United States Patent 11,098,302 (IDENTIFICATION OF POLYNUCLEOTIDES ASSOCIATED WITH A SAMPLE) - sequence listing, part 107

SEQ ID NO: 367849 - DNA, 736 bp, Homo sapiens
  misc_feature: GZ8MTXP02I48MX.19.57.F02.1.454.CMB.2.raw
  modified_base (222)..(222): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctggtaggagacagagtcaccatcacttggcggngagtcgaggattagtaggcgtcgttcggttaggctaggtatcgagcaagaaacgaccgaaccgggaaaccccctaagcctaccgtagtacttcgtaagtggtcgtacctaacgttacccgtaacggttttaacggggaaacggttccggggttaccccctaggtaaacggtttcccgacggcggacgtaggttggacgtcgtggggaactagtactttccgacttcgccgcctatcgagccagcctgacagactagtaagttagtttacgtaaccttaatttttagtttacgactaaaccgtacggttaacccttaacccgtttccctttacccccgtacgtttaccgggtttacccggggaacgggtaaccgggtaaaccgggtaaacggggttacgggaaacgttaacgttaaccggaaacggtacccgggtaaaaccgttggttaaccgggaaccgttaccgggaacccgtaacccttacgtttcccggtttaccgttcccgtttaacccg

SEQ ID NO: 367850 - DNA, 645 bp, Homo sapiens
  misc_feature: GZ8MTXP02HFRMX.19.57.F02.1.454.CMB.2.raw
  modified_base (198)..(198): a, c, t, g, unknown or other
  modified_base (306)..(306): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccattcttccgtgtctgcatctgtagganacagagtcaaccatcacgttggtcggcgagtcaggtatagttaggcgtctcgttaggctggtatcagcaagaagcgaacggaacccctagcctcctgatctagtggtnctatccctagtttaggaaacggtccgggtccctagtaagtccgagcggcagtgatcgtgggactagtactttcgacttcgtccgacctagtcgaacgctacgcctagccaagaccgttagtaaagtttactttcgtaaacctttaaacgtttttacgttttcggtaaacctaaacgtacggttaacccttaaacccttacccgttttaccccctacggttaaccggtttccggggaaccgggtaaacgggaaccccgttaaagggtacggagtaaacgtacgaaaacggtcccgtaaacgtggtacggtctcggacctactattccgtagttccttacc

SEQ ID NO: 367851 - DNA, 749 bp, Homo sapiens
  misc_feature: GZ8MTXP02HBNNY.19.57.F02.1.454.CMB.2.raw
  modified_base (197)..(197): a, c, t, g, unknown or other
  modified_base (226)..(226): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagacgtcaccatcacgttggtcggggngagtcaggtattagtaggcgtcgtacggtaggctggtatcgagacaagaaacgcgaaccgggaaacccctaagcctccagtactcgtagtggtacactacgtacctaacggtttagggaaacgggttcccggggtaccccctaaggtaaacgggttccccgaacggggccggtacgtaaggggtacgggtaacgttcgggtacgggggtaacttaaaggttaccttttacccgaaccttccgttacccgacctaactaccgacgtaccgacggtcccgtagaccgtaacgtacgtaaggtaagtttacgtttacggtaaacttttaaactttttagtttttaccggaactaacgtaacggttaacccttaaccctttaccccctttaccccctacggttaccggtttaccggggaacggggtaacggtaaccggtaaggggtacggtacggtaactaacggaaacgtacccgtaaaggtcggtacggtcgtacgacctactacgttcttaccgttcttacccg

SEQ ID NO: 367852 - DNA, 646 bp, Homo sapiens
  misc_feature: GZ8MTXP02HHNPF.19.57.F02.1.454.CMB.2.raw
  modified_base (197)..(197): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggtcgggcgagtcaggatagttaggcgtctcgtaggctggtatcagcagaaagcgaacggaacccctaagcctcctgatctatggtgcatcctacgtttagggaaacgtcggggtcccctagtaacggttccgacggcggcgtaggtggacgtcgtggggactagtactttccactcctcgccatcagcacgcctgaccagactaggtaattacgttttgacttaactttttagtttcgtactaacgtacgtaccttaaacccttccccttttaccccctacgttacccggtttacgggaccggggaacggtaaacccggtaacggttagggaaacgtacgttaaacggaaacggtacccgttaacgttcgggtacggaaccttacggaccccttaccgtaacttcccggtttacgtttacccttttcccg

SEQ ID NO: 367853 - DNA, 558 bp, Homo sapiens
  misc_feature: GZ8MTXP02HOEI4.19.57.F02.1.454.CMB.2.raw
  modified_base (287)..(287): a, c, t, g, unknown or other
  modified_base (359)..(359): a, c, t, g, unknown or other
  modified_base (535)..(535): a, c, t, g, unknown or other
  modified_base (542)..(542): a, c, t, g, unknown or other
  modified_base (549)..(549): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcacatcacttggtcgggcagtcaggatataggcgctcgtaggctggtatcagacagaaagcgaacggaaacccctaagctccngtatctatagtgctatcctagttaggaaacggtcggggtccctacgtaaggttcccagcgcaggtgacttgnggggacagtactttcacctctcgccatcagcagcctgcagtactagaacgttattcgtaacttaaacgtttattttacgtactaacgtagtaccttaaactcccttaccctctacgtttcggacggtagaccgtaaggtggacgacttacgaaacggtcaaccggtgtacgcgtcncgtaacntttccgngttcttacc

SEQ ID NO: 367854 - DNA, 810 bp, Homo sapiens
  misc_feature: GZ8MTXP02IGEJT.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttcgtgtctgcatctgtaggagacagagtcaccatcacttggtcgggcgagtcaggattagttaggcgtctcggttaggctggtatcagcaagaacgcgaacggaaacccctagcctcctagatctagtggtcactactaccgtacgtttagggaaacgggttcccggggtaccccctaggtaaacgggtttccccgaaagggcccgggtacgtagggttacggggtacgttaccgggttacggggggtaaacctaacgggtttaacctttttaccccgtaaacccgtttcccgtacccggtaccccctaaacgtttcccgaaaccggtcccggaaacggtccccgttacggaaccgtaaacggtaaccgttaaagggttaaaacgtttaagtttttaccgaaacccgtttttaaaacttttttacggtttttacggttaaaccctaaacgggttaaccggttaaacccttaaacccgtttaccccctttacccccgttaacgtttaccgggtttaccggggaccggggtaaacgggtaaacccggtaagggtcggtaaacgtaaacttaccggaaacgtaccgtaacgttggtcggtaactcgaaccgtactacgttcgttacgtttccttaccg

SEQ ID NO: 367855 - DNA, 635 bp, Homo sapiens
  misc_feature: GZ8MTXP02INFHZ.19.57.F02.1.454.CMB.2.raw
  modified_base (204)..(204): a, c, t, g, unknown or other
  modified_base (399)..(399): a, c, t, g, unknown or other
  modified_base (407)..(407): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatcgacccagtctccatcttccgtgtctgcatctggtaggagacagngtcacatcacgttggtcgggcgagtcgaaggtatagttaggcgtcttcggtaggctggtatcaagcaagaacgcgaaacggaaaccccagcctctagatctagtgtgctactcctagtttaggaaacggtccgggtccctacgaaggttccgacggcgacgtagtgagttcgtgggactagtacttccgacttcncgcctaancgacgctacgcgacgacgaagttacgtaagtaagttctttaacgttactttaacttttagtttacgtaacgtaaacgtacgttaacccttaaccttaccccgtttccccgtacgttacggtaccgggacgggtaaacggtaaccggtaaggtacgtaacgtaacgtaacgaacgtacgtacgtggtaccgaacgtcgaacctactcgtttccgttacgtttactaccg

SEQ ID NO: 367856 - DNA, 670 bp, Homo sapiens
  misc_feature: GZ8MTXP02FFSY2.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagatcaccatcacttggcggcagtcaggattataggcgctcgttaggctggtatcagcaagaaagcgaacgggaaaccccctaagcctacctgactctagtggtgcatcctacgttagggtaaacgttcggggtaccctacgtaaaggttcccgacggtccggacgtaggtggtagtcggtggggacaaggttatttccaacgttcgtccgacctaaatccacggactaacgcccgtagaccgaagtaccgtaaggtaagttacttttacgacctttaaactttaagtttttacggaacctaaacgtacgggtaaccttaaaccttaccccgtttaccccctacgtaccgtttacgggaccggggtaacgggaaccgtaaacggggtaggaagtaacgtaacgaaacggaccggtaaacgtcggtacgggtcgtacgacccaaacccgttacgttacgtacgtaccttacg

SEQ ID NO: 367857 - DNA, 703 bp, Homo sapiens
  misc_feature: GZ8MTXP02GDZBI.19.57.F02.1.454.CMB.2.raw
  modified_base (686)..(686): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatcgacccagtctccattcttccgtgtctgcatctggtaggagacagagtccaccatctacgttggtcgggcgagtcgaggtattagttaggcgtcgttcggttaggctaggtatcgagacgaaggaaacgaccgaaaccgggaaaccccctagcctaccgtgactcgtagtcggtacactactacccgtaaggtttagggaaacggttccggggtaccctaggtaacggttcccgacggcggataggtggtacgtcggtgggactaggttacttccaccgttctaccgactacgtcgaacgtcacgtcgtacgacgtagtaacgtaaggtaatttacgtttacgtaaacttttagttttaacgttttacgaaacgtaaccgtaacggttaacccttaaacccctttccccgtttacccccgttacggttaaccgggtttaccggggaacggggtaaacgggtaaccgtaaagggttacggaagtacgtaacggacgtacggtacgtggtacggtaactacgactactnttccgtacttccttacc

SEQ ID NO: 367858 - DNA, 635 bp, Homo sapiens
  misc_feature: GZ8MTXP02FH3R5.19.57.F02.1.454.CMB.2.raw
  modified_base (203)..(203): a, c, t, g, unknown or other
  modified_base (227)..(227): a, c, t, g, unknown or other
tcagtactctcgtgcacgaccggtgctcgatttagctcgatatagttgggtttgggggcaggagtcagacccagtcaggacacagcatggacatgagggtcccccgctcagctcctggggctcctgctgctctggttccccaggttccagatgcgacatccagatgacccagtctccatcttccgtgtctgcatctgtagganacagacgtcaccatcattgcgggngagtcaggatagtaggcgtcgtcgttaggctaggtatcgagacaagaaacgccgaaaccggggaaaaccccctaagcctacctagatctagtggtgacactaccgtaacgtttagggaacggttccggggtccctacgtaggtcagcggacaggtgatcgtagggaactagtatttcgactcctccgactatacacgcacgtccgtacgacgaacgtactaagtaagttaacgttttacgacctttaaacgttttagttttacgtaacgtaaaacgtacgttaaccttaaacccttacccctttacccccgtacgttaccggtttcggaaccggtacgggaaccggtagggtagaggtaactacgaaacgtcgtaagtcggtcgacgtacgactacgtacttcgttac

SEQ ID NO: 367859 - DNA, 703 bp, Homo sapiens
  misc_feature: GZ8MTXP02JVKZ8.19.57.F02.1.454.CMB.2.raw
  modified_base (197)..(197): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcacatcacttggtcgggcgagtcaggtatagttaggcgtcgtcggttaggctggtatcgagacagaaacgcgaacgggaaacccctagcctctgatctagtggtgctactaccgtacgtttagggaaacggttccggggtacccctacggtaacggttcccgacggtcggacgaggttcggagttacggtcggggaaactaggttactttaccgaccgttaccgccgacctactccgaacgccgtacgtctcgacacgtacgtaagtaagttactttacgttaacttaaacgtttttagttttacgaacgttaaccgtacggttaaccttaaacccgttaccccctttttacccccgtaccgttaaccggtttccggggacggggtaaacggggaacccggtaaggggttacggaaacgtacgtaaccggaaacggtacggtaacgttcggtacgggccttacggaccctaacggtacttccgttccgttactttcccg

SEQ ID NO: 367860 - DNA, 873 bp, Homo sapiens
  misc_feature: GZ8MTXP02HCFHA.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtcctccattcttccgtgtctgcatcgtggtaggagacagacgtcaccatctacgttggcgggcagtcgaggtattagtaggcgtcgtcggtaggctggtatcgagacgaaggaaacgaccgaaaccgggaaaccccctagtcctcctagtacttcgtaagtggtcgctaacgttacccgtacggtttaacggggaaaccgggttcccggggtacccctacgggttaaacggtccccgacgggccggtacgtagggttcgggtaacgttcgggtacgggggaaccttaaaggttaccttttacccgaaccgtttcccgtaccgaccctaaacgttcccggaaccgaccgtaaccgggtcccgtagggaaccgtaaacggtacgtttaaacggggtaaagtttacgttttaaccggtaaacctttttaaacgttttttaacgttttaaccggtaaacctaaaaccggttaaccggtttaacccctttaaaccccgttttaacccccttttccccccgaacggtttaccccgggtttacccgggggaacgggttaaaccgggtaacccggggttaaaaggggtacgggtaacgtaaacgggttaaccgaaaaccgggtaccgttaaaccggggtggttaacccgggtcctaaccgggtaaccccttaaacggtttaccgtttaccgttccggtttaacccgtttaccccg

SEQ ID NO: 367861 - DNA, 663 bp, Homo sapiens
  misc_feature: GZ8MTXP02FQMDW.19.57.F02.1.454.CMB.2.raw
  modified_base (200)..(200): a, c, t, g, unknown or other
  modified_base (226)..(226): a, c, t, g, unknown or other
  modified_base (411)..(411): a, c, t, g, unknown or other
  modified_base (642)..(642): a, c, t, g, unknown or other
tcagtactctcgtgcacgaccggtgctcgatttagctcgatataggttgggtttgggggagtcagacccagtcaggacacagcatggacatgagggtccccgctcagctcctggggctcctgctgctctggttcccaggttccagatgcgacatccagatgacccagtctccatcttccgtgtctgctatcgtgtagganacagagtcaccatcacgttggcgggnagtcaaggtatagttaggcgtcgttcggttaggctggtatacgagcaaggaaacgcgaaaccgggaaaccccctaagccttaccgtgtactactagtcggtcgactactaccctaacggtttaggaaacggttccggggtacccctaggacggttaccacggccggagtaggtaggacgttacgnggggtactaacgtactttaccaccttctaccgacaatccaagcagccctgaccactagtagtaaacttagtttactaaacctttaaatttttagtttacgaacgtaaacgtaaccgtacccttaaaaccctttcccgtttaaccccctgttaaccggtttacggaccggggtaacggtaaccggtaaacgggtgaaacgtactacgaagtaccgaagtccgtaggcgaacncgtactcgtcgtcttactacg

SEQ ID NO: 367862 - DNA, 651 bp, Homo sapiens
  misc_feature: GZ8MTXP02FX21X.19.57.F02.1.454.CMB.2.raw
tcagtactctcgtgcacgaccggtgctcgatttagctcgatatagttgggtttgggggagtcagacccagtcaggacacagcatggacatgagggtcccccgctcagctcctggggctcctgctgctctggttcccaggttccagatgcgacatccagatcgacccagtcctccattccttccgtgtctgcatcgtaggtaggagacagacgtccaacctatcctacgttcggtcgggcgagtcgaaggtattaggttaggcgtcgttacggttaggctggtatcagacgaagaacgaccgaaaccgggaaaccccctagcctaccgagtatcgtagtggtcgacctactacccgttaggttacgggtaaacggtccgggtacccctaggtacggttccgacggcggagtaggtggacgttcggtagggactacgttactttaccgactctccgactactacgacgacacgtcctagcgaagtactagtaagttacttacgtaactttagtttgtttacgactaaacgtacgtaccttaacccttcccgttcccgtacgtaccggttcgggacggtacggaacgtagggtacgaatacgtaacgaacgccgtaagtgtacggctacgacctactgttacctcgttccttac

SEQ ID NO: 367863 - DNA, 573 bp, Homo sapiens
  misc_feature: GZ8MTXP02GK7RN.19.57.F02.1.454.CMB.2.raw
  modified_base (197)..(197): a, c, t, g, unknown or other
  modified_base (446)..(446): a, c, t, g, unknown or other
  modified_base (526)..(526): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacgttggtcggggcgagtcgaagggtattagttagggcgcgttcggttaggctggtatcagacagaaagcgaacgggaaaccccctaagcctctgatctagtggtgcatcctacgtttaggaaacggtcgggtaccctacgacggtccagcgctaggtgatcgtgggacagtattcactctacgccatcgagtcacgcctgacacgtatagtaagttagtttgacttaacttttntttacgtacaaacgtacggtaccttaacctaccctttccccagttaaccgttcggacggtaagggacgtaacggtggtanacgtacgaagcgtaacgtgtaggctcgactacatcgtactctttacc

SEQ ID NO: 367864 - DNA, 904 bp, Homo sapiens
  misc_feature: GZ8MTXP02JP2JV.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctggtaggagacaggacgtcaccagtcacgttggtcggcgagtcgaggtatagtaggcgacgttcggttaggacgtggtatcgagacgaaggaaacgaccgaaaccggggaaaaccccctaaggccccttaccgtacgtactttaccgtaggttggttacgacctacgtttaccccgttaacggttttacggggttaaacgggttacccggggggttaccccccttaacgggttaaacggggtttcccccgaaacgggtcccggggtaaccgtaggggttacgggtacgttacgggttacgggggtaacctaagggttaaaccgtttttccaaccgtttcccgtacccggtaccctaacttacccggaaacttccccgacggtacccccgttaagggaccccgtaagggtaaacccgtttaaaggggttaaacgttttaccgtttttacggtaaaccgttttaaacgttttttttaaactttttaccgggtaaaccttaaaaccgggtacccggtttaaaacctttaacccctttaacccccgttttccccccgttagtttaacccgggtttacccggggaaacgggggtaacggggtaaacccgtaagggggttacggaaacggtaccgtaaacggtaaacgaccggggtaaacgttcggtaaccggtcctaacggtccgtaaccccgtttagttaccgttcgttacccttaccg

SEQ ID NO: 367865 - DNA, 695 bp, Homo sapiens
  misc_feature: GZ8MTXP02FMYLW.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacgttggtcgggcagtcaggatagttaggcgcgttcggttaggctggtatcagacaagaacgacgaacgggaacccctagcctcctgtactcgtagtggtcgctacttcccgtagtttagggaaacggtccggggtacccctagtaacggtccgaggccggacgtaggtggtactcggtggggactaggtactttccgacctcgtccgacaagtcaagccacgcctagccgtaagacgttaaggtaatttacgtttacgtacctttaaagttttacgtttttacgaaccgtaaaccgtacggttaacccctttaaacccctttacccgttttaccccccgtagtttaacccgggttaccggggaaccgggggttaaacgggaacccggttaaaggggtcggtaaacggtactaaccggaacggtaccgtaacgtcggtaccggtaactcggaccctaacctgtttaccgttacttctttacccg

SEQ ID NO: 367866 - DNA, 818 bp, Homo sapiens
  misc_feature: GZ8MTXP02IKQR4.19.57.F02.1.454.CMB.2.raw
  modified_base (316)..(316): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccattcttccgtgtctgcatctggtaggagacagagtcaccatcacgttggcgggcgagtcaggtatagttaggcgtcgttcggttaggctggtatcgagacaagaagccgaacgggaaaccccctaagctccgtgtatctagtggngactacgtacctacgtttagggaaacggttccggggtacccctagtacggttccgacgcggacgtaggtggtacgttcgtcggggtactaaggttactttaccaccttccgtaccgcctactcgacgtacgacgtacccgtagaccgtaacggtaaccgttaggttaaaacgtttacgtttttacgtaaacccgtttttaaaacttttttaaacgttttttaccggttaaacccgttaaaacccgtaccgggtttaaaacccctttaaaacccccgtttaccccctttttaccccccggtttacccgtttaaaccccgggtttttaccgggggaaacccgggggttaaaccgggggtaaaccccggtaaagggggtttaacggggaaacggttaaccgttaaaccgggaaacgggttaccgggtaaaacggttcggtacccggggtaacttcgggaaccccttaacccggtactttcccgtttacggtttccctttaacccg

SEQ ID NO: 367867 - DNA, 644 bp, Homo sapiens
  misc_feature: GZ8MTXP02H1KZ1.19.57.F02.1.454.CMB.2.raw
  modified_base (197)..(197): a, c, t, g, unknown or other
  modified_base (323)..(323): a, c, t, g, unknown or other
  modified_base (434)..(434): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtccaccatctacgttggtcgggacgagtcgaagggtattagttacggcgtacgtcggttaggctggtatcgagcgaagaaacgacgaaccggaaaccccagctcctagtatctagtggtnactactactagtttaggaaacggtccgggtaccctagaacggttccgaggcgctaggtgactcggtgggaactagttactttccacttcgacgtccactcgacgcacgtcngacagtacgtagtaaagttctttaagtactttaaacgtttttgtttacgaacctaaaaccgtcgtaaccctttaaccttaaccccgtttcccctacgttaaccggtttaccgggaacgggtaacgaaccggtaggtacgagtaacgttaccggaaagtcggacgttcggcgtaacgtcgtaacgtacctacgttccttagttacctttcg

SEQ ID NO: 367868 - DNA, 699 bp, Homo sapiens
  misc_feature: GZ8MTXP02H36NX.19.57.F02.1.454.CMB.2.raw
  modified_base (197)..(197): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaaccatcacgttggcgggcgagtcaggtatagttaggcgtcgtcgttaggctggtatcagacaagaaagcgaacgggaaacccctaagctcctgatctagtggtgcactccgtaacgtttaggaaacggtcggggtacccctagtaacggttcccagcggacgaggtggacgttcgcggggactaggtactttccgaaccttcgtaccgacctactccgaagccgaacgtccctagaccgaagtactaggtaaacgttattttacgacctttaaacttttacgtttttacggaactaaacgtaccgggtacccttaaaacccgttacccccgtttacccccctacgttaacccggttttaccgggaccggggtaaaccgggtaaacccgtaaacggggtaggaacgtaacgttaaccggaaaacgggttccgtaaaccgttgggtacggtccgttacggaacctacctacgttccgtttcgtaccctttacccg

SEQ ID NO: 367869 - DNA, 633 bp, Homo sapiens
  misc_feature: GZ8MTXP02G5QSB.19.57.F02.1.454.CMB.2.raw
  modified_base (299)..(299): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattggcgctcgttaggctggtatcagcagaaagcgaacgggaaccccctaagctcctgatctatggtncatccctacgttttagggaaacgtcggggtacccctagtaacggttccacggtcggcaggtggatcgtggggatagtatttacacctctcgcctatcagacacgcctgcagactgaaagttctttagaacttaaacgttttagtttttacgtactaaaaccgtacggtaaccttaaacccttaccccttttacccccctacgttaacccgttttccggggaaccgggtacgggaacccgtaaaaggggtcggtaaacgtacgttacgaaacggtaccgtaaaccgtggtacggtccgttacgactaacctacgtaccgttcgttacctttaccg

SEQ ID NO: 367870 - DNA, 705 bp, Homo sapiens
  misc_feature: GZ8MTXP02FF9JA.19.57.F02.1.454.CMB.2.raw
  modified_base (205)..(205): a, c, t, g, unknown or other
  modified_base (232)..(232): a, c, t, g, unknown or other
  modified_base (335)..(335): a, c, t, g, unknown or other
tcagtactctcgtgcacgaccggtgctcgatttagctcgatatagttgggtttgggggcaggagtcagacccagtcaggacacagcatggacatgagggtcccccgctcagctcctggggcctcctgctgctctggttcccaggttccagatgcgacatccagatgacccagtctccattcttccgtgtctgcatcgtgtagganacagacgtcaccatcacgttggcgggngtagtcgaaggtatagtaggccgtcgttacggttaggtctaggtatcgagacaagaaacgaccgaaaccgggaaccccctaagcctcctagactctagtggtnacctactccgttacgtttaggaacggttcccgggtaccctacgtaacggttcgaacggtcggagacggttggtacgtcggtacgggaactagttaactttcgacttacgtacctactagtacgacgacgacgtcccaagaccgaaagtacgtaagtaacgttattttacgaaactttaacgttttagttttacgaaccgtaaacgtaccgttaacccttaaaccctttacccccgtttttacccccgacgttaccgggtttaccggggaaccgggtaaacggaaaccggtaaggggtaccgaaagtacgtaacccgaaaggtaccgtaaacgtcgggtacgccgtacgaccgtaactacgttccgttacg

SEQ ID NO: 367871 - DNA, 538 bp, Homo sapiens
  misc_feature: GZ8MTXP02FMT8N.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcaagggaaacccctaagctcctgatctatggtgcatccactttggaaagtcggggtccctcaggttccagcgcagtggatctggggacagatttcactctcgcatcagcagcctgcagactgaagtatttgactaaactttattttgtactaaacaggtacctaaacctacctttccccctactacgtttccggacggtacgggaccaagggttcgaagtactacaaacggtcgaaactggtacggctcggacaccgatcgtacgtctttacc

SEQ ID NO: 367872 - DNA, 613 bp, Homo sapiens
  misc_feature: GZ8MTXP02HHR3U.19.57.F02.1.454.CMB.2.raw
  modified_base (198)..(198): a, c, t, g, unknown or other
  modified_base (315)..(315): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctggtagganacagagtcaccatcacgttggtcgggcagtcaggtattagttagggcgtcttcggtaggctggtatcagacaagaaacgcgaaaccgggaacccctaagcctcctgatctagtggtncgtactcccgtacgtttagggaaacggttccggggtcccctaggtaacggttccgacggcggactaggtggactcgtggggactagtactttcactcgacgccagtcagcacgctgcagacgtagtaagttactttcgacttaacttttagtttcgtaacaacgtacgtaccttaacccgttacctttcccctacgttacggtttaccgggacgggtacggtaaccgtaagggtacggtacgaacgtacggaaacgtccgaacgtggtacgctcgacactacgtcgtcgtactttccg

SEQ ID NO: 367873 - DNA, 711 bp, Homo sapiens
  misc_feature: GZ8MTXP02HJBJD.19.57.F02.1.454.CMB.2.raw
  modified_base (197)..(197): a, c, t, g, unknown or other
  modified_base (305)..(305): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccattcacttggtcggcgagttcaggtatagttaggcgtcgtcgttaggctggtatcagcaagaagcaacggaaacccctagctcctgatactagtggngcatcctaagtttaggaaacgtcggggtacccctgaagttccgagcgacaggtgactacgtggggactagtactttcacgttcaccgtcactcacgtcaggccctgtacgacgtaacgtaggtaaagttacgtttaacgtaccttaaaaccggtttttttacgttttaacggttaaaccgtaaaccgtaaccggttaaacccctttaaacccgtttacccccgttttacccccgttaacggtttaacccgggttaccggggtaacccggggttaaaaccggggtaaaccggttaaacggggtacggtaaacgtaaccggtaaaccggtaaacggtaccggttaacggttcggtacggtaaccgttacgaaccgtaccgtacgtttacgttacgtttacccttaccg

SEQ ID NO: 367874 - DNA, 782 bp, Homo sapiens
  misc_feature: GZ8MTXP02H346L.19.57.F02.1.454.CMB.2.raw
  modified_base (196)..(196): a, c, t, g, unknown or other
  modified_base (221)..(221): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaganacagagtcacatcacttggtcgggnagtcgaggtatagttaggcgtctcggttaggcttggtatcgagcaagaaacgacgaacgggtaaaccccctagccgtcctgaacttctagtcggtagactacttaccgtacgtttagggaaacggttccggggtacccctaggtaacggttccgacggtccggacgtaggtcggtaacgttcgtggggaactaggttactttacccgattcccgacgacctactaccgacggaccgacgtcccgtacgaccgtaacggtacttaagggtaaacgtttacgttttaacgtaaacccgttttaaattttttaacgttttttaacggtaaacccgtaaaccgtttaacccgggtaaaaccctttaaacccgtttaccccttttacccccccgtttaacggttaaaccccggtttttaccggggaaccggggtaaaccggggttaaccggtaaaacgggggtaccgggtaaaggtttaacgaaaccggtaaacggtacgtaaacccggttggttaaccgtcgacgtaacccaccggttatttaccgtaccggtttcctttacccg

SEQ ID NO: 367875 - DNA, 701 bp, Homo sapiens
  misc_feature: GZ8MTXP02I48GV.19.57.F02.1.454.CMB.2.raw
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggcgggcgagtcaggattagttaggcgctcgtaggctggtatcgagcgaagaaagaccgaacgggaaaccccctaagcctcctagatctatggtgacacttcctacgtttagggaaacgtcggggtcccctagtaaggttcccaaggcggacaggtaggatcgtggggaactagtactttccgaaccttcgtccgacctaatccaaggaccgacgacccgttagaccgaagaaaccttagggtaaacttagttttacgaaaccgttaaactttttagtttttacggaaactaaaaccgtcgggttaaacccttaaaacccgttaccccttttaccccccgtacgttacccggtttaccggggtaccggggtaaacgggaaccccgtaaaggggtacggtaaacggtaacgttaacgaaaacgtaccggtaaaacgttggtacggaacttcggaacctaaacgactttacggttcttactttaacccg

SEQ ID NO: 367876 - DNA, 830 bp, Homo sapiens
  misc_feature: GZ8MTXP02F1R9X.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatcgacccagtcctccattccttccgtgtctgctatcgtaggtaggagacagacgtaccacctatcctacgttggcgggacgagtcgaggtattagttacggcgtcgttacggttaggcttaggtatacgaggacgaaaggaaacggaccgaaaccgggtaaaccccctagccttaccgtagtacttcgtagtcggcgtacctacgttacccgttaaggtttacggggtaaacggttccggggtacccctaggtaacgtcccgacggccggtagtagggtcgtaacgttcgggtacggggaacttaaggttacctttaccgaccttaccgtacccgaccgtacgtaccgacggaccgtacgtcccgtacgaactaacggtacgttaagttaacgtttacgtttaccgtaaaccgttttaaacgttttacgttttaccggaacgtaaacccggttaacccgttaaccctttaaccccttacccccgttttacccccgtaacggtttcccggggttaaccgggggtaaccggggtaaaccggggtaacccggtaaggggtcggtaaaccgtacggtaaaacccggtaaggtacccggtaacggttacggttaccgggaaccgttccggaaacccttaccgtttaacgttccggttaccgtttaccctttaacccg

SEQ ID NO: 367877 - DNA, 756 bp, Homo sapiens
  misc_feature: GZ8MTXP02JYIJB.19.57.F02.1.454.CMB.2.raw
  modified_base (203)..(203): a, c, t, g, unknown or other
tcagtactctcgtgcacgaccggtgctcgatttagctcgatatagttgggtttgggggcaggagtcagacccagtcaggacacagcatggacatgagggtcccccgctcagctcctggggctcctgctgctctggttcccaggttccagatgcgacatccagatcgacccagtctccatcttccgtgtctgcatctgtagganacagacgtcaccatctacgttggtcgggcgagtcaggtatagtaggcgcgttggttaggcttaggtatcgagacgaagaaacggtacgaaaccgggtaaaccccctaagccttcctaggacttacgtagtggttcgcctacgttcccgttaagtttagggtaaacggtccggggttacccctacgtaacgggttcgacggcggtacgaggttcggacgttcgggtcgggtaaactagtttacttccctaacgtccgtaccgaccttaacaccgacgtaccgaccgtcgtacgcgtaaacgtacgtaggttaaaagtttccgttttagaaacctttttaacgttttagtttttacgaaccggtaaaccgttaccggtttaaacccttaaccctttacccccgtttacccccgttaacggttacccggggtttccgggaaacgggggaaaccgggtttaacccggaaaggggtacggtaacgtacgttaaccggaaggtaccgtttaacgcgggtcggtacgttaccgaccgttaacctacgtcggttttacccg

SEQ ID NO: 367878 - DNA, 591 bp, Homo sapiens
  misc_feature: GZ8MTXP02HW3PF.19.57.F02.1.454.CMB.2.raw
  modified_base (305)..(305): a, c, t, g, unknown or other
  modified_base (318)..(318): a, c, t, g, unknown or other
  modified_base (407)..(407): a, c, t, g, unknown or other
tcagtactctcgtgcacgaccggtgctcgatttagctcgatatagttgggtttgggggcaggagtcagacccagtcaggacacagcatggacatgagggtcccccgctcagctcctggggctcctgctgctctggttcccaggttccagatgcgacatccagatgacccagtctccatcttccgtgtctgcatctgtaggagacagagtcaccatcacgttggtcgggacgaggtcaaggattagttaggcgtctcggtaggctggtatcgagacagaaacgcgaacggaacccctaagctaccngatcgtatggtanctagtcctacgttaggaacgtcgggtcccctagtaaacggttccaaggtcggactaggtgtacgtcgtaggacagtactttcgacttcncgctatacgcgtcaagcctgacagtacagtaaagttatttcgtattaacttttactttttagaacaaacgtcgtaactaacccgttacctttaccccgtcttaacgttcggacggtacggaacgtacgggtgaacgttacgacgtaacgacgaactggtcgacgtcgtaccacgtactacttcg

SEQ ID NO: 367879 - DNA, 747 bp, Homo sapiens
  misc_feature: GZ8MTXP02GZ1OC.19.57.F02.1.454.CMB.2.raw
  modified_base (197)..(197): a, c, t, g, unknown or other
  modified_base (202)..(202): a, c, t, g, unknown or other
tcagtactctcgtgcacgaccggtgctcgatttagctcgatatagttgggtttgggggagtcagacccagtcaggacacagcatggacatgagggtcccccgctcagctcctggggctcctgctgctctggttcccaggttccagatgcgacatccagatgacccagtctcatcttccgtgtctgcatctgtagganacagngtcaccatcacttgcggcgagtcaggatattaggcgctcgttaggctggtatcgagcaaggaaagcgaacgggaaacccctagctcctagtatctagtgtgcatccgtacgtttagggaaacggtccgggtaccctgaacggttcacggtcggacgaagtcggtacttgacggggtaccaagttacgtttaccaaccgttccgtaccgtacccaaacgttcgaaacggcctaacggtccctcggtacccaaggggtacctaagggttaaaggttaaacctttttcggaaactttaaactttttaacggtttttaggaaccttaaacgttaacccgggtaacctttaaaacccccgtttccccttttaaccccccccgtttagtacccccgggttttaaccggggtaccggggaaacggggtaaaccccggttaaaacggggtaccgggtaaagtacgttaaaaccgaaacgggttacccctaaaaggttcggtacgggtcttacgaaccctaaccggtacttaccggttcgttaccctttaaccg

SEQ ID NO: 367880 - DNA, 600 bp, Homo sapiens
  misc_feature: GZ8MTXP02GII18.19.57.F02.1.454.CMB.2.raw
  modified_base (179)..(179): a, c, t, g, unknown or other
  modified_base (199)..(199): a, c, t, g, unknown or other
  modified_base (261)..(261): a, c, t, g, unknown or other
  modified_base (316)..(316): a, c, t, g, unknown or other
  modified_base (354)..(354): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgngtctgcatctgtaggagacngagtcaccatcacttgcggcagtcaggatattaggcgctcgttaggctggatcagcagaaancacggaaacccctaagctcctgatcatgtgcatccatttggaaagtcggtcccanaggttccagcgcagtcggatcgtggggacaaacggttnttacgacttcgaccgacctactacgacgcacgcgtgacacgtactaggaagtagtttacgtacttaaactttattttacgtactaaccgaacggtacctaaaccgttacccgtttaccccgttaccgttaccgtttacgggaccgggtacgggtaaccgtaacgggtacggaaggtacgtaacgaaacgtacgaaccgttagtacggtaacgtcggtacctaccgtacgtcgttacgtactttacg

SEQ ID NO: 367881 - DNA, 595 bp, Homo sapiens
  misc_feature: GZ8MTXP02FQMJY.19.57.F02.1.454.CMB.2.raw
  modified_base (195)..(195): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatctccgtgtctgcatctgtagganacagagtcaccatcacttgtcgggcagtcaggatattaggcgctcgttaggctggtatcagcaaggaaagcgaacggaaaccccctaagctcctgatctatggtgcatcccatttggaaagtcggggtccctcgaacggttccagtcggcaacgtggatcgtggggacagtatttccactctcgcccatcgacgcacgcctgacgacgcgtaagtaacgtattttagacttaactttatttttacggactaacgtacggtacttaaacccttacccttttacccccattaaccggtttcggttaagggaccgggtaacggtaaaagggttcggggaattagacgaaacgtccggtaaactgggtaggtctacggacctaccgtacgttcctgttacttcc

SEQ ID NO: 367882 - DNA, 593 bp, Homo sapiens
  misc_feature: GZ8MTXP02JXKA7.41.71.G05.1.454.CMB.2.raw
  modified_base (383)..(383): a, c, t, g, unknown or other
  modified_base (397)..(397): a, c, t, g, unknown or other
tcagtctatactatcacgaccggtgctcgatttagtgtcgtcgcaagagagaggagcccagccctggggactgaacagagagaactcaccatggagtttgggctgagcgtggcttttctggtggctgttttaaaaggtgtccagtgtgaagtgcagctgttggagtcggggggaggcttggtacagccgggggggtccctgacactctcctgtgcagcctctggattcgcctttaatacctatgccatgatctgggtccgtcaggccccaggggaaggggctggagtgggtctcgatccgattactggtggtagtgccacaaatgtcgcagactccgtgaacgggccgcttcatcccgtctccaggacatccaagatacggtnttctgcagatgaanacgcctgcgagtggacgacgaccggtccctttattaccgtgtacgccgaagcggggtcgacgagaaacgttaacaaacaactacgaaattattaactactaacagttacgggaacgtccgtaggggacgaaaacggggacccccgttacgaacccggtcgtcccttcgacgccctaccgacccgacgggacccccg

SEQ ID NO: 367883 - DNA, 587 bp, Homo sapiens
  misc_feature: GZ8MTXP02GX16G.41.71.G05.1.454.CMB.2.raw
  modified_base (396)..(396): a, c, t, g, unknown or other
tcagtctatactatcacgaccggtgctcgatttagtgtcgtcgcaagagagaggagcccagccctggggactgaacagagagaactcaccatggagtttgggctgagctggcttttcttgtggctgttttaaaaggtgtccagtgtgaagtgcagctgttggagtcggggggaggcttggtacaggccggggggtccctgacactctcctgtgcagcctctggattcgcctttaatacctatgccatgatcgtgggtcctcacggccccgaggggaagggctggagtgggtctcatccattactggtggtagtgaccacaaatgtcgcagacctccggtgaacgggccgctcatcccgtctccgaggacaattccaaagtacgtacgttgtttacngtcagatagaaagagcctagcgagtggaacgacgacgtaccctttaatacctgtcgccaggacgggtcacgtagaagttaacaaacaataacaaagttattactaaactacagtggacgtcgtacggggaccaaacggggaccccgtcgaccgtcctccgtacaccgcctacccgaaccgacgggaccccc

SEQ ID NO: 367884 - DNA, 668 bp, Homo sapiens
  misc_feature: GZ8MTXP02FFSQY.41.71.G05.1.454.CMB.2.raw
  modified_base (542)..(542): a, c, t, g, unknown or other
tcagtctatactatcacgaccggtgctcgatttagtgtcgtcgcaagagagaggagcccagccctggggactgaacagagagaactcaccatggagtttgggctgagctggctttttcttgtggctgttttaaaaggtgtccagtgtgaagtgcagctgttggagtcggggggagcttggtacaggccgggggggtccctgacactctcctgtgcagcctctggattcgtcctttaatacctatgccatgatcgtgggtcccgtcgacggccccgaggggaaggggctgggagtgggtctcgatccattactgggtcggtagtgaccaacgaaagtcggtcgacacggtacctccggtaggaaacggggtcccgctttcatccccgtcctaccgagggaacctaaattcccgaaaagtacgtaccgggttgtttctagacaagtataggaaagcgccgtgacgtaggtacgaccgacgtaccggtaccctttaagttacctgtagccgaaggacggggtcacgtaagtaaagttaccaaaanaattaaacgaaagttaattaacctaactaaacgagttagggaccgttcgggacggggaaccgaaaaccgggtcccccggtacaccggtcctccgtacaacgtcccgtacaacccgtacgggacccc

SEQ ID NO: 367885 - DNA, 480 bp, Homo sapiens
  misc_feature: GZ8MTXP01BMLTM.2.83.H06.1.454.CMB.2.raw
  modified_base (469)..(480): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaatccggggtcctgaccgattcagtggcagcgggtctgggacagatttcactctcaccattaacagcctgcaggctgaagatgtggcagtttattactgtcagccagttctttcttcctcctcggacttttggccaaagggaccaagctggagatcaaacgaactgtggctgcaccatctgtcttcatccttccggctatcctgatgtcgagcgtctgagcggctggcaggcgagannnnnnnnnnnn

SEQ ID NO: 367886 - DNA, 479 bp, Homo sapiens
  misc_feature: GZ8MTXP01B00P1.2.83.H06.1.454.CMB.2.raw
  modified_base (470)..(470): a, c, t, g, unknown or other
  modified_base (472)..(479): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaatccggggtccctgaccgattcagtggcagcgggtctgggacagatttcactctcaccattaacagcctgcaggctgaagatgtggcagtttattactgtcagcctagttctttctcctcctcggacttttggccaagggaccaagctggagatcaaacgaactgtggctgacacatctgtcttcatccttccggctatctgatgtcgagcgtctgagcgggctggcaggcgcatgngnnnnnnnn

SEQ ID NO: 367887 - DNA, 500 bp, Homo sapiens
  misc_feature: GZ8MTXP01CEXO6.2.83.H06.1.454.CMB.2.raw
  modified_base (464)..(464): a, c, t, g, unknown or other
  modified_base (486)..(486): a, c, t, g, unknown or other
  modified_base (490)..(490): a, c, t, g, unknown or other
  modified_base (492)..(500): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaatccggggtccctgaccgattcagtggcagcgggtctgggacagatttcactctcaccattaacagcctgcaggctgaagatgtggcagtttattactgtcagcctagttctttcttcctccttcggtactttttggccctaaaggggtacccaagcctagggagatcaaaacgactagtggctgacaccatctgtcttcactcttcccggctatctgatgtcgagtcgtntgagcgggctgggcaggaccgngatngnnnnnnnnn

SEQ ID NO: 367888 - DNA, 558 bp, Homo sapiens
  misc_feature: GZ8MTXP01D7JCP.2.83.H06.1.454.CMB.2.raw
  modified_base (208)..(208): a, c, t, g, unknown or other
  modified_base (219)..(219): a, c, t, g, unknown or other
  modified_base (386)..(386): a, c, t, g, unknown or other
  modified_base (544)..(544): a, c, t, g, unknown or other
  modified_base (546)..(546): a, c, t, g, unknown or other
  modified_base (548)..(556): a, c, t, g, unknown or other
  modified_base (558)..(558): a, c, t, g, unknown or other
tcagacgctcgacacacgaccggtgctcgatttagatcacgtgcgtgcggggacatcgtgatgacccagtctccagactccctggctgtgtctctgggcgagaggccaccatcaactgcaagtccagccagagtgttttatacaggtccaacaataagaactacttagcttggtaccagcagaaaccagacagcctcctaagttgctnatttctggacntccgacccggaatcccggggtcctgaccgtattcaggtggcaggcgggtctgggacagtattcactctcaccattaacagcctgcaggctgaagatgtggctagtttatatgtcagtccagtttctttcttcctcgtacgtacttttggaccgaaaggggtaaaccncgtcgtaggatactacaaacgtagtgtcgctgaccactatcgtcgttccttactacttccgttccccggtctacttcgtacgtgttccgtacggtacggtccgttcggtcggacgggtccgggtcggtcgggtaacggacggacggttacgtagtagngngnnnnnnnnngn

SEQ ID NO: 367889 - DNA, 539 bp, Homo sapiens
  misc_feature: GZ8MTXP01DL0TJ.2.83.H06.1.454.CMB.2.raw
  modified_base (495)..(495): a, c, t, g, unknown or other
  modified_base (511)..(511): a, c, t, g, unknown or other
  modified_base (522)..(522): a, c, t, g, unknown or other
  modified_base (528)..(528): a, c, t, g, unknown or other
  modified_base (530)..(539): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaatccggggtccctgaccgattcagtggcagcgggtctgggacagatttcactctcaccattaacagccctgcaggctgaagatgtggctagtttattactgtcagtcctagtttctttctttccctccttaccgggtactttttcgggaccaaaggggtacccaaagccttagggagattacgaaaacgtaacctaggtgggcttggacctaccgtattctgttccttcacttccgtttcccgccctattcctgatcgtcgngcgtctgacggcgggntggcaagggcncgatgngnnnnnnnnnn

SEQ ID NO: 367890 - DNA, 504 bp, Homo sapiens
  misc_feature: GZ8MTXP01CMYMC.2.83.H06.1.454.CMB.2.raw
  modified_base (217)..(217): a, c, t, g, unknown or other
  modified_base (248)..(248): a, c, t, g, unknown or other
  modified_base (251)..(251): a, c, t, g, unknown or other
  modified_base (270)..(270): a, c, t, g, unknown or other
  modified_base (290)..(290): a, c, t, g, unknown or other
  modified_base (292)..(292): a, c, t, g, unknown or other
  modified_base (295)..(296): a, c, t, g, unknown or other
  modified_base (298)..(298): a, c, t, g, unknown or other
  modified_base (300)..(300): a, c, t, g, unknown or other
  modified_base (309)..(309): a, c, t, g, unknown or other
  modified_base (322)..(324): a, c, t, g, unknown or other
  modified_base (330)..(330): a, c, t, g, unknown or other
  modified_base (362)..(362): a, c, t, g, unknown or other
  modified_base (364)..(364): a, c, t, g, unknown or other
  modified_base (369)..(369): a, c, t, g, unknown or other
  modified_base (382)..(382): a, c, t, g, unknown or other
  modified_base (384)..(384): a, c, t, g, unknown or other
  modified_base (491)..(492): a, c, t, g, unknown or other
  modified_base (494)..(504): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttacnggcatcgtacccgggacgtccgtcacgactntgngcgcgcggtcgtggacganagttctctctcacactatancncgnngngnaagatgtgngtattattatctnnntacttntttcttctcctcgtacgttgtcgacgacgacngngaganactaagactgtgncncacatctgtacttcctacgtctttccccgtacgacttacgttcgagttaccgtcgtaccgtggttccgtgtacgggcgggccggtagtcggaaagcgggtcaatagnngnnnnnnnnnnn

SEQ ID NO: 367891 - DNA, 476 bp, Homo sapiens
  misc_feature: GZ8MTXP01EY9HR.2.83.H06.1.454.CMB.2.raw
  modified_base (467)..(467): a, c, t, g, unknown or other
  modified_base (469)..(476): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaatccggggtccctgaccgattcagtggcagcgggtctgggacagatttcactctcaccattaacagcctgcaggctgaagatgtggcagtttattactgtcagccagttctttcttctcctcggacttttggccaagggccaagctggagatcaaacgaactgtggctgcaccatctgtctcatcttccggcatctgatgtcgagcgtctgagcgggctggcaaggcgcatagngnnnnnnnn

SEQ ID NO: 367892 - DNA, 518 bp, Homo sapiens
  misc_feature: GZ8MTXP01CLNVL.2.83.H06.1.454.CMB.2.raw
  modified_base (404)..(404): a, c, t, g, unknown or other
  modified_base (506)..(506): a, c, t, g, unknown or other
  modified_base (508)..(518): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaatccggggtccctgaccgattcagtggcagcgggtctgggacagatttcactctcaccattaacagcctgcaggctgaagatggtggtctaggtttattactgtcagtcctagtttcttttcgttccctccgttcggtacttttggaccctaaaggggaccaagctagganatacaaagaactgtggctgcaccatctagtcttcacttcctcccgctatcctgatgtcgagtcgtctggacggcgggcgtcggcgaagggccgacgataggngnnnnnnnnnnn

SEQ ID NO: 367893 - DNA, 551 bp, Homo sapiens
  misc_feature: GZ8MTXP01AZSQF.2.83.H06.1.454.CMB.2.raw
  modified_base (206)..(206): a, c, t, g, unknown or other
  modified_base (209)..(209): a, c, t, g, unknown or other
  modified_base (245)..(245): a, c, t, g, unknown or other
  modified_base (250)..(250): a, c, t, g, unknown or other
  modified_base (279)..(279): a, c, t, g, unknown or other
  modified_base (293)..(294): a, c, t, g, unknown or other
  modified_base (310)..(310): a, c, t, g, unknown or other
  modified_base (335)..(335): a, c, t, g, unknown or other
  modified_base (539)..(539): a, c, t, g, unknown or other
  modified_base (541)..(551): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagccctactagtnctntattacgtggcatccgtaaccggacgtccgggtccngactntcagtgcaggcggtcgtggacagtattcnctctcactataacnncctgcaggctagaagntggtcgacttagtttacttcgtgtnacgtcctagtttctttccttccctccgtacggttctttcggaccgaacgggaacagtcgtagggaagtactaacgaaaacgtacgtggtacgtctgaccctactatctgttcctactcttcccgtccgacttactccgtagtactcgtcgacgtcgttccgtgacgggccggttcgtcggaccggaaggggtccacgtaggagngnnnnnnnnnnn

SEQ ID NO: 367894 - DNA, 672 bp, Homo sapiens
  misc_feature: GZ8MTXP01EGFCK.2.83.H06.1.454.CMB.2.raw
  modified_base (655)..(655): a, c, t, g, unknown or other
  modified_base (660)..(660): a, c, t, g, unknown or other
  modified_base (664)..(666): a, c, t, g, unknown or other
  modified_base (669)..(669): a, c, t, g, unknown or other
  modified_base (672)..(672): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgtttatacaggtccaacaataagaactacttagcttggtaccagcaagaaaccaggacagcctcctaagttgctcatttactggcatctacccgggaatccggggtcctgaccgattcgagtggcaggcgggtctgggacagattcactctcaccattaacagctgcagctagaagatgtggctagtttattactgtcagtcctagttctttcttcctccgttacggtacgttttcggaccgtaaacgggacctaaagtcgtacgggaagtaactacgtaaaacgtaaaccgttgtacgggtcctacggtacctaaaccgtaacttccggttcgttaccctttacgtaaaccttttcccccgtttccccggggtacccttaacgtttaccgttacgttaaacggttcggttacccgggtaaggttacccggttccgtaaggggttacggcccgggggttaccggtaacggggtaacccggaaaacggggtccccgggacgttaaacgtaagggttcgcgngtaangcgnnntgngtn

SEQ ID NO: 367895 - DNA, 674 bp, Homo sapiens
  misc_feature: GZ8MTXP01CQRAM.2.83.H06.1.454.CMB.2.raw
  modified_base (252)..(252): a, c, t, g, unknown or other
  modified_base (655)..(655): a, c, t, g, unknown or other
  modified_base (659)..(659): a, c, t, g, unknown or other
  modified_base (662)..(662): a, c, t, g, unknown or other
  modified_base (664)..(664): a, c, t, g, unknown or other
  modified_base (666)..(667): a, c, t, g, unknown or other
  modified_base (671)..(671): a, c, t, g, unknown or other
  modified_base (674)..(674): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaaacaataagaactacttagcttggtaccagcagaaaccaggacagcctctaagttgctcatttactgggcatctacccgggaatccggggtccctgaccgnttcagtggcagcgggtctgggacagattcactctcacattaacagcctgcaggctagaagatgtggctagtttatactgtcagtccctagtttctttcttcctcccgttacggtacctttttcggacccgtaaacggggtaccctaaggtcgtagggaacgtaacttaaccgtaaaacggtaaccgttaggtcgggtacgttacggtacctaaccccgttaagtttcccgttaacgggtttcccttaccgttaacctttccccgttttacccccggggtacccctttaaacgtttccgttacggtactttaccgggttccgtaacggtaccggtttcgtacgggtacggtcccgggggtcgttaaccggggacggaaaccgggtcgggaccgtaaacgtgggngcgngtngngnnctgngtn

SEQ ID NO: 367896 - DNA, 592 bp, Homo sapiens
  misc_feature: GZ8MTXP01C1T87.2.83.H06.1.454.CMB.2.raw
  modified_base (251)..(251): a, c, t, g, unknown or other
  modified_base (579)..(579): a, c, t, g, unknown or other
  modified_base (581)..(585): a, c, t, g, unknown or other
  modified_base (587)..(589): a, c, t, g, unknown or other
  modified_base (591)..(592): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaaacaataagaactacttagcttggtaccagcagaaaccaggacagcctcctaagttgctcatttactgggcatcgtacccgggatccggggtcctgacgnttcagtggcagcgggtctgggacagatttcactctcacattaacagccctgcaggctgaagatgtggctagtttattactgtcagcctagtttctttcttcctccctcggtacttttggaccgaagggtacccagcctaggagtactacaaacgtaactggtcggctgaccgtacctaatcgttcggtaccttctaactttccccgtttccccggggtacccctaagttcccgttggtaacgttcgtccggtaaggtccggtttcccttgggaacgggtcgggggtccgttcgggaccggaaacggggtcccgacgtaaaggtcgcgngnnnnngnnngnn

SEQ ID NO: 367897 - DNA, 561 bp, Homo sapiens
  misc_feature: GZ8MTXP01DMV52.2.83.H06.1.454.CMB.2.raw
  modified_base (142)..(142): a, c, t, g, unknown or other
  modified_base (217)..(217): a, c, t, g, unknown or other
  modified_base (298)..(298): a, c, t, g, unknown or other
  modified_base (548)..(548): a, c, t, g, unknown or other
  modified_base (550)..(561): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttanacaggtccaaacaataagaactacttagcttggtaccagcagaaaccaggacagcctctaagttgctcatttacnggcatcctacccgggaatccggggtcctgaccgattcaggtggcaggcgggtcgtgggacagtattcactctcacataacngcctgcaggctagaagatgtggctagtttattactgtcacgtccttactttcgtttccttcccttccgttccggttacgttttcggacccgtaaagggacccaaagtcgtagggaagtactaacgaaacgtaactggtacggctacgacacctacgttctacgttcttctaacttccccgttcccggctaacttctcgtacgttcgtcgacgtcgtccgtggacgcgggcgtcggcggttaggcgctagngnnnnnnnnnnnn

SEQ ID NO: 367898 - DNA, 506 bp, Homo sapiens
  misc_feature: GZ8MTXP01BW79F.2.83.H06.1.454.CMB.2.raw
  modified_base (395)..(395): a, c, t, g, unknown or other
  modified_base (494)..(494): a, c, t, g, unknown or other
  modified_base (496)..(506): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaatccggggtcctgaccgattcagtggcagcgggtctgggacagtattcactctcaccattaacagcctgcaggctgaagatggtgctagtttattactgtcagtcctagtttctttcttccctccgttacggtctttcggacctaagggaccagcgtagganatacaaacgatgtggctgaccactatctgtcttcacttccttcccggctatctgatgtcgacgcgtctggacgtcgggcgtcggcgagggcacgagtgngnnnnnnnnnnn

SEQ ID NO: 367899 - DNA, 476 bp, Homo sapiens
  misc_feature: GZ8MTXP02IWEBC.2.83.H06.1.454.CMB.2.raw
  modified_base (468)..(476): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaatccggggtccctgaccgattcagtggcagcgggtctgggacagattcactctcaccattaacagcctgcaggctgaagatgtggcagtttatactgtcagccagttctttcttcctctcggtactttggcctaaagggccaagctggagatcaaacgactgtggctgcaccatctgtctcatcttcccgctatctgatgtcgagcgtctgacgcgggctggcaaggcgcatagnnnnnnnnn

SEQ ID NO: 367900 - DNA, 471 bp, Homo sapiens
  misc_feature: GZ8MTXP02GNV5I.2.83.H06.1.454.CMB.2.raw
  modified_base (463)..(471): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaatccggggtccctgaccgattcagtggcagcgggtctgggacagatttcactctcaccattaacagcctgcaggctgaagatgtggcagtttattactgtcagccagtcttctctctcgacttttgccaggaccaagctggagatcaaacgaactgtaggctgcaccatctgtcttcatcttcccgccatctgatgtcgagcgtctgagcgggctggcaaggcgcatagnnnnnnnnn

SEQ ID NO: 367901 - DNA, 485 bp, Homo sapiens
  misc_feature: GZ8MTXP02JZJJO.2.83.H06.1.454.CMB.2.raw
  modified_base (448)..(448): a, c, t, g, unknown or other
  modified_base (475)..(485): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaatccggggtccctgaccgattcagtggcagcgggtctgggacagatttcactctcaccattaacagcctgcaggctgaagatgtggctagtttattactgtcagcctagttctttcttcctctcggtactttggccaaaggggccagctggagatacaaacgaactgtggctgcaccatctgtcttcatctcccgcatctgatgtcgagtcgtcnggagcgggctgggcagggcgcagtagnnnnnnnnnnn

SEQ ID NO: 367902 - DNA, 477 bp, Homo sapiens
  misc_feature: GZ8MTXP02I4BKU.2.83.H06.1.454.CMB.2.raw
  modified_base (469)..(477): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaatccggggtccctgaccgattcagtggcagcgtgtctgggacagatttcactctcaccattaacagcctgcaggctgaagatgtgcagtttattactgtcagcagttcttcttcctcctcggcttttggccaagggaccaagctggagatcaaacgactagtggctgcacatctgtcttcatcttcccgctatctgactgtcgagcgtctgagcgggctggcaacggcgcagtagnnnnnnnnn

SEQ ID NO: 367903 - DNA, 489 bp, Homo sapiens
  misc_feature: GZ8MTXP02GAC9I.2.83.H06.1.454.CMB.2.raw
  modified_base (480)..(489): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaatccggggtccctgaccgattcagtggcagcgggtctgggacagatttcactctcaccattaacagcctgcaggctgaagatgtggcagtttatactgtcagcctagtttctttcttcctctcggacttttggccaaggggaccaagctggagatacaaacgaactgtggctgcacccatctgtacttcactcttacccgctatcctgatcgtcgagcgtctgagcgggctcggcaaggcgcatagnnnnnnnnnn

SEQ ID NO: 367904 - DNA, 483 bp, Homo sapiens
  misc_feature: GZ8MTXP02JJAR9.2.83.H06.1.454.CMB.2.raw
  modified_base (385)..(385): a, c, t, g, unknown or other
  modified_base (472)..(483): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaatccggggtccctgaccgattcagtggcagcggggtctggggacagatttcactctcaccattaacagcctgcaggctgaagatgtggctagtttatactgtcagcctagttcttcttcctctcggtactttggccaagggaccagctgganatacaaacgaactgtagctgcaccatctgtctcatcctccgcatctgatgtcgagctctgagcggcgtggcgaaggcgacacgtagnnnnnnnnnnnn

SEQ ID NO: 367905 - DNA, 476 bp, Homo sapiens
  misc_feature: GZ8MTXP02IMTGB.2.83.H06.1.454.CMB.2.raw
  modified_base (469)..(476): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaatccggggtccctgaccgattcagtggcagcgggtctgggacagatttcactctcaccattaacagcctgcaggctgaagatgtggctagtttatactgtcagcagttctttctcctctcgacttttggccaagggccaagctggagatacaaacgaactgtggctgcaccatctgtcttcatccttcccgcctatctgatgtcgagcgtctgagcgggctcggcaggcgcatagnnnnnnnn

SEQ ID NO: 367906 - DNA, 479 bp, Homo sapiens
  misc_feature: GZ8MTXP02G3JBZ.2.83.H06.1.454.CMB.2.raw
  modified_base (382)..(382): a, c, t, g, unknown or other
  modified_base (468)..(479): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaatccggggtcctgaccgattcagtggcagcgggtctgggacagatttcactctcaccattaacagcctgcaggctgaagatgtggcagtttattactgtcagctagttctttctcctctcggtactttggccaagggaccaagctgganatacaaacgactgtggctgcaccatctgtctcatccttccgcctatcctgatgtcgagcgtctgagcgggctggcaggcgcatagnnnnnnnnnnnn

SEQ ID NO: 367907 - DNA, 481 bp, Homo sapiens
  misc_feature: GZ8MTXP02G8URJ.2.83.H06.1.454.CMB.2.raw
  modified_base (415)..(415): a, c, t, g, unknown or other
  modified_base (467)..(467): a, c, t, g, unknown or other
  modified_base (470)..(470): a, c, t, g, unknown or other
  modified_base (472)..(481): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaatccggggtccctgaccgattcagtggcagcgggtctgggacagattcactctcaccataacagcctgcaggctgaagatgtggctagtttatactgtcagcctagttctttctcctcgtcgtactttggccaagggtaccaagctaggaagactacgaaacgaactgtaggctgcacatcngtctcatccttccgctatctgatgtcgagtcgtctgagcggctggcgaggcngangnnnnnnnnnn

SEQ ID NO: 367908 - DNA, 486 bp, Homo sapiens
  misc_feature: GZ8MTXP02IXUH5.2.83.H06.1.454.CMB.2.raw
  modified_base (478)..(486): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaatccggggtcctgaccgattcagtggcagcgggtctgggacagatttcactctcaccattaacagcctgcaggctgaagatgtggcagtttattactgtcagcctagttcttcttcctcctcggacttttggccaagggaccaagctggagatacaaacgaactgtaggctgcaccatctagtcttcattccttcccgctatcctgatcgtcgagcgtctgagcgggctgggcaaggcgcatagnnnnnnnnn

SEQ ID NO: 367909 - DNA, 476 bp, Homo sapiens
  misc_feature: GZ8MTXP02FH971.2.83.H06.1.454.CMB.2.raw
  modified_base (468)..(476): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaatccggggtccctgaccgattcagtggcagcggggtctgggacagattcactctcaccattaacagcctgcaggctgaagatgtggcagtttattactgtcagcagttcttcttcctctcggacttttggccaagggaccaagctggagatcaaacgaactgtgctgcaccatctgtcttcatctcccgcatctgatgtcgagcgtctgagcggggctgggcaagggcgcatagnnnnnnnnn

SEQ ID NO: 367910 - DNA, 524 bp, Homo sapiens
  misc_feature: GZ8MTXP02HH8DR.2.83.H06.1.454.CMB.2.raw
  modified_base (243)..(243): a, c, t, g, unknown or other
  modified_base (249)..(249): a, c, t, g, unknown or other
  modified_base (252)..(252): a, c, t, g, unknown or other
  modified_base (257)..(257): a, c, t, g, unknown or other
  modified_base (271)..(271): a, c, t, g, unknown or other
  modified_base (292)..(292): a, c, t, g, unknown or other
  modified_base (297)..(297): a, c, t, g, unknown or other
  modified_base (304)..(304): a, c, t, g, unknown or other
  modified_base (331)..(331): a, c, t, g, unknown or other
  modified_base (333)..(333): a, c, t, g, unknown or other
  modified_base (381)..(381): a, c, t, g, unknown or other
  modified_base (401)..(401): a, c, t, g, unknown or other
  modified_base (513)..(524): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaacgtccgtcncgactntcngcganggcgtgcgagattntcactctaccactaactaacnctcgnacgcgtnaagagtgtggtacgtattatttatgtnangtcttctttcttctcctcgtacgttcgtcgaacgaacgacagtgaganactaaacaaactgtgcgtcncaccactctcgttcttccttactaccgttccctaccacttactcgtagtacgtcgtacgacgtcgtcgtacggacggtcggtcggtacggacggacggacgacgtacgacgnnnnnnnnnnnn

SEQ ID NO: 367911 - DNA, 482 bp, Homo sapiens
  misc_feature: GZ8MTXP02F6H4Q.2.83.H06.1.454.CMB.2.raw
  modified_base (475)..(482): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaatccggggtccctgaccgattcagtggcagcgggtctgggacagatttcactctcaccattaacagcctgcaggctgaagatgtggcagtttattactgtcagccagttctttcttcctcctcggacttttgggccaaagggaccaagctggagatacaaaacgaactgtggctgcaccatctgtcttcattttcccgctatctgatgtcgagctctgagcgggctggcaagggcgcatagnnnnnnnn

SEQ ID NO: 367912 - DNA, 484 bp, Homo sapiens
  misc_feature: GZ8MTXP02I7Z9N.2.83.H06.1.454.CMB.2.raw
  modified_base (313)..(313): a, c, t, g, unknown or other
  modified_base (383)..(383): a, c, t, g, unknown or other
  modified_base (474)..(484): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaatccggggtcctgaccgattcagtggcagcgggtctgggacagatttcactctcaccattaacagcctgcaggctgaagntgtggcagtttatactgtcagccagttcttcttcctcctcggactttgggccaaggggaccagctggganatcaaacgaactgtggctgcaccatctgtcttcattccttcccgccatctgactgtcgagcgtctgagcgggctggcgaaggcgcatacgnnnnnnnnnnn

SEQ ID NO: 367913 - DNA, 582 bp, Homo sapiens
  misc_feature: GZ8MTXP02G3GEC.2.83.H06.1.454.CMB.2.raw
  modified_base (217)..(217): a, c, t, g, unknown or other
  modified_base (250)..(250): a, c, t, g, unknown or other
  modified_base (255)..(255): a, c, t, g, unknown or other
  modified_base (258)..(258): a, c, t, g, unknown or other
  modified_base (271)..(271): a, c, t, g, unknown or other
  modified_base (298)..(298): a, c, t, g, unknown or other
  modified_base (308)..(308): a, c, t, g, unknown or other
  modified_base (567)..(567): a, c, t, g, unknown or other
  modified_base (576)..(576): a, c, t, g, unknown or other
  modified_base (578)..(581): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttacngggcatctacccgggaacgtccggtcacgactntgagnganggcgtgcgagatnttcactctaccaactaataacgactcncagacggtanaagaagtgtggtagtagtttaatttactagtgagactaccgttactttcctttcctcctccggtacgtttacgtcgaacggaacgaacgagtcgagataacgtaaaacgaaacgtagtggcgtcacacctactgtcgttctactactccgttccccgtacccagtactgtagtgtacgtacggtacgtacgtacgtacggtacgggacgggtacggtacggtaacgggaacggacggtaacgtaaacgtacgtacgagngaagagcgnannnng

SEQ ID NO: 367914 - DNA, 534 bp, Homo sapiens
  misc_feature: GZ8MTXP02G8XFQ.2.83.H06.1.454.CMB.2.raw
  modified_base (523)..(534): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactggcatctacccgggatccggggtcctgaccgattcagtggcagcgggtctgggacagattcactctcaccattaacagcctgcaggctagaagagtgtggctagtttattactgtcagcctagtttctttctcctctcggttactttggaccaagggaccagctaggagatacaaacgtaactgtagcgtgacacctatctcgttccttactacttcccgttcccgccctaatccttagacttcggtcggagtcggttcgtcggcgggccgggtcgtacgggcccgtaaagggccgacgaatacgnnnnnnnnnnnn

SEQ ID NO: 367915 - DNA, 501 bp, Homo sapiens
  misc_feature: GZ8MTXP02I1496.2.83.H06.1.454.CMB.2.raw
  modified_base (370)..(370): a, c, t, g, unknown or other
  modified_base (373)..(373): a, c, t, g, unknown or other
  modified_base (377)..(377): a, c, t, g, unknown or other
  modified_base (387)..(387): a, c, t, g, unknown or other
  modified_base (489)..(492): a, c, t, g, unknown or other
  modified_base (494)..(501): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaatccggggtcctgaccgattcagtggcagcgggtctgggacagattcactctcaccattaacagcctgcaggctgaagatgtggctagtttatactgtcagcctagttctttcttcctctcgactttgcaggcagcnganatanaaacgactgnggctgcaccatctgtacttcacttcttcccgcctatctgactcgtacgacgcgtcgtggacggcgggtccgtgggtcggaaacgggcggaaccgtagtacgnnnngnnnnnnnn

SEQ ID NO: 367916 - DNA, 529 bp, Homo sapiens
  misc_feature: GZ8MTXP02G7S0N.2.83.H06.1.454.CMB.2.raw
  modified_base (245)..(245): a, c, t, g, unknown or other
  modified_base (251)..(251): a, c, t, g, unknown or other
  modified_base (255)..(255): a, c, t, g, unknown or other
  modified_base (283)..(283): a, c, t, g, unknown or other
  modified_base (298)..(298): a, c, t, g, unknown or other
  modified_base (300)..(300): a, c, t, g, unknown or other
  modified_base (303)..(303): a, c, t, g, unknown or other
  modified_base (322)..(322): a, c, t, g, unknown or other
  modified_base (413)..(413): a, c, t, g, unknown or other
  modified_base (452)..(452): a, c, t, g, unknown or other
  modified_base (485)..(485): a, c, t, g, unknown or other
  modified_base (506)..(506): a, c, t, g, unknown or other
  modified_base (517)..(517): a, c, t, g, unknown or other
  modified_base (519)..(529): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaacggtccggtcncgactntcgnggcgagcggcggtggaggacagttctcnctcacactaataacncnctnacgagtcgaagagtgtggngtacgtttagtttactagtgacgataccttcgtttctttcctcctcgtcgtttgtcgaacgacgacagcgagatcaaacgaactagtgcgntacacgtaactctcgttctacctatccttcccgtacccnttacttgtacgtagttcgacgtcgtccgtaggnggtacggcggtgacgaacggnggccataagtncnnnnnnnnnnn

SEQ ID NO: 367917 - DNA, 526 bp, Homo sapiens
  misc_feature: GZ8MTXP02IZERS.2.83.H06.1.454.CMB.2.raw
  modified_base (472)..(472): a, c, t, g, unknown or other
  modified_base (515)..(517): a, c, t, g, unknown or other
  modified_base (519)..(526): a, c, t, g, unknown or other
tcagacgctcgacacacgaccggtgctcgatttagatcacgtgcgtgcgggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactgggcatctacccgggaatccggggtcctgaccattcagtggcagcgggtctgggacagattcactctcaccataacagcctgcaggctggagatggtggctagtttattactgtcagtctagtttctttcttcctcttcggtacttttgggccaacgggtaccaagccgtaggagatacgaaacgtaactgtggcttcgactaccatccttgtccttctacttcccttcccgacctacttcgtgtactcgtcgngtccgtcgtggaggtcgggccgttgggacgaggcgacagtgcnnngnnnnnnnn

SEQ ID NO: 367918 - DNA, 521 bp, Homo sapiens
  misc_feature: GZ8MTXP02GLLIO.2.83.H06.1.454.CMB.2.raw
  modified_base (317)..(317): a, c, t, g, unknown or other
  modified_base (401)..(401): a, c, t, g, unknown or other
  modified_base (431)..(431): a, c, t, g, unknown or other
  modified_base (489)..(489): a, c, t, g, unknown or other
  modified_base (508)..(508): a, c, t, g, unknown or other
  modified_base (511)..(521): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcagaaaccaggacagcctcctaagttgctcatttactggcatcgtacccgggaatcccggggtcctgaccgattcagtggcaggcgggtctgggacagtatttcactctcaccattaacagcctgcaggctagaagntggtgctagttttattacctgtcagcctagtttcctttcttccctccgtcggttactttcgggaccaaagggccaagctagganatacaaacgactgaggctgccactatcgtntctctatcccttcccgcctatcctagactggtacgacgtcgtacgtggaggtccgggngtacggacgaggcgatagngcnnnnnnnnnnn

SEQ ID NO: 367919 - DNA, 584 bp, Homo sapiens
  misc_feature: GZ8MTXP02JGW71.2.83.H06.1.454.CMB.2.raw
  modified_base (306)..(306): a, c, t, g, unknown or other
  modified_base (573)..(575): a, c, t, g, unknown or other
  modified_base (577)..(584): a, c, t, g, unknown or other
tcagacgctcgacacacgaccggtgctcgatttagatcacgtgcgtgcggggacatcgtgatgacccagtctccagactccctggctgtgtctctgggcgagagggccaccatcaactgcaagtccagccagagtgttttatacaggtccaacaataagaactacttagcttggtaccagcaagaaaccaggacagcctcctaagttgctctatttactgggcatccgtaacccgggaatcccggggtccctgaccgtattcagtggcaggcgggtctgggacagtattcactctcacctataacngcctgacaggctagaagagtgtaggctagtttattactgtcagtcctagtttcctttcttccttcctacggttacttttcgggacctaaaggggaccctaagccgtaggaatactacgaaacgtactggtcggctcgacaccctattcctagttccttctacgttccccttacccgtaccctattcctggtaacgttcgtacggtacgtccgttacggcggtacgggcgggtcgtacggggaccgaaagggccgagaacggtcgcgnnngnnnnnnnn

SEQ ID NO: 367920 - DNA, 581 bp, Homo sapiens
  misc_feature: GZ8MTXP01DDPB1.17.21.B10.1.454.CMB.2.raw
  modified_base (572)..(581): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggccaatctccaaggctcttatttataaggtctctgaccgggactctgggggtcccagacagattcagcggcagtgggcagacactgatttcacactgaaaatcagcagggtggaggctggaggatggtcggggtttacactgcatgcagggtacacgtctgggtcccgttctaacgtttttcgggacccaggggggtaacccaaaacgtgggaattaagtaccgaaggaacgaaacgttggtacgggctcggaccaccattcctgttcctttacgactttccctttccccgccctaattcctcggtaaccttaacggtccttaacgccgttggaacggtccggggccgttggggaccaaaggggccggacaagttaggnnnnnnnnnn

SEQ ID NO: 367921 - DNA, 487 bp, Homo sapiens
  misc_feature: GZ8MTXP01EZXXL.17.21.B10.1.454.CMB.2.raw
  modified_base (479)..(487): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggccaatctccaaggcgtcttatttataaggtctctgaccgggactcgtggggtcccagacagattcagcggcagtgggcagacactgatttcacactgaaaatcagcagggtggagctgagatgtcgggtttacactgcatgcagggtacactctggcccgtttcacgttttgggcctagggggaccaaacgtgggatatcagacgaactgtaggctgcaccatctgtcttcatcttcccgcatcctgactagtctacgctgagcggcttggcaaggcgcagttgnnnnnnnnn

SEQ ID NO: 367922 - DNA, 489 bp, Homo sapiens
  misc_feature: GZ8MTXP01D3WI6.17.21.B10.1.454.CMB.2.raw
  modified_base (458)..(458): a, c, t, g, unknown or other
  modified_base (481)..(489): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggcagacactgatttcacactgaaaatcagcagggtggaggctgaggatggtcgggtttactactgcatgcagggtacactctggccgttctacgttttgggcctagggggaccaaacgtggatatcagacgaactgtaggctgcaccatctgtcttcattcttcccgcatctgactagtctacgctgngcggcttgggcaaggcgcattgnnnnnnnnn

SEQ ID NO: 367923 - DNA, 481 bp, Homo sapiens
  misc_feature: GZ8MTXP01BMTOL.17.21.B10.1.454.CMB.2.raw
  modified_base (454)..(454): a, c, t, g, unknown or other
  modified_base (472)..(472): a, c, t, g, unknown or other
  modified_base (477)..(481): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcaggggtacactctggccgttcacttttgggccagggggaccaaacgtggatatcagacgaactgtggctgcaccatctgtcttcatcttcccgcatctgactagtctacgctgngcgggcttggcaggcgcngttgnnnnn

SEQ ID NO: 367924 - DNA, 484 bp, Homo sapiens
  misc_feature: GZ8MTXP01D5U1N.17.21.B10.1.454.CMB.2.raw
  modified_base (457)..(457): a, c, t, g, unknown or other
  modified_base (480)..(484): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctgggggtcccagacagattcagcggcagtgggtcagacactgatttcacactgaaaatcagcagggtgaggctgaggatgtcgggggtttactactgcatgcaggggtacactctgggccgtttcacttttggggcagggggaccaaacgtgggatatcagacgaactgtggctgcaccatctgtcttcatcttccgcatctgactagtctagctgngcgggcttggcaggcgcagttgnnnnn

SEQ ID NO: 367925 - DNA, 495 bp, Homo sapiens
  misc_feature: GZ8MTXP01AJTIO.17.21.B10.1.454.CMB.2.raw
  modified_base (486)..(495): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggccaatctccaaggcgtcttatttataaggtctctgaccgggactctggggtcccagacagattcagcggcagtgggcagacactgatttcacactgaaaatcagcagggtgagctgagatgtcgggtttacactgcatgcagggtacactcgtggtccgttcacgttttgggccagggggaccaaacgtggactatcagacgaactgtaggctgcaccagtctgtcttcactccttcccgcctatctgactacgtctacgctgcggtcgggcgttggcgaaggcgcagttgnnnnnnnnnn

SEQ ID NO: 367926 - DNA, 497 bp, Homo sapiens
  misc_feature: GZ8MTXP01CKO5F.17.21.B10.1.454.CMB.2.raw
  modified_base (488)..(497): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggccaatctccaaggcgtcttatttataaggtctctgaccgggactctggggtcccagacagattcagcggcagtgggtcagacactgatttcacactgaaaatcagcagggtggaggctgaggatgtggggtttacagtgcatgcaggggtacacgtctgggccgttctaacgtttttggccagggggaccaaactgggatatcagacgaactgtggctgcacatctgtcttctatccttcccgcctactctcgactacgtctacgctgagcgggcttggccaaggcgcagttgnnnnnnnnnn

SEQ ID NO: 367927 - DNA, 581 bp, Homo sapiens
  misc_feature: GZ8MTXP01C8PMH.17.21.B10.1.454.CMB.2.raw
  modified_base (249)..(249): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctcatctcctgcaggtctagtcaaagcctcgtccacagtgatggaaacntctactcatgtggttcagcaggacggccggcaatctccaaggcttacttattataaggtctcgtgaccgggtactcgtcggggtacccccaggacagattcgaagcgcagtgggtacagacactgattcacactagaaatacagacgaggtaggaggagtagaggtagtaggttacgggggttacgttacgttacgacgagtagcgaggtacgtacgtcgtcggtccgttacgtaacgtttacggttacggtacgggaaccgtaaaccgtaacgttacgttagttacgtaacgaacgtaaccgtacgtaggttacgtcgttaacgtaacccg

SEQ ID NO: 367928 - DNA, 574 bp, Homo sapiens
  misc_feature: GZ8MTXP01BXLV1.17.21.B10.1.454.CMB.2.raw
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctactcatgtggttcagcagagccggcaatctccaaggcgtcttatttataaggtctctgaccggactcgtcggggtccccccagacagattcgaagcggcagtgggtcagacactgatttcacactagaaatcagcgagggtggaggctggaggtagttggttacggggggtttactacgtgcagtgcgagggtacacgtcgttacgggtccgtttctaaagttttcgggaccgtaaacgggggaaccctaaacgtgggaacttacgttacgaacggtaaccggaaaccgtttcggggtcgggttactcggaaccgtaaccg

SEQ ID NO: 367929 - DNA, 505 bp, Homo sapiens
  misc_feature: GZ8MTXP01EF2YC.17.21.B10.1.454.CMB.2.raw
  modified_base (477)..(477): a, c, t, g, unknown or other
  modified_base (494)..(494): a, c, t, g, unknown or other
  modified_base (496)..(505): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggttcagcagaggccggccaatctccaaggcgtcttatttataagtctctgaccggactcgtggggtcccagacagattcagcggcaggtgggcagacactgtatttcacactagaaaatcagcgagggtggaggctggaggtatgggttcggggtttactactggcagtgacgagggtacacgtcgtggtccgttctacgttttcgggaccgaggggaaccaaacgtggaatatacagaacgaactgtagctgcacatctgtctctacttccttcccgctatctgactagtctacgctgngcggcttggcagggcangnnnnnnnnnn

SEQ ID NO: 367930 - DNA, 555 bp, Homo sapiens
  misc_feature: GZ8MTXP01D3P1K.17.21.B10.1.454.CMB.2.raw
  modified_base (250)..(250): a, c, t, g, unknown or other
  modified_base (292)..(292): a, c, t, g, unknown or other
  modified_base (300)..(300): a, c, t, g, unknown or other
  modified_base (445)..(445): a, c, t, g, unknown or other
tcagcgtagactagcacgaccggtgctcgatttagtgtcgtcgcaagggggactgatcagaactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacntctactcatgtggttcagcagaggccggcaatctcaaggctnttatttanaaggtctctgaccggactcgtcggggtcccccagacagattcgaagcggcagtgggtcagacactgtatttcacactagaaaatcagacgagggtggaggcgtagaggagttggttacggggggtttactacgttgactagtcgngtagggtactacgtcgtcggtccgttctaaagttttcgggaccgtaacggggaccgtaaacgtggttaagttattacgaagtaacgtaacgtggtggctcggcctaaccg

SEQ ID NO: 367931 - DNA, 607 bp, Homo sapiens
  misc_feature: GZ8MTXP01CIW2G.17.21.B10.1.454.CMB.2.raw
  modified_base (249)..(249): a, c, t, g, unknown or other
  modified_base (272)..(272): a, c, t, g, unknown or other
  modified_base (342)..(342): a, c, t, g, unknown or other
  modified_base (415)..(415): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccgcctccatctcctgcaggtctagtcaaacgcctcgtcacagtgatggaaacntctactcatgttgttcagcaggnggccggcaatccacaaggtcttacttattataaggtctcgtgaccggtactcgtcggggtcccccagacngtactcgaaggcggcagggtgggtacagactactgtacttacacactaagaaatcgagacgaggggtggaggngtagagggtagttcgggttacggggggtttaactacggttgacgtaagtcggaccgtaagggttaccctaccgttcggttacgggttaccgtttagttaaacggttttcgggaccgggtaaacgggaaaccgtaaaacgtggttaacgttgttaccgaagtaaccgtaacgtggtcggacttcggcgtaacc

SEQ ID NO: 367932 - DNA, 550 bp, Homo sapiens
  misc_feature: GZ8MTXP01DCF93.17.21.B10.1.454.CMB.2.raw
  modified_base (250)..(250): a, c, t, g, unknown or other
  modified_base (271)..(271): a, c, t, g, unknown or other
  modified_base (280)..(280): a, c, t, g, unknown or other
  modified_base (293)..(293): a, c, t, g, unknown or other
  modified_base (328)..(328): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacntctactcatgtgttcagcagngcggcatcncagctcttattanaggtctctgaccggactcgtcgggtcccccagacngtattcgaagcggcagtgggtcagcactgtattcacactagaaatcagacgagggtggaggcgtagaggtagttggttacggggggtttactacgtgcagtgcgtaggtacacgtcgtcggtcccgtttcgtaacgttttcgggccgtaacggggacccgtaaacgtgggttacttacgttacgaaggtaacgtaacgttggtcgggttctcggcctaaccg

SEQ ID NO: 367933 - DNA, 540 bp, Homo sapiens
  misc_feature: GZ8MTXP01D3BBW.17.21.B10.1.454.CMB.2.raw
  modified_base (507)..(507): a, c, t, g, unknown or other
  modified_base (531)..(540): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggcaatctccaaggcgttcttatttataaggtctctgaccgggactcgtggggtcccagacagattcagcggcaggtggcagactactgtatttcactactgaaaatcagcgagggtggagcgtggaggtagtgggttcggggtttacacgtgcatgacgtaggggtacacgtacgtcgggtccgtttactacgttttcggaccgtacgggggacctaaacgtggatatcgagacgaacttgtaggactgacacatctgtccttcgaacttcctaccgctatccgtgtactaagtctacgcgtagacggtcgggngttcggacgaggtctgttagttgnnnnnnnnnn

SEQ ID NO: 367934 - DNA, 514 bp, Homo sapiens
  misc_feature: GZ8MTXP01AIBS6.17.21.B10.1.454.CMB.2.raw
  modified_base (487)..(487): a, c, t, g, unknown or other
tcagcgtagactagcacgaccggtgctcgatttagtgtcgtcgcaaggggactgatcaggactcctcagttcaccttctcacaatgaggctccctgctcagctcctggggctgctaatgctctgggtcccagcatccagtgggatgttgtgatgactcagtctccactctccctgcccgtcacccttggacagccggcctccatctcctgcaggtctagtcaaagcctcgtccacagtgatggaaacatctactcatgtggtttcagcagaggccggccaatctccaaggcgtcttatttataaggtctctgaccgggactcgtggggtcccccagacagattcaagcggcagtgggtcagacactgatttcacactgaaaatcagcgagggtgaggctgaggatgtcggggggttactacgtgcatgcgagggtacactcgtggccgttctaattttcgggccaaggggaccaaacgttgggattnttcaagacgaactgtggctgcgtaacc

SEQ ID NO: 367935 - DNA, 508 bp, Homo sapiens
  misc_feature: GZ8MTXP01AF5G2.17.21.B10.1.454.CMB.2.raw
  modified_base (295)..(295): a, c, t, g, unknown or other
  modified_base (384)..(384): a, c, t, g, unknown or other
  modified_base (386)..(386): a, c, t, g, unknown or other
  modified_base (410)..(410): a, c, t, g, unknown or other
tcagcgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctactcatgtgttcagcagagccggcaatctcaagctcttattanaagtctctgaccggatcgtggggtcccccagacagattcaagcgcagtgggtcagacatgattcacactgaaaatcagcagggtgaggngngagagtgtcggggttacgtactgngagtgcgaggtacgacgtcgtcgtcgttcgtaacgttcggacgacggaacgtaaacgtagttagttacttacgaagacgaacgtgtggcgtcgcgaac

SEQ ID NO: 367936 - DNA, 488 bp, Homo sapiens
  misc_feature: GZ8MTXP01DIRQD.17.21.B10.1.454.CMB.2.raw
  modified_base (481)..(488): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggcaatctcaaggcgtcttatttataaggtctctgaccgggactctggggtcccagacagattcagcggcagtgggtcagacactgatttcacactgaaaatcagcagggtgaggctgaggatggtcggggtttactactgcatgcagggtacactctggccgttcacttttggccaggggaccaaacgtggatatacagacgaactgtagggctgcaccatctagtcttcacttcttcccgctatctgactacgtctacgctgagcgggcttggcaaggcgcagttgnnnnnnnn

SEQ ID NO: 367937 - DNA, 602 bp, Homo sapiens
  misc_feature: GZ8MTXP01A2KBB.17.21.B10.1.454.CMB.2.raw
  modified_base (250)..(250): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacntctactcatgtggttcagcaggacggccggaccaatctaccaaggtcgttctttatttataaggttctcgtggaccggactcgtcggggtcccccagacagattcgaagcggcgaggtcgggtcacgactacgtgtactttacactaactagaaactcgagacgagggtaggaggcgtggaaggtagttcgggttacggggggttttaactacgtgacgtagtcggcgtaagggtactaccgtcgtcggtcccgttagtaaacgttttcgggaccgtaacggggaaccctaaagtcggttaacttagttacgaaggtacgaaccgttggtcgggttactcggaacctaaccg

SEQ ID NO: 367938 - DNA, 496 bp, Homo sapiens
  misc_feature: GZ8MTXP01ARCIY.17.21.B10.1.454.CMB.2.raw
  modified_base (465)..(465): a, c, t, g, unknown or other
  modified_base (470)..(470): a, c, t, g, unknown or other
  modified_base (488)..(496): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggccaatctccaaggcgtcttatttataaggtctctgaccgggactcgtggggtcccagacagattcagcggcagtgggcagacactgatttcacactagaaaatcagcgagggtgaggctggaggagtggtcgggggtttactacgtgcagtgcgagggtacacgtcgtggtccgttctacgtttggccgaggggaccaaacgtggatatcagacgaactgtaggctgcacatctgtctcgacttctcccgcatctgactagtctacgctgngcggnttggcgaggcgcagttgnnnnnnnnn

SEQ ID NO: 367939 - DNA, 635 bp, Homo sapiens
  misc_feature: GZ8MTXP01ET7G6.17.21.B10.1.454.CMB.2.raw
  modified_base (250)..(250): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccgcctccatctcctgcaggtctagtcaaagcctcgtccacagtgataggaaacntctactcatgtggttcagcaggacggccggacaatctaccgaaggtcttatttatttagtaaggttctcgtaggacccggtactcgtcggggtacccccaggacagtacttcgaacggcggcgtaggtcggggtacagactacgtgtactttcactactagaaatcaggacgagggtggacggtgtagaggtagttcgggttacggggggtttaactaacgtgacgtaagtcggacgtaaggggtaacctcgttcggttcggtcccgtttcgtaacgttttcgggacccggtaaacgggggaaccctaaacggtgggaatttacgttacggaaacggtaacgtaaccggttgggtacgggttaccttcggttaacccgtaacccg

SEQ ID NO: 367940 - DNA, 539 bp, Homo sapiens
  misc_feature: GZ8MTXP01E19VD.17.21.B10.1.454.CMB.2.raw
  modified_base (530)..(539): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggccaatctccaaggcgtcttatttataaggtctctgaccgggactcgtggggtcccagacagattcagcggcagtgggcagacactgatttcacactagaaaatcagcgaggggtggaggcgtggaggtatggttacgggggtttactacgtgcagtgacgaggggtacacgtctcggtccgttcgtacgttttcgggccgaagggggaacccaaaacgtgggaatacgtacgagaacgaactggtggctgcaccatctgtcttcacttccttcccgccaactctcgtactacgtcctacgctcggaggcgggcttcgggacgaaggcgacagttgnnnnnnnnnn

SEQ ID NO: 367941 - DNA, 591 bp, Homo sapiens
  misc_feature: GZ8MTXP01C2JSI.17.21.B10.1.454.CMB.2.raw
  modified_base (582)..(591): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggcaatctccaaggcgtcttattataaggtctctgaccgggactcgtggggtcccagacagattcagcggcagtggcagacactgatttcacactagaaaatcagcgagggtgaggctggaggatggtcgggtttacacgtgctagtggacaggggtacacgtcgtagggtcccgtttcgtaaccgtttttgggacccgaaaggggggtaacccctaaaagtcgggaattaactacgaaacggaacgaaacgttggtacgggcttagccaacctagtcttacgttctttcgaacttcccgtttccccacctacttccgtgtacttaacggtcctacggcttacggacgggtccgggtcggttcgggaccgaaaggccggtacaaggttgnnnnnnnnnn

SEQ ID NO: 367942 - DNA, 743 bp, Homo sapiens
  misc_feature: GZ8MTXP01B8DW2.17.21.B10.1.454.CMB.2.raw
  modified_base (740)..(740): a, c, t, g, unknown or other
  modified_base (742)..(742): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggccaatctccaaggcgtcttatttataaggtctctgaccgggactcgtggggtcccagacagattcagcggcagtgggcagacactgatttcacactagaaaatcagcaggggtggaggctggaggatggttacgggggtttactacgtggctagtggacgtaggggtaccacgttccgtcgggtcccgtttactaaccgtttttcggggacccgtaacggggggtaacccctaaaaccgttggggaacttaacgttaccgaaacggaaccggtaaaccgttgggttacggggtccttagggacccgtaaccccgtattccgttacggtttcccgttttaccgtaacgttttccccttttcccccccgggacccttaaacgtttcccctttacggtaacccgttttaaaccggttcccgtttaaacccgggtacccgtttggggaaaccggggtccccggggggtaccgtttccggggggtaccccgaaaagggggtcccgggacccttaaaacggtttacgggacgtaacgcgtcgcgcgcgtcgngng

SEQ ID NO: 367943 - DNA, 499 bp, Homo sapiens
  misc_feature: GZ8MTXP01EB0UR.17.21.B10.1.454.CMB.2.raw
  modified_base (425)..(425): a, c, t, g, unknown or other
  modified_base (439)..(439): a, c, t, g, unknown or other
  modified_base (475)..(475): a, c, t, g, unknown or other
  modified_base (489)..(499): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggccaatctccaaggcgtcttatttataaggtctctgaccgggactctggggtcccagacagattcagcggcagtgggcagacactgatttcacactgaaaatcagcaggtgagctgagatggtgggtttacactgcatgcagggtacactcgtggccgtttcacgttttcgggaccgtaagggggaccaaaacgtgggaatatacagacgaactgtaggctgcaccatcttntctctacttctccnctactctcgtactacgtctacgtctgcggcggtcgnggacgaggcacagnnnnnnnnnnn

SEQ ID NO: 367944 - DNA, 536 bp, Homo sapiens
  misc_feature: GZ8MTXP01EK2YQ.17.21.B10.1.454.CMB.2.raw
  modified_base (337)..(337): a, c, t, g, unknown or other
  modified_base (379)..(379): a, c, t, g, unknown or other
  modified_base (398)..(398): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctactcatgtgttcagcagaggccggcaatctccaaggcgtacttattataaggtctctgaccggactcgtggggtcccccagacngattcaagcgcgagtgggtcagaccatgattcacatagaaanacagacgaggtaggagggngagagtagtaggttacggggttacgtacgtgagagtgacgacggtacgtacgtcgtcgtccgttcgtcgttcggacggacgggaacgtaacgtacgttacgttattacgtaacgacgaacgtgtcggcgtcgcgtaac

SEQ ID NO: 367945 - DNA, 553 bp, Homo sapiens
  misc_feature: GZ8MTXP01C6QL3.17.21.B10.1.454.CMB.2.raw
  modified_base (248)..(248): a, c, t, g, unknown or other
  modified_base (290)..(290): a, c, t, g, unknown or other
  modified_base (335)..(335): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctcatctctgcaggtctagtcaaagcctcgtccacagtgatggaaacntctactcatgtgttcagcagaggccggcaatctacaggcgtnttatttataaggtctcgtgaccggatcgtcggggtcccccagacngatcgaagcgcagtgggtcagacactagattcacactagaaatcgagcgagggtaggaggcgtggaggtagttgggttacggggggtttactacgttgcgtagtgcgtacgggtacacgtcgtcgggtccgttcgtaaagttttcggaccgtacggggaacctaaacgtggaattacgttacgaaggtacgaacgttggtggcttaacgccgtaaccg

SEQ ID NO: 367946 - DNA, 547 bp, Homo sapiens
  misc_feature: GZ8MTXP01CFBW3.17.21.B10.1.454.CMB.2.raw
  modified_base (538)..(547): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggccaatctccaaggcgtcttatttataaggtctctgaccgggactcgtggggtcccagacagattcagcggcagtgggtcagacactgatttcacactgaaaatcagcagggtggaggctgaggatggtcggggtttacactgcagtgcaggggtacactcgtggtccgttctacgttttgggccgaagggggaaccctaaaacgtgggtatagtaccaaggaacgtaacgtggtagggcctgccaccatcctgtccttcgacttccttccccgcctactccgtgaccttacggtcctaacggtctggacggccgggtcgttcgggacaacgggcgcagttaggnnnnnnnnnn

SEQ ID NO: 367947 - DNA, 636 bp, Homo sapiens
  misc_feature: GZ8MTXP01EN3T6.17.21.B10.1.454.CMB.2.raw
  modified_base (249)..(249): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccgcctccatctcctgcaggtctagtcaaagcctcgtccacagtgataggaacntctactcatgtgttcagcaggacggccggacaatctaccgaaggtcgttactttaattttagtaagggttccttcgtacggaccgggtactcggtcggggtcccccaggacagtacttcgaaagcggtcgaggtcgggtacaggacctacgtgtactttacgaactactagaaaactcgaaggtacggtaggggtaggagggtcgtaggaggtaagtgggtttacggggggtttaactacgtgacgtagtcgcgtaacggtactacgttcggtcggtaccgtttcgtaaacgttttcgggaccggtaacggggttaacccgtaaacggtcgggttaacttagttacgaaggtaaccgtaacgtggtacggacttcggccgtaacccg

SEQ ID NO: 367948 - DNA, 633 bp, Homo sapiens
  misc_feature: GZ8MTXP01EXZ65.17.21.B10.1.454.CMB.2.raw
  modified_base (535)..(535): a, c, t, g, unknown or other
  modified_base (617)..(617): a, c, t, g, unknown or other
  modified_base (622)..(622): a, c, t, g, unknown or other
  modified_base (624)..(633): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggcactactccacgacggtcttactttaattaagtacgtctcgtacgggaccgtcgtcgggtccggtaccaacgacgagttactacgacggcgacgtagggtcggacgacgactacgtagttactacaactacgtaaagtaaactacgacggtacgggtagggggtagggacggtggtagggtaaggttggttcgggggtttacggttactacggtcgtacgtaggtcgaacgggtacgtacctaacgttcgggtcggttccgttacgtttacgggttccggaaccggggtacggtaaactagtgtaatcgagaacgtaacgtggttggcctgacacctactnttgtacctttcaacttccgttccccgccaattctcggactacgttacctcgtactggacgggcggtcgttgacggaacgcgnttagngnnnnnnnnnn

SEQ ID NO: 367949 - DNA, 625 bp, Homo sapiens
  misc_feature: GZ8MTXP01BECW5.17.21.B10.1.454.CMB.2.raw
  modified_base (615)..(625): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggttcagcagaggccggccaatctccaaggcgtcttatttataaggtctcgtgaccgggactcgtcggggtcccagacagattcgaggcggcgaggtgggcagacactgtatttcacactagaaaatcgagcgagggtggaggcgtggaggtagttggttacggggtttactacgtgctagtgacgtaagggtacctacgtccgttcggtccgttacgtacggtttcgggacccggtaacgggggtaacctaaacgttcggaattacgtacggtaagaaccgtaacgtggtacggctacgacctacctagttccttacgttcccttacggtacctttcccgttccccgacttacgttccgtacgttaaccgttacggttaccgttaacgggttcggaccggggtcgggtcgtacgggacggtaacggcgacgagttagnnnnnnnnnnn

SEQ ID NO: 367950 - DNA, 572 bp, Homo sapiens
  misc_feature: GZ8MTXP01BT48R.17.21.B10.1.454.CMB.2.raw
  modified_base (231)..(231): a, c, t, g, unknown or other
  modified_base (243)..(243): a, c, t, g, unknown or other
  modified_base (250)..(250): a, c, t, g, unknown or other
  modified_base (541)..(541): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtccagcatccagtgggatgttgtgatgactcagtctccactctccctgcccgtcacccttggacagccgcctcatctctgcaggtctagtcaaagcctcgtcanagtgatggaacntctactnatgttgttcagcaggacggccggacaaatcctaccgaagggtcttactttagtttataacgggttctacgtcggaccgggtactcggtcggggtacccccaaggacagtacttcgaacggcggcgtagggtcgggacacgactacgtgtactttcaactacgtagaaatcgagacgagggtgaggtctagaggtagtgggttacgggggttatcgtgactagtgcgtaggtacactcgtacgtccgttcgtaacggtttcggaccgtacggggaacctaagtggaacttancgaagtacgtaagtcggtggctcgccgtaac

SEQ ID NO: 367951 - DNA, 490 bp, Homo sapiens
  misc_feature: GZ8MTXP01EZKKM.17.21.B10.1.454.CMB.2.raw
  modified_base (442)..(442): a, c, t, g, unknown or other
  modified_base (480)..(480): a, c, t, g, unknown or other
  modified_base (482)..(490): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggcagacactgatttcacactgaaaatcagcagggtggagctgaggatggtcgggtttatactgcatgcagggtacactctgggccgtttcacgttttgggccagggggaaccaaacgttgggactatcaagacgaaactgtggctgcacatctgtcttcatcttccgcatcngctagtctacgctgaggtcgggcttggcaaggcgcagngnnnnnnnnn

SEQ ID NO: 367952 - DNA, 647 bp, Homo sapiens
  misc_feature: GZ8MTXP01DZFAP.17.21.B10.1.454.CMB.2.raw
  modified_base (634)..(634): a, c, t, g, unknown or other
  modified_base (636)..(638): a, c, t, g, unknown or other
  modified_base (640)..(642): a, c, t, g, unknown or other
  modified_base (645)..(645): a, c, t, g, unknown or other
  modified_base (647)..(647): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggcaatctcaaggcgtcttattataagtctctgaccggatcgtgggtcccagacagattcagcggcagtgggcagacactgatttcacactagaaaatcagcgagggtggaggctgaggagtggtacgggtttactacgtgcagtgacgagggtacacgttcgtcggtcccgtttacgtaccgtttttcgggccgaacgggggaaccctaaaacgtgggtaattaagttaccgaaggaaccgtaaacgttaggttcgggtaccttcggaccaaccctacttacccttagggttcccttttacgtaacctttcccggtttcccccgacccttaacgtccttacggtaacctttaacgttaccctaaccgggtacccgttgggaaacgggcccgggggtcgttaccggggaccgaaacgggggccccgtaaacgttagttacgngnnngnnntgngn

SEQ ID NO: 367953 - DNA, 619 bp, Homo sapiens
  misc_feature: GZ8MTXP01CSEMB.17.21.B10.1.454.CMB.2.raw
  modified_base (250)..(250): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactcctccctgcccgtcacccttggacagccggcctcatctcctgcaggtctagtcaaagcctcgtccacagtgatggaaacntctactcatgttggttcagcaggacggcccggaccaatcctaccgaaggtcttactttatttataaggttctcgtggaccgggtactcgtcggggtccccccaggacagtacttcgaagcggcgaggtgggtacagacacgtgtacttcacactagaaatcgagacgtaggggtaggaggcgtaggaggtagttacgggttacggggggtttaactacgtcgacgtagtcggtacggtacgggtacctacgttcgttcggtcccgtttcgttaacggttttcgggaccggtaacggggaaccgtaaacggtggttaacgttacgttacgaaggtaacgtaacgttggtacggttacgtcgccgtaaccg

SEQ ID NO: 367954 - DNA, 650 bp, Homo sapiens
  misc_feature: GZ8MTXP01BQTT5.17.21.B10.1.454.CMB.2.raw
  modified_base (252)..(252): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccaggtggggatgttgtgatgactcagtctccactcctccctgcccgtcacccttggacagcccgcctccatctcctgcaggtctagtcaaagcctcgtcacagtgataggaaacntctactcatgtggttcagcgaggacggccggaccaatcctaccgaaggtcttactttaatttagtaacggtctcgtaggaccgggtactcggtcggggtacccccagacagtacttcgaacggcggcgtaggtggggtaccaagggacctacgtagtactttacaacgtaacttaaggaaaatcgaaggtacggaagggggttggaacgggtgttagggaagggtagttcggggttaccggggggtttaactaacgtgtacgaagtcggcgtaaggggtacctcgtcggttcggttccgttacgttaaagttttcggggaccgtaacgggggaaaccctaaaggtcggattacgttacgaacgacgaacgttggacgggttcctaacggccgtaaccg

SEQ ID NO: 367955 - DNA, 711 bp, Homo sapiens
  misc_feature: GZ8MTXP01EYMPV.17.21.B10.1.454.CMB.2.raw
  modified_base (249)..(249): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactcctccctgcccgtcacccttggacagccgcctccatctcctgcaggtctagtcaaagcctcgtcacagtgatgaaactntctactcagtgttgttcagcaggacggcccggcaactccgtacgaaggtcttactttaatttagtaacggttcttacgtacggtaccgggtacttcggtacggggtaccccccaaggtacgtagtacttccgaaacgggtcggtcgtagggtcggggtaccaggtacctacgttgtaactttacaacgtaacgtaagtaaaacgttccgaggtaccggtagggggttagggacgggtacgttagggtaaggttaggtttaccggggtttacggggggggtttaacttacggttacggtaccgtaggttacggacgttaacgggttaacctcgttccggtacggttccgtttcgtaacggttttaccgggaccggtaacgggttaacccgtaaaggtcggttacgttacgttacgtaacggtacgtaacgtcgggtacggttactcggttaacccgttaaccg

SEQ ID NO: 367956 - DNA, 770 bp, Homo sapiens
  misc_feature: GZ8MTXP01E3IJG.17.21.B10.1.454.CMB.2.raw
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggccaatctcaaggcgtcttattataaggtctcgtgaccggactcgtggggtcccagacagattcagcggcagtggcagacactgatttcacactagaaaactcaagcgagggtggagctggaggtatggttacgggtttacacgtgacagtggacgtaggggtaccacgttcgtcgggtcccgtttacgtaaccgttttcggggacccgtaaacggggggtaaccctaaaacgtgggtaaacgttaacgttaccgaaacggtaaccggtaaaaccggttgggttaacggggtacccgtttacgggaaccccgtaaccccttaaacgttaccccgtttcggtttaccccgttttaccggtaacccttttacccccggtttaccccccggttacccgttaaaccttcccggttaccggttaaacccgtttaaaccgggtttcccgttaaaccggcccgtttaagggaccggggtaacccgggggttaccgttacggggaacccgggttaaacggggtcccggtacccggaaaacgttacggggttcgtaacgtacgtaacgtcgacgacgtaacgcgtg

SEQ ID NO: 367957 - DNA, 586 bp, Homo sapiens
  misc_feature: GZ8MTXP01CRSRF.17.21.B10.1.454.CMB.2.raw
  modified_base (237)..(237): a, c, t, g, unknown or other
  modified_base (250)..(250): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactcctccctgcccgtcacccttggacacgccgcctccatctcctgcaggtctagtcaaagcctcgtcanagtgatggaaacntctactcatgtgttcagcaggacggccggaccaatctaccgaaggtctactttatttagtaaggttctcgtggaccggtactcgtcggggtacccccagacagtatcgaagcggcgaggtgggtcaagactactgtactttacacaactagaaatcgaaggtacgaggggtggaggcgtaggaggtagttgggttacggggggtttactacgtgcgagtggacgtaggtacctacgtcgtacggtccgttcgtaacgtttcggaccggtaaggggaactaaacgtcggttaattacgttactaaggacgtaacgtggtcgacgtcgaacgtaaccg

SEQ ID NO: 367958 - DNA, 650 bp, Homo sapiens
  misc_feature: GZ8MTXP01DGXHQ.17.21.B10.1.454.CMB.2.raw
  modified_base (637)..(637): a, c, t, g, unknown or other
  modified_base (639)..(639): a, c, t, g, unknown or other
  modified_base (642)..(645): a, c, t, g, unknown or other
  modified_base (647)..(647): a, c, t, g, unknown or other
  modified_base (649)..(649): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggcaatctccaaggcgtcttatttataaggtctctgaccggatcgtggggtcccagacagattcagcggcagtgggtcagacactgatttcacactagaaaatcagcgaggggtggaggctggagggatgggtacgggggttttactacgtgactatggacgtaggggtaacacgttaccgtcgggtcccgtttctaccgttttcggggcccgtaagggggaaccctaaacgtgggaacttacgtacgtaaggacgaaacgttaggtacgggtccttacggacctaacccgtagttccttacggttccctttacgtaacctttccctttacccccggtcctaacgtccttacggtacttaaccgttccgttaaccgccgttgggaacgggtccggggtcgttgggggacccgaaaggggtccccggtaacgttaacgttcgcgngngcnnnngngng

SEQ ID NO: 367959 - DNA, 587 bp, Homo sapiens
  misc_feature: GZ8MTXP01ESP1B.17.21.B10.1.454.CMB.2.raw
  modified_base (577)..(577): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactcctccctgcccgtcacccttggacacgccgcctcatctcctgcaggtctagtcaaagcctcgtcacagtgataggaaacatctactcatgtgttcagcaggacggccggcaactctacgaagtcgttacttattataacgtctcgtgaccggactcgtcggggtaccccagacagatcaacgggcgcgtaggtcgggtacagactatagtactttcaactactaagaaatcagacggagggtagggaggagtggaaggtaggttacgggttacggggggtttactacggttagacaagtcgacggtacggtactacgtcgttacggtccgttcgttaacgtttcggacggtaacgggaaaccgtaagtaggttaacttagttacgaagacgtaacgtggtaggttcngaacgtaacc

SEQ ID NO: 367960 - DNA, 528 bp, Homo sapiens
  misc_feature: GZ8MTXP01AL8PA.17.21.B10.1.454.CMB.2.raw
  modified_base (518)..(520): a, c, t, g, unknown or other
  modified_base (522)..(528): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggccaatctccaaggcgtcttatttataaggtctctgaccgggatcgtggggtcccagacagattcagcggcagtgggtcagacactgatttcacactgaaaatcagcagggtggaggctgaggatggtcggggtttactactgcatggcagggtacacgttcgtcggtccgttctacgtttttcgggaccgacgggggtaccaaacgtgggaattatacgaagacgaacgtgtggactgacacatctagtctcgtactccttcccgcatctgtactagtctacgcgtgacgtcgggacttgggcgaacggccgacgagttacggnnngnnnnnnn

SEQ ID NO: 367961 - DNA, 622 bp, Homo sapiens
  misc_feature: GZ8MTXP01EFHTT.17.21.B10.1.454.CMB.2.raw
  modified_base (285)..(285): a, c, t, g, unknown or other
  modified_base (608)..(608): a, c, t, g, unknown or other
  modified_base (610)..(610): a, c, t, g, unknown or other
  modified_base (612)..(614): a, c, t, g, unknown or other
  modified_base (616)..(620): a, c, t, g, unknown or other
  modified_base (622)..(622): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggcaatctccaagcgtcttatttataaggtctctgaccgggactcgtggggtcccagacagattcagcggcagtgggcagacactgatttcanactgaaaatcagcaggggtggaggcttaggagttggtcggggtttactactgcatcgcgagggtacacttcgtcggcccgtttcgtaacgtttttcgggaccctaagggggtaacccctaaaacgtgggtaattaacgtacgaagtaacgaaacgttggttaggacttacgacaaccctaattccgtgttactttcctaacgtttccctttccccggtaccctaacgttccttacggtaacctttaggttaccttaaccggccttcgggtaacgggccggggtcgttacggggacccgaaagggcccggacttaagttaaggngngnnngnnnnngn

SEQ ID NO: 367962 - DNA, 610 bp, Homo sapiens
  misc_feature: GZ8MTXP01ER2CC.17.21.B10.1.454.CMB.2.raw
  modified_base (234)..(234): a, c, t, g, unknown or other
  modified_base (246)..(246): a, c, t, g, unknown or other
  modified_base (438)..(438): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttgacagccgcctcatctcctgcagtctagtcaaacgcctcgtcacngtgatggaaacntctactcatgtggttcagcaggacggccggaccaatctaccgaaggtcgtttactttaagtttaagtaacggttctcgtcggaccgggtactcgtcggggtacccccaggacagtactcgaagggcggcgtagggtcggggtacaggactacgtgtactttcaactactagaaatcaggacgaggggtaggnggacgtaggacggtagttcgggttacggggggtttactacgtcgacagtgacggtaggtacctacgtcgtcggtccgttcgtaacggttttcggaccggacgggttaaaccgtaaacggtcgttaagttacacgtaaggacgtaacgtcggtcggttacgtcggcgtaaccg

SEQ ID NO: 367963 - DNA, 692 bp, Homo sapiens
  misc_feature: GZ8MTXP01B4TNV.17.21.B10.1.454.CMB.2.raw
  modified_base (251)..(251): a, c, t, g, unknown or other
  modified_base (377)..(377): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacacgccggcctccatctcctgcaggtctagtcaaagcctcgtccacagtgatggaaacntctactcatgttgttcagcgaggacggcccgggaccaaactcctaccgaaggtcttactttatttagtaagtctcgtggaccggtacttcgtcggggtccccccagacagtacttcgaaggccggngtagggtcgggtcacgactactgtactttcaactactaagaaactcgagacggtagggggttagggacgggtacgtagggaagggtagttacggggtttacggggggtttaaccgttacgttacggtaccgtaaggtcggacggttaacggggtaaccgttaccggttccggttacgggttcccgttttccgttaacggtttttccggggacccggtaaacggggttaacccgtaaacggttacgggttaatttcggacgtaaggtaaccggtaacgtttcgggtacggttccgtaaccggttcccgttaacccg

SEQ ID NO: 367964 - DNA, 585 bp, Homo sapiens
  misc_feature: GZ8MTXP01DAKSW.17.21.B10.1.454.CMB.2.raw
  modified_base (576)..(585): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggcaatctccaaggcgtcttatttataaggtctctgaccggactcgtggggtcccagacagatcagcggcaggtgggcagacactgatttcacactagaaaatcgagcgaggggtggaggcgtaggagggtagtcgggttacggggtttactacgtgacagtggacgagggtacacgtcgtggtccgttctacgtttcgggaccgaagggggaaccaaacgtgggtaactagtacgaaggacgtaacgtaggtggtcgtgaccacctattcttgttcctttcgtaacctttcccgttaccccgtcctaacgttcctacggtaacttacggtctaacggccgtggaacgggtcgggtccgttgggacgaaacggtcgacagttgnnnnnnnnnn

SEQ ID NO: 367965 - DNA, 649 bp, Homo sapiens
  misc_feature: GZ8MTXP01CW0VN.17.21.B10.1.454.CMB.2.raw
  modified_base (252)..(252): a, c, t, g, unknown or other
  modified_base (491)..(491): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactcctcctgcccgtcacccttggacagccgcctcatctcctgcaggtctagtacaaacgcctcgtccacagtcgataggaaacntctactcatgtggttacagcaggcggcccggacaagtccacgaaggtcgttacttaagtttagtaagggttctacgttacggaaccgggtactcggtcggggtaccccccaaggtactaggtacttacggaaacgggtccgggtcgtagggtttacggggtaccaaacggtaacctacgttagtaactttaccaactaacgttaaggaaaactccgaaggacggtaggggtaggacggngtagaagggtagttcgggttacgggggtttaacacgttgacgtagtcgacggtacggtaactcgtcgttcggtccgttagtaacgtttcggaccggtaaacgggacccgtaaagttggaattcgacgtaacgacgtaacgtggtagctgaaccgtaac

SEQ ID NO: 367966 - DNA, 627 bp, Homo sapiens
  misc_feature: GZ8MTXP01AIQLB.17.21.B10.1.454.CMB.2.raw
  modified_base (239)..(239): a, c, t, g, unknown or other
  modified_base (251)..(251): a, c, t, g, unknown or other
  modified_base (258)..(258): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacacgccggcctccatctcctgcaggtctagtcaaacgcctcgtccanagtgatgaaacntctactnatgtgttcagcaggacggccggaccaatcctacgaaggtcgtttactttaagtttagtaacgggtccttacgtacggacccgggtacttccggtacgggggtacccccaaggactaggtactcgaaacggtcgggcgtacgggtgggtacagacgtactagtaactttaccgaactaacgtaagaaaacgtcgaaggtacgggtaggggtacgggaggtacgtaggtagggtagttcggggttaacgggggtttacacgtgactagtgacgacggtacacgttcggtacgtccgttagtaaggtttcggaccggtaagggaacctaagtggaattcgacgaaggacgtaacgtggcgcgtcgccgtaac

SEQ ID NO: 367967 - DNA, 546 bp, Homo sapiens
  misc_feature: GZ8MTXP01CDE2F.17.21.B10.1.454.CMB.2.raw
  modified_base (536)..(536): a, c, t, g, unknown or other
  modified_base (538)..(546): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggccaatctccaaggcgtcttatttataaggtctctgaccgggactctggggtcccagacagattcagcggcagtgggtcagcactgatttcacactagaaaatcagcgagggtggaggctgaggatggtcgggggtttactacgtgcatggcgaggggtacacgtcgttgggcccgtttcgtacgttttggggctacgggggaacctaaacgtgggattagtcgaagacgtaaacgtgtacggctggcaccattctgtcctttcgattccctttcccgcctactctcgtacttaacgtcctaacgtcgttggaggtcgggcttgggccaaggccgcaagttgngnnnnnnnnn

SEQ ID NO: 367968 - DNA, 616 bp, Homo sapiens
  misc_feature: GZ8MTXP01DHIML.17.21.B10.1.454.CMB.2.raw
  modified_base (250)..(250): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacacgccggcctccatctctgcagtctagtcaaagcctcgtccacagtgataggaaacntctactcatgtggttcagcaggacggccggaccaaactctaccgaaggtcgttactttaatttagtaacggttctcgtacggacccgggtactcggtcggggtaccccccaggacagtattcgaaggcgcgaggtgggtacagactactgtactttacaactactaagaaaactcgaaggacggtaggggtaggagggcgtagggaaggtacgttcgggttacggggggtttaactagtagtctagtcgacgtacgggtactacgttcgtacggttccgttacgtaacgtttcgggacccggtaacggggaaccaaagtgttacgttattacgaaggaccgtaagtcggtcggctcgaacgtaacc

SEQ ID NO: 367969 - DNA, 574 bp, Homo sapiens
  misc_feature: GZ8MTXP01ESIF3.17.21.B10.1.454.CMB.2.raw
  modified_base (251)..(251): a, c, t, g, unknown or other
  modified_base (272)..(272): a, c, t, g, unknown or other
  modified_base (283)..(283): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgataggaaacntctactcatgtgttcagcagnggccggcatcncaagcgtcttattataaggtctcgtgaccggactcgtcggggtacccccaggacagtattccgaaagccggctagggtggggtacaggacctacgtgtactttcactactagaaatcagacgaggggtggaggcgtagaggtagtgggttacggggggtttactcgtagctaagtgcgtaggtactacgtcgtcggtccgttagtaacgttttcggaccggtacgggttaaacccgtaaacggtaggacttacgttacgaagaacgtaacgtggtcgcttcgccgtaaccg

SEQ ID NO: 367970 - DNA, 625 bp, Homo sapiens
  misc_feature: GZ8MTXP01BJ76Y.17.21.B10.1.454.CMB.2.raw
  modified_base (249)..(249): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccgcctccatctcctgcaggtctagtcaaagcctcgtccacagtgatggaaacntctactcatgtgttcagcaggacggccggacaatctaccgaaggtcgttacttatttataacggtctcgtggaccggtactcggtacggggtacccccaggacagtacttcgaaaggtccggcgtagggtggggtacaaggtacctacgtgtaactttacgaactaacgtaagaaaatccgaaggacggtaagggggtggaagggtcgtagggaagggtagttcggggttacggggggtttactacggtgtaccgaagttcggacgtacgggtactacgttcggtcggtccgtttcgtaacggtttcgggaccgtaacggggaaacctaaagtggaacttcgttacgaagtacgtaacgtgacggctcgcgtaacc

SEQ ID NO: 367971 - DNA, 548 bp, Homo sapiens
  misc_feature: GZ8MTXP01AO6O8.17.21.B10.1.454.CMB.2.raw
  modified_base (250)..(250): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacntctactcatgtgttcagcagacggccggcaatctaccaaggctcttatttataaggtctcgtggaccgggactcgtcgggggtccccccagacagacttcaagcgggcaggtgggtcagacactgactttcacactagaaaatcagcgaggggtggaggcgtagaggagtggtcggggggtttactacgtgcagtgcgagggtacacgtcgtggtccgttctaagttttcggaccgtaggggacccaaagttgggaacttcgttaccgaagacgaacgttggtcggctcgctaacccg

SEQ ID NO: 367972 - DNA, 609 bp, Homo sapiens
  misc_feature: GZ8MTXP01AB9OV.17.21.B10.1.454.CMB.2.raw
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccgcctcatctctgcagtctagtcaaagcctcgtccacagtgataggaactatctactcagtgttggttcagcaggacggccgggaccaactcctaccgaaggtcttactttatttataaggtctcgtcggaccggtactcgtcggggtacccccaggactagtacttcgaaggcggtcgaaggtcgggtacagactactgtacttacactactagaaatcgagtcgagggtggaggcgtgaggtagttgggttacgggggtttactagttgacgtaagtcgacgtacgggttacacgttccggtacgtccgtttacgtaacggtttcgggaccggtaacgggttaaccgtaaacgttcgggacttacgttacgaaggacgtaacgtcgggtaggttcctcggaacgtaacccg

SEQ ID NO: 367973 - DNA, 652 bp, Homo sapiens
  misc_feature: GZ8MTXP01ELW8Z.17.21.B10.1.454.CMB.2.raw
  modified_base (252)..(252): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacacgccgcctccatctcctgcaggtctagtcaaacgccctcctccacagtgatagaaacntactactcatgttggttacagcaggacggccggactaatccgtacgaaggtcttactttaatttaagtaacggttctaccgtacggtacccgggtacttccggtacgggggtacccccccaaggtaacctagtactttaccggaaacggtccgggcgtaacgggttcggggtaccacggaacctacgtagtaactttacgaactaactaagaaactcgaggtacggtaggggtaggaggacgtaggaaggtagttacgggtttacggggggtttactacgtgacgtagtcgacggtaggtactacgtcgtcggtaccgttcgtaacggtttcggacggtaacgggttaacgaaacgtggacttcgacgtaagacgtaagtggtcggctcgaaccgtaacg

SEQ ID NO: 367974 - DNA, 545 bp, Homo sapiens
  misc_feature: GZ8MTXP01AX4O1.17.21.B10.1.454.CMB.2.raw
  modified_base (534)..(540): a, c, t, g, unknown or other
  modified_base (542)..(542): a, c, t, g, unknown or other
  modified_base (544)..(544): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggccaatctccaaggcgtcttatttataaggtctctgaccgggactcgtggggtcccagacagattcagcggcagtgggtcagacactgatttcacactagaaaatcagcgaggggtggaggcgtggaggagttggttacggggtttactacgtgctagtggacgagggtacacgtcgtcggtccgttctacgttttggccgtaggggaccaaacgtggatagtcgagacgaactgtcgcgtgcacattctgtcttcgacttcttctccgcctatcctacgtactacgtcctacgtctggaacggcgggttacgtcgggaccgaaggggccagttagttagnnnnnnngngng

SEQ ID NO: 367975 - DNA, 572 bp, Homo sapiens
  misc_feature: GZ8MTXP01AX1YQ.17.21.B10.1.454.CMB.2.raw
  modified_base (557)..(557): a, c, t, g, unknown or other
  modified_base (562)..(572): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggttcagcagaggccggccaatctccaaggcgtcttatttataaggtctctgaccgggatcgtggggtcccagacagattcagcggcaggtgggcagacactgtatttcacgactagaaaactcaagcgaggggtggaggctaggagggtagttgggttacgggggtttactacgtgctagtcggacgagggtacacgtcgttcgggtccgttctacgttttcgggaccgaaggggaccaaaacgtggaatatacgaacggaacgtaaacgtggtacggcttacgccaacctatcttagttccttacgtacttccgttccccgcctaacgtcctcgtaccttacgtctaccgtctggacggcgggcgttggacgacggcgnttagnnnnnnnnnnn

SEQ ID NO: 367976 - DNA, 582 bp, Homo sapiens
  misc_feature: GZ8MTXP01CPINL.17.21.B10.1.454.CMB.2.raw
  modified_base (565)..(565): a, c, t, g, unknown or other
  modified_base (571)..(571): a, c, t, g, unknown or other
  modified_base (574)..(582): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagacggccggccaatctccaaggcgtcttatttataaggtctctgaccggactcgtggggtcccagacagattcagcggcaggtgggcagacactgatttcaacatagaaaatcagcgaggggtggaggctaggagggtagtcgggttacggggtttactacgtgacagttcggacgtagggtaccacgttcgtcgggtccgttataaagtttcgggaccgtacgggggaacctaaacgtggtattacgtacgaagacgaacgtggtggctgacctacattctcgtcttactcgttccctttcccgactacttcgtcgtaccgttagttcctaaccggtcgttcggaacgggccgggtcgttcgggaccgacgggccganacgttncgnnnnnnnnn

SEQ ID NO: 367977 - DNA, 646 bp, Homo sapiens
  misc_feature: GZ8MTXP01BLGU8.17.21.B10.1.454.CMB.2.raw
  modified_base (235)..(235): a, c, t, g, unknown or other
  modified_base (248)..(248): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccgcctccatctctgcaggtctagtcaaagcctcgtccanagtgataggaacntctactcatgttgttcagcaggacggccggaccaaatccgtaccgaaaggtcgttactttaagttttagtaacgggttcctacgtcggacccgggtactcggtcggggtacccccaggacagtacttcgaacggcggcgaggtcggggtacaggactactgtacttacactactagaaactcgagacggtagggtaggaggcgtaggaggtagttgggttacgggggtttactacgtgacgtagtgacggtaacggtacgtacgttcgtacggtaccgttacgtaacggttttccgggaccggtaacggggttaaccgtaaaccggtaggttaacgttacgttacgtaacggtaaccggtaacgttcgggtacggttaccgtcggaacccgtaacccg

SEQ ID NO: 367978 - DNA, 595 bp, Homo sapiens
  misc_feature: GZ8MTXP01B1EYV.17.21.B10.1.454.CMB.2.raw
  modified_base (164)..(164): a, c, t, g, unknown or other
  modified_base (583)..(584): a, c, t, g, unknown or other
  modified_base (586)..(586): a, c, t, g, unknown or other
  modified_base (588)..(590): a, c, t, g, unknown or other
  modified_base (593)..(593): a, c, t, g, unknown or other
  modified_base (595)..(595): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacntctacttcatgtggtttcagcagaggccggcaatctccaagggctctttatttataaggtctctggaccgggatcgtggggtcccagacagattcgagcgcagtgggcagacactgatttcaacactagaaaatcagcgaggggtggaaggctaggaggtagtggttacggggtttaactacgtggacaagtcggacgtagggtacacgttacgtcgggtcccgtttactacgttttcgggaccgtaacggggaacctaaacgtggaatacgtacaaggaacgaacgttggtcggtacgtgaccacattcgtgttcttcgaactttccgttcccactatcgtacgtacttaacgtccgtaaccgtctcggacggtcgggcgttcgggaccgaaacgggcggtaccttaaagggttcagnngngnnntgngn

SEQ ID NO: 367979 - DNA, 635 bp, Homo sapiens
  misc_feature: GZ8MTXP01BD7JB.17.21.B10.1.454.CMB.2.raw
  modified_base (623)..(623): a, c, t, g, unknown or other
  modified_base (626)..(633): a, c, t, g, unknown or other
  modified_base (635)..(635): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgataggaaacatctacttcatgttggtttcagcaggacggccgggaccaatcctaccgaaggtcgttactttatttaataaggttctcgtcggaccgggactcgtcgggggtacccagacagtacttcgaggcggcgtaggtgggtcagactactgtactttcaacactagaaaatcgagcgaggggtggaggcgtaggaggtagttcgggttacggggtttactagtgctagtgacgagggtacacgttcgtcgggtcccgttcgttacggttttcgggaccgtaacgggggaactaaacgtgggaattacgacgaggaacgtaagtcggtacggtctacgacctaccgtattcgttacgttccttaccgtcctttcccgttaccccgtactacttccgtacgtaccgttacgtacctacggtcgtcggacggtccgggtcgttcgggaccgaacggcgacttaaggngcnnnnnnnngn

SEQ ID NO: 367980 - DNA, 658 bp, Homo sapiens
  misc_feature: GZ8MTXP01EHZCD.17.21.B10.1.454.CMB.2.raw
  modified_base (646)..(646): a, c, t, g, unknown or other
  modified_base (648)..(654): a, c, t, g, unknown or other
  modified_base (656)..(656): a, c, t, g, unknown or other
  modified_base (658)..(658): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggcaatctccaaggcgtcttatttataaggtctctgaccggactcgtcggggtcccagacagattcgagcggcgaggtgggcagacactgtatttcaacactagaaaatcgagcgagggtggaggcgtaggaggtagttgggttacgggttttaactacgtgctaagtcggacgtagggtacctaccgttcgtacggtccgtttcgtacgtttcgggacccgtaacggggtaaccctaaacgtaggtaattacgtaccgaaggtaaccgtaacgttgggtacggtctacggacctaacctaacgttcgttacgttccttacgtacctttccccgtttaccccgcctaacttccggtacttaaccgttaacgggttccctaaccggtccgttaacgggccgggccggggttccgttcgggaccggttaaacgggtccgtaaccggaagttacggngnnnnnnngngn

SEQ ID NO: 367981 - DNA, 617 bp, Homo sapiens
  misc_feature: GZ8MTXP01BDU1T.17.21.B10.1.454.CMB.2.raw
  modified_base (605)..(606): a, c, t, g, unknown or other
  modified_base (608)..(608): a, c, t, g, unknown or other
  modified_base (610)..(611): a, c, t, g, unknown or other
  modified_base (613)..(613): a, c, t, g, unknown or other
  modified_base (615)..(615): a, c, t, g, unknown or other
  modified_base (617)..(617): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggccaatctccaaggcgtcttatttataaggtctctgaccggactcgtggggtcccagacagattcagcggcagtgggcagacactgatttcacactagaaaatcagcgagggtggaggctgaggatggtcggggtttactcgtgcatgcgagggtacacgtcgtggtccgtttctacgttttcgggaccgtaagggggaacctaaacgtcgggaattacgtacgaaggacgtaaacgttggtacggtaccttaggacccaaccgtaacttccgttagtttccctttacgtaactttcccgtttccccgacctaaccgttccttacgggtaccttacgttccgtaaccggtccgttacggtacgggccggggtcgttcggggaccgaacggggcgaccgttaaaggttcgcgnngngnncngngn

SEQ ID NO: 367982 - DNA, 613 bp, Homo sapiens
  misc_feature: GZ8MTXP01CDGOD.17.21.B10.1.454.CMB.2.raw
  modified_base (201)..(201): a, c, t, g, unknown or other
  modified_base (602)..(602): a, c, t, g, unknown or other
  modified_base (604)..(613): a, c, t, g, unknown or other
tcagcgtagactagcacgaccggtgctcgatttagtgtcgtcgcaagggtgacgggcagggagagtgatgactcagtctccactctccctgccccgtcacccttggacagccggcctccatctcctgcaggtctagtcaaagcctcgtccacagtgatggaaacatctacttcatgtggtttcagcagaggccggcaatcncaaggcgtcttatttataaggtctctgacggactcgtcggggtcccagacagtattcgagcggcaggtggcagacactgtattcacactagaaaatcgagcgaggggtaggagcgtaggaggtagttgggttacggggtttactaacgtgacgtagtacggacgaacgggtacctaccgttacgttcgggtcccgtttaccgttacgttttccggggaccgtaacgggggtaaccctaaacggtggtaacttaagtacgaaacggaccgtaaagttgggtacgcgttacgacctaccgtatctacgtttccttacgtactttcccgttaccccgtcctacgtcctcggtaactcggttcctacgcgtacgcggcgggcttacgggcgacggacgcttaagngnnnnnnnnnn

SEQ ID NO: 367983 - DNA, 632 bp, Homo sapiens
  misc_feature: GZ8MTXP01BU1I8.17.21.B10.1.454.CMB.2.raw
  modified_base (622)..(632): a, c, t, g, unknown or other
tcagcgtagactagcacgaccggtgctcgatttagtgtcgtcgcaagggtgacggggcagggagagtgatgactcagtctccactctccctgcccgtcacccttggacagccggcctccatctcctgcaggtctagtcaaagcctcgtccacagtgatggaaacatctacttcatgtggtttcagcagaggccggccaatctccaaggcgttcttatttataaggtctctcggaccgggactcgtggggtcccagacagtattcaggcggcaggtgggcagacactgtactttcacactagaaaactcgagcgaggggtggaggcgtggaggtagttcggggtttacggggtttactacgtggactagtcggacgtaagggtacacgtcgtcggtccgttacgtacgtttcgggaccgtacggggtaacctaaacggtggtactacgtacgtaacggaaccgtaaacgtcgggtacgggtcctacggtaccctaaccgtacttcgttacgttcctttaccgtactttccccgttccccgtacctacttccgttacgtacgttacgtccgtacgtccgttagggacgggccggggtcgttcggggacaacggcgtcaaggttnnnnnnnnnnn

SEQ ID NO: 367984 - DNA, 687 bp, Homo sapiens
  misc_feature: GZ8MTXP01EWEVZ.17.21.B10.1.454.CMB.2.raw
  modified_base (198)..(198): a, c, t, g, unknown or other
  modified_base (263)..(263): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccaggtggggatgttgtgatgactcagtctccactcctccctcgcccgtcacccgttggacncgccgcctcatctcctgctaggtctagtacaaacgtccctcgtaccacagtagagtacggaaacntcttactcagtgttggttacagcaggacggcccggactaactcctacgtaacggtcgttactttagtttagtaacggtttccttacggtacggtacccgggtacgttccggtaccgggggtaccccccaaaggtaacgtaaggtaacgttcccgaaaacgggtccgggtccgtaggggtacgggtacaacggtaacctacgttagtactttacaacgtaacgtaagaaactcgaaggtacggaggggttaggaacggtcgtaggacggtagttcgggttacgggggtttactacgtgtactagtgacgtaggtacctcgtacgtcgtaccgttgtaacgtttcggaccgggtaacggttaaccgtaaagtaggagttagttacgtaacgacgtaacgtgggtcgttacgtaacgaacgtaaccg

SEQ ID NO: 367985 - DNA, 631 bp, Homo sapiens
  misc_feature: GZ8MTXP01AVNWR.17.21.B10.1.454.CMB.2.raw
  modified_base (622)..(631): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggttcagcagaggccggccaatctccaaggcgtcttattataaggtctctgaccggatcgtgggtcccagacagattcgagcggcagtgggcagacactgatttcacactagaaaaatcgaagcgagggtggaggctggaggagtggttcggggtttaacacgtgactatggacgaagggtaccacgtcgttcggtccgtttcgtacgtttcgggaccgaggggtaaccctaaacgtggtaactagtacgaaacggaacgtaaacgtgggtacggcgttacggacctaacctaattccgttagtttcccttaccgtaaactttccccgtttacccccgacccttaaacttcccgtaaggtacctttaaacggtcccgtaaccgtccggttaggaaccgggtccgggtaacggttcgggtacgaaacggggcaaccgttagttaggnnnnnnnnnn

SEQ ID NO: 367986 - DNA, 593 bp, Homo sapiens
  misc_feature: GZ8MTXP01B0N9J.17.21.B10.1.454.CMB.2.raw
  modified_base (248)..(248): a, c, t, g, unknown or other
  modified_base (265)..(265): a, c, t, g, unknown or other
  modified_base (551)..(551): a, c, t, g, unknown or other
  modified_base (583)..(583): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactcctccctgcccgtcacccttggacagccgcctcatctcctgcagtcagtcaacgcctcgtcacagtagataggaaacntctactcatgttcgttnagcaggacggccggactaatcctccgaaggtcgttactttagtttaagtaacggtctcgtcggaccggtactcggtcggggtacccccaggtactagtacttcgaaacggcgggcgtaggtcgggtacaggactacgtagtacttacactacgtagaaatcgaggacgaggggtagacggtagagagtaggttgggttacgggggtttactacggtgacgtaatggacggtacgtacgtcgtacggtcgttacgttagtaagtttcggaggtacggaacgtaacgngttacgttagttaccgaagaccgtaagtgcgngtcgcgtaac

SEQ ID NO: 367987 - DNA, 659 bp, Homo sapiens
  misc_feature: GZ8MTXP01AK2I2.17.21.B10.1.454.CMB.2.raw
  modified_base (245)..(245): a, c, t, g, unknown or other
  modified_base (251)..(251): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagcccggcctcatctcctgcaggtcagtcaaagcctcgcacagtgatgaacntctatnatgtgttcagcaggacggcggccaatcctcgaaggtcgttattatttataggtctacgcgaccggactcgtcgggtcccccagactagtacttcgaacgggtcggtaacgtagggttacggggactacgggaactacgttacgtaactttaccaacgtaaacttagaaaacgtccgaaggtaccggaacggggtggaacgggtcgtagggtaaacgggtggttagggtttaacccggggggtttaagtaaccggttgaccgtaaggttcgacggtaacgggtaaccttccgtcggttcgttaccccggtttcgtaacgtttcgggacccggtaaacgggggacctaaacgtcggttacttacttacgttaacgacggtaaccgtggtcgttcgtcgttaacgtaaccg

SEQ ID NO: 367988 - DNA, 580 bp, Homo sapiens
  misc_feature: GZ8MTXP01DDKN8.17.21.B10.1.454.CMB.2.raw
  modified_base (532)..(532): a, c, t, g, unknown or other
  modified_base (570)..(580): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtcacagtgatggaaacatctacttcatgtggttcagcagaggccggcaatctccaaggcgttcttatttataaggtctctgaccgggactcgtcggggtcccagacagattcgagcggcaggtgggtcagacactgtatttcacactagaaaatcagcgaggggtggaggcgtggagggtagtgggttacggggtttactacgtgcagtgacgtagggtacacgttcgtcggtcccgttacgtacgtttcgggacccgtacggggaaacctaaacgtggtatacgtacgaacggtacgtaaacgttggtagcgtcgacacctatcgttcgttcttcgtacttcccgttaccccgctacgtcctacgtaacgttacgtcgtacgtcncgggacggtcgggtcgttcgggacgaacggcgcttagnnnnnnnnnnn

SEQ ID NO: 367989 - DNA, 662 bp, Homo sapiens
  misc_feature: GZ8MTXP01C5SE1.17.21.B10.1.454.CMB.2.raw
  modified_base (199)..(199): a, c, t, g, unknown or other
  modified_base (215)..(215): a, c, t, g, unknown or other
  modified_base (239)..(239): a, c, t, g, unknown or other
  modified_base (252)..(252): a, c, t, g, unknown or other
  modified_base (536)..(536): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccgaggtggggatgttgtgatgactcagtctccactcctccctcgcccgtcacccgttggacncgcccgcctcatctcngcagtcagtacaacgcctcgtcanagtagatagaacntctacgtcagtgtgtcagcaggacggccggacatctacgagtcttatttattagtaacgttctgtacggccggtatcggtcggggtccccaagactaggtacttaccgcgggcgtaacgtaggtcggggtaccaaacggggcctaagttcgttactttaacaacgttaagtaagaaactacgaggtacggtaaggggtgagggtcgttagggaacggtagttacggggtttacgggggtttaacgacttaggggaccttaggtacgacgtacggggtttaaccncggtttccggtacggttcgtttaccgttcgggttaacgggacggtaaaccgggttaacgtaaacggttggaacgttcttacggaaaggtaaccaacggtttggcggttactccttaacggttaacc

SEQ ID NO: 367990 - DNA, 576 bp, Homo sapiens
  misc_feature: GZ8MTXP01B7Q17.17.21.B10.1.454.CMB.2.raw
  modified_base (250)..(250): a, c, t, g, unknown or other
  modified_base (294)..(294): a, c, t, g, unknown or other
  modified_base (308)..(308): a, c, t, g, unknown or other
  modified_base (333)..(333): a, c, t, g, unknown or other
  modified_base (559)..(559): a, c, t, g, unknown or other
  modified_base (565)..(566): a, c, t, g, unknown or other
  modified_base (568)..(568): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggccaatctccaaggcgtcttatttataaggtctctgacggactctggggtccagacngattcagcgcagtgggcagacactgatttcacactgaaaatcancagggtgaaggctnaggactgtcgggtttactactgganactgcgaggtacgtacgtacgtcgtccgtctacgtttacggtacgaacgggaacgaaacgtagtatatacgagaacgaacgtacgtacggtcgtacgtacaaccactacgttcgttacgttacgtacttaccgttcccgtaccgtacgtacgtacgtacgtacgtacgtacgtacgtcgtacggaacgggtcggttcggtacgaacggacggcgacgttagacgtncgtaanngngtcgcgtg

SEQ ID NO: 367991 - DNA, 485 bp, Homo sapiens
  misc_feature: GZ8MTXP02GHRS0.17.21.B10.1.454.CMB.2.raw
  modified_base (478)..(485): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatggtcggggtttactactgcatgcaggggtacactctgggccgttcacttttggccagggggaccaaacgtggatatcagacgaactgtggctgcacatctgtcttcatcttcccgctatctgactgtctacgctgagcgggctggcaaggcgcgatagnnnnnnnn

SEQ ID NO: 367992 - DNA, 550 bp, Homo sapiens
  misc_feature: GZ8MTXP02IGPT6.17.21.B10.1.454.CMB.2.raw
  modified_base (367)..(367): a, c, t, g, unknown or other
tcagcgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctactcatgtggttcagcagaggccggcaatctcaagcgtcttattataagtctctgaccggactcgtcggggtccccagacagattcagcgcagtgggtacagacactgtattcanactagaaatcagcgagggtggaggcgtagaggagttggttcgggtttactacgtgacagtgcgagggtacacgtcgtggtccgttacgtaacgttttcggaccgtaacgggggtaaaccaaaaccgtgggtaacttagtacgaacggaaccgtaaacgttggtacggtcgtacggacctaacc

SEQ ID NO: 367993 - DNA, 543 bp, Homo sapiens
  misc_feature: GZ8MTXP02GCV9S.17.21.B10.1.454.CMB.2.raw
  modified_base (375)..(375): a, c, t, g, unknown or other
  modified_base (379)..(379): a, c, t, g, unknown or other
  modified_base (381)..(381): a, c, t, g, unknown or other
  modified_base (395)..(395): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggttcagcagagcggcaatctccaaggctcttattataaggtctctgaccgggatctggggtcccccagacagattcagcgcagtgggtcagacactgatttcacacgtaaanaaananagagaggaggaggngagaggagtaggttacgggttacgtagtagagagtagacgacggtacgtacgtcgtcgtcgttcgttacgttacggtacggtaacgggaacgtaaacgtacgtacgtaatacgaacgtaacgaacgtacgtacggacgtacgacgacg

SEQ ID NO: 367994 - DNA, 510 bp, Homo sapiens
  misc_feature: GZ8MTXP02GIX1U.17.21.B10.1.454.CMB.2.raw
  modified_base (389)..(389): a, c, t, g, unknown or other
tcagcgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctactcatgtgttcagcagaggccggcaatctcaagcgtcttattataaggtctctgaccgggatcgtggggtccccagacagattcagcgcagtggtcagcactgattcacactagaaaatcaagcagggtgaggcgngagagtggtcgggttacgtactgcgatgcgaggtacgactcgtcgtcgttcgtacgtttacggtccgacgggaacgaaaccgtacgacgtatacaagacgaacgtacgtgcgtcgacaacc

SEQ ID NO: 367995 - DNA, 513 bp, Homo sapiens
  misc_feature: GZ8MTXP02G2W35.17.21.B10.1.454.CMB.2.raw
  modified_base (503)..(513): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggccaatctccaaggcgtcttatttataaggtctctgaccgggactcgtggggtcccagacagattcagcggcagtgggtcagacactgatttcacactagaaaatcagcagggtggaggctgaggatggtcggggtttactatgcatgcgagggtacactcgtgggccgtttctacgttttcgggacccgaagggggaccctaaaacgtgggaatatacgagaacgaacgtgtaggctgcaccatctgtcttcacttctcccgcactcctgactcgtctacgctgacggcggcgtggcgaggccgacagnnnnnnnnnnn

SEQ ID NO: 367996 - DNA, 633 bp, Homo sapiens
  misc_feature: GZ8MTXP02FU46A.17.21.B10.1.454.CMB.2.raw
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggttcagcagaggccggaccaatctaccgaaggcgttactttatttataaggtctcgtgaccgggtactcggtcggggtccccccaggaccagattcgaggcggcgagggtcggggtacagtacctacgttagtactttacaactaacttaagaaaaacttcgaaggacgagggggttaggaacgggtcgtaggaggtagttcgggttacggggtttaactacgtgacgtagtcgacgtagggtactacgtcgtacggtccgttacgttaaacggtttcgggaccgtaacggggtaaaccctaaacggttacggaaatacgttaacgaacggtaaccgtaaacgttaggtacggtaccgtacgacctaacg

SEQ ID NO: 367997 - DNA, 557 bp, Homo sapiens
  misc_feature: GZ8MTXP02JWXFB.17.21.B10.1.454.CMB.2.raw
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggttcagcagaggccggccaatctccaaggcgtcttattataaggtctctgaccgggactctggggtcccccagacagattcagcgcagtggtcagacactgattcacactgaaatcagcagggtgagctgagatgtacgggtttacacgtgcagtgacgaggggtacacgtcgtcggtccgttacgtaaagttttcgggaccgaacgggggtaacccaaaacggttcgggaacgtttaacgtacgaacggtaaaccggtaaacgttacggtacggtccgtacggaccctaaccg

SEQ ID NO: 367998 - DNA, 497 bp, Homo sapiens
  misc_feature: GZ8MTXP02G59ZX.17.21.B10.1.454.CMB.2.raw
  modified_base (330)..(330): a, c, t, g, unknown or other
  modified_base (492)..(497): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgactgggactctggggtcccagacagattcagcggcagtgggtcagacactgatttcacactgaaaatcagcaaggtgaggctgaggatgtcggggtttanactgccatgcaggggtacactctgggccgtttcactttttggccctagggggacccaaacgtggatagtcagacgaaactgtaggctggcaccatctgtcttcatccttccgccatcctgactacgtctacgcttgacgcgggctcggcaacggcgcaatgnnnnnn

SEQ ID NO: 367999 - DNA, 513 bp, Homo sapiens
  misc_feature: GZ8MTXP02F4C2V.17.21.B10.1.454.CMB.2.raw
  modified_base (503)..(503): a, c, t, g, unknown or other
  modified_base (506)..(507): a, c, t, g, unknown or other
  modified_base (509)..(513): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactcgtggggtcccagacagattcagcggcagtgggtcagacactgatttcacactgaaaatcagcagggtggaggctgaggatggttcggggtttactactgcatgcagggtacactctggccgttctacgttttggacccgtagggggaacccaaaacgtgggaattagtccaagaacgaactgtggccttgcacctatctgttcttcacttccttcccgcatcctgactagtctacgctgacgcgggctggccgaaggcgcaanagnngnnnnn

SEQ ID NO: 368000 - DNA, 676 bp, Homo sapiens
  misc_feature: GZ8MTXP02G69T6.17.21.B10.1.454.CMB.2.raw
  modified_base (662)..(662): a, c, t, g, unknown or other
  modified_base (664)..(665): a, c, t, g, unknown or other
  modified_base (667)..(667): a, c, t, g, unknown or other
  modified_base (669)..(669): a, c, t, g, unknown or other
  modified_base (671)..(672): a, c, t, g, unknown or other
  modified_base (674)..(676): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagtcaggacggccggacaatcctacgaaggtcgttactttatttaagtaacggtctcgtacggaccggtacttcggtccggggtacccagacgagtacttcgacggccggacgtagggtcgggtacaacggacctacgtagttactttaccaactactaagaaaactcgaagacggaaggggtaggaggtcgtaggaagggtagttcggggtttacggggtttaactacggtgactagtcgacggtagggtacctacgttcgtcgggtcccgttacttacggtttccggaccggtaaccggggaacctaaacgtggtaaattacgacgtaacgaaacgtaacgttggtcggtactacgaccaaacgtcgttacgttcgttccttactacctttcccgtacccctactaactcgtaacgtacttacgtaccgtacgtcgtacggcgggtccggtcggtacgacgaacgggccacgtaacgngnngncncnncnnn

SEQ ID NO: 368001 - DNA, 520 bp, Homo sapiens
  misc_feature: GZ8MTXP02HFZ0I.17.21.B10.1.454.CMB.2.raw
  modified_base (511)..(520): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactcgtggggtcccagacagattcagcggcagtgggtcagacactgatttcacactgaaaatcagcaggggtggaggctggagggatggtcggggtttactacgtgcatgcagggtacactcgtgggtccgttctacgttttgggacccgagggggaaccaaacgttggagtatcgaagacgaactgtgctgcaccatctgtcttcacttccttcccgctactctacgtactacgtcttacgctagacgtcgggcgtcggcgaaggcgacagagnnnnnnnnnn

SEQ ID NO: 368002 - DNA, 602 bp, Homo sapiens
  misc_feature: GZ8MTXP02HFFUX.17.21.B10.1.454.CMB.2.raw
  modified_base (283)..(283): a, c, t, g, unknown or other
  modified_base (335)..(335): a, c, t, g, unknown or other
  modified_base (382)..(382): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacacgccggcctccatctcctgcaggtctagtcaaagcctcgtccacagtgatggaaacatctacttcatgtgttcagcagcggcggcatcncagtcgtcttattataaggtctctagaccggactcgtcgggtcccccagacngacttcaggtcgcgaggtggtacagactactgtattacactacgtanaaaactcaaggtcgagggggtaggaggacgtaggagggtagttcgggtttacggggtttaacctagtgtccgaagtcgacgtaacgggtactcggttcgtcgggtcccgtttcgttaacggttttcgggaccggtaaacggggtaaaccctaaacggtcgggtaaattacgtaacgaacggtaacggtaaaccgtgggtacggtccttacggacctaacc

SEQ ID NO: 368003 - DNA, 503 bp, Homo sapiens
  misc_feature: GZ8MTXP02FR4F5.17.21.B10.1.454.CMB.2.raw
  modified_base (496)..(503): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactcgtggggtcccagacagattcagcggcagtgggtcagacactgatttcacactagaaaatcagcagggtggaggctggaggatggtcggggtttacactgcatgcagggtacactctggtccgttctacgttttggcccgaagggggaacccaaacgtggaatagtaccagaacgaacttgtaggctgacaccatctgtcttctactccttcccgctatcctgactagtcacgctgagcggctggcaaggcgcatgnnnnnnnn

SEQ ID NO: 368004 - DNA, 587 bp, Homo sapiens
  misc_feature: GZ8MTXP02GHFI4.17.21.B10.1.454.CMB.2.raw
  modified_base (573)..(573): a, c, t, g, unknown or other
  modified_base (575)..(575): a, c, t, g, unknown or other
  modified_base (577)..(577): a, c, t, g, unknown or other
  modified_base (582)..(587): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactcgtggggtcccagacagattcagcggcagtgggtcagacactgatttcacactagaaatcagcagggtggaggctgaggatggtcgggtttacactgcatgcagggtacacgtcgtcggtccgttctacgttttcggccgtacgggggaaccaaaacgtgggaatactacgaacgaacgtaaccgtagtcggcgttaggaccacctaactcttacgttcctttactacttccctttccccgcctaacttcctacggtacttacggtacctaacgtccgttaggacggtcggggtccgttagggcccgaaaagggggctaccgaaacgttacggngngngacgnnnnnn

SEQ ID NO: 368005 - DNA, 571 bp, Homo sapiens
  misc_feature: GZ8MTXP02I39WX.17.21.B10.1.454.CMB.2.raw
  modified_base (252)..(252): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatcctcctgcaggtctagtcaaagccctcgtccacagtgatggaaacntctacttcatgtggttcagcagaggccggcaatctccaaggctcttattataaggtctctggaccgggactcgtcggggtcccccagacagattcaggcgcaggtgggtacagacactgtacttcaacactagaaaatcgagcgagggtggaggcgtagaggtagttcgggttacggggtttaactacgtgacgtagtcggacgtaagggtacctacgtcgtcggtaccgttacgtaaacggttttcggaccgaacgggggtaaaccaaacgttcggaatacgtacgaagaaccgaacgttggtgacgtcgacctaacg

SEQ ID NO: 368006 - DNA, 506 bp, Homo sapiens
  misc_feature: GZ8MTXP02ICLS7.17.21.B10.1.454.CMB.2.raw
  modified_base (492)..(492): a, c, t, g, unknown or other
  modified_base (498)..(506): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaacatctacttcatgtggtttcagcagaggccgggccaatctccaaggcgtcttatttataaggtctctgaccgggactctggggtcccagacagtattcagcggcagtgggtcagacactgatttcacactgaaatcagcagggtggaggctgaggatgtcggggtttactacgtgcagtgcgaggggtacacgttcgtcgggtccgtttctacgtttttgggcccgtagggggaacctaaacgtggatatcgagacgtaatgtggctgcaccatctgtctcacttctcccgctatctgactgtctacgtctgacgcggctggcgaacggcnctaagnnnnnnnnn

SEQ ID NO: 368007 - DNA, 501 bp, Homo sapiens
  misc_feature: GZ8MTXP02HKNE0.17.21.B10.1.454.CMB.2.raw
  modified_base (493)..(501): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggagctgaggatggtcgggtttactactgcatgcagggtacactcgtggccgttctacgttttggcccgagggggtaccaaacgtgggactagtacagaacgaactgtaggctgcaccgatctgtcttcattccttcccgctatctcgactacgtctacgctgacgcggctggcgaaggcgcatagnnnnnnnnn

SEQ ID NO: 368008 - DNA, 593 bp, Homo sapiens
  misc_feature: GZ8MTXP02HT4XN.17.21.B10.1.454.CMB.2.raw
  modified_base (250)..(250): a, c, t, g, unknown or other
  modified_base (449)..(449): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacntctacttcatgtgttcagcagaggccggcaatctccgaaggctacttattataaggtctctgaccggactcgtcggggtcccccagacagattcaggcgcgaggtggggtacacgacacgtgtactttcaactactagaaaatcgaagtcgaggggtggaggctaggaggtagttcgggttacggggtttaacttacgnggtacagtgacgtaagggtaccacgttcgtcggtcccgtttagttaacgtttcgggaccggaacggggtaaacctaaacgtggtaaacttacgtaacgaaacggtaaccggtaaacgttcggtcggaccttacggacctaaccg

SEQ ID NO: 368009 - DNA, 485 bp, Homo sapiens
  misc_feature: GZ8MTXP02FO7FJ.17.21.B10.1.454.CMB.2.raw
  modified_base (476)..(485): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatggtcggggtttactatgcatgcaggggtacactctggccgttcacttttggcctagggggaccaaacgtggaatatcagacgaactgtagctgcacatctgtctcactcttcccgcatctgactagtctacgctgagcggctggcaaggcgcatagnnnnnnnnnn

SEQ ID NO: 368010 - DNA, 486 bp, Homo sapiens
  misc_feature: GZ8MTXP02FY391.17.21.B10.1.454.CMB.2.raw
  modified_base (477)..(478): a, c, t, g, unknown or other
  modified_base (480)..(486): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgattcacactgaaaatcagcagggtgaggctgaggatggtcggggtttacactgcatgcagggtacactctggccgttcacttttggccgtagggggaaccaaacgtgggaatatcagacgaactgtggctgcaccatctgtctcatctccgccatctgactgtctacgctgagcgggctggcgaaaggcgcatagnngnnnnnnn

SEQ ID NO: 368011 - DNA, 571 bp, Homo sapiens
  misc_feature: GZ8MTXP02HCETG.17.21.B10.1.454.CMB.2.raw
  modified_base (561)..(562): a, c, t, g, unknown or other
  modified_base (564)..(571): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctcaaggcgtcttatttataaggtctctgaccggactcgtggggtcccagacagattcagcggcagtgggtcagacactgatttcacactagaaaatcagcgaggggtggaggctggagggtagttggttcggggtttaactacgtgcagtgcgagggtacacgtcgtcgggtccgtttcgtacgtttcgggaccgtacgggggtaaccaaacgtacggtatactacgaagaacgtaacgtggtggcctacgacctaacctacgttcgttcgttccttactacttccttccccgacctactctacgacttacgtcctacgtcctggacggtcggcgtcggacgaacggccgacgacgtagnngnnnnnnnn

SEQ ID NO: 368012 - DNA, 514 bp, Homo sapiens
  misc_feature: GZ8MTXP02G4J7F.17.21.B10.1.454.CMB.2.raw
  modified_base (392)..(392): a, c, t, g, unknown or other
  modified_base (497)..(497): a, c, t, g, unknown or other
  modified_base (502)..(514): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtttctaaccgggactctggggtcccagacagattcagcggcagtgggtcaggcactgatttcacactgaagaatcagcagggtggaggctggaggatggttgggtttatacgtgtcttgctaaggtacacactggtactacgtttggccgaggggaccaagctagganatacaaacgtaactgaggctagcaccatccgtagtccttcacttccttcccgccctatctagacttagtctacgtctgacgcgggtcgtggacaagggcacgtanacggnnnnnnnnnnnnn

SEQ ID NO: 368013 - DNA, 529 bp, Homo sapiens
  misc_feature: GZ8MTXP02GH08R.17.21.B10.1.454.CMB.2.raw
tcagcgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggttcagcagaggccggcaatctccaaggcgtcttattataaggtctctgaccgggactcgtggggtcccccagacagattcagcggcagtgggtcagacactgatttcacactgaaaatcagcagggtggaggctgaggatggtcggggtttactacgtgcatgcgagggtacacgtcgtggccgttacgtacgttttggccgtaacgggggacctaaaacgtcgggaattaagtcgaagaccgaaacttggtaggcctggcaaccg

SEQ ID NO: 368014 - DNA, 567 bp, Homo sapiens
  misc_feature: GZ8MTXP02JV3X7.17.21.B10.1.454.CMB.2.raw
  modified_base (556)..(556): a, c, t, g, unknown or other
  modified_base (558)..(558): a, c, t, g, unknown or other
  modified_base (560)..(560): a, c, t, g, unknown or other
  modified_base (562)..(567): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggcaatctcaaggctcttatttataaggtctctgaccggactcgtggggtcccagacagattcagcggcaggtgggtcagacactgtatttcacactagaaatcagacgaggggtaggaggcgtaggagggtagttcgggttacggggtttaactagtggactagtcggacgtaagggtaccacgttcgtcgggtcccgtttactcgttttcgggaccgacgggggaaccaaacgtggaatagtacagtaacgactgtgctgcacatctgtcttcgacttccgttcccgctactcgtacgtacttacgtctaacgcgtacggacggtcgggtacgtgggaccgaacgggccgacgtagtaaggngngncnnnnnn

SEQ ID NO: 368015 - DNA, 539 bp, Homo sapiens
  misc_feature: GZ8MTXP02IXTN7.17.21.B10.1.454.CMB.2.raw
  modified_base (527)..(527): a, c, t, g, unknown or other
  modified_base (529)..(530): a, c, t, g, unknown or other
  modified_base (532)..(539): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggcaatctccaaggctcttatttataaggtctctgaccgggactctggggtcccagacagattcagcggcagtgggtcagacactgatttcacactagaaaatcagcgagggtggaggctggaggatggtcggggtttactacgtgctagtgacgtaggggtacacgtcgtcgggtccgtttctacgtttttgggacccgtacgggggtaacctaaacgtggaatatcgaagaacgaaactgtaggtcctagcacactcttgtcttcacttcctcccgtcactcctgtactcgtactacgtcgtcgacggcggcgtcggacgaaggcgacgacgngnngnnnnnnnn

SEQ ID NO: 368016 - DNA, 608 bp, Homo sapiens
  misc_feature: GZ8MTXP02G7RDV.17.21.B10.1.454.CMB.2.raw
  modified_base (594)..(594): a, c, t, g, unknown or other
  modified_base (596)..(596): a, c, t, g, unknown or other
  modified_base (598)..(598): a, c, t, g, unknown or other
  modified_base (601)..(601): a, c, t, g, unknown or other
  modified_base (603)..(604): a, c, t, g, unknown or other
  modified_base (606)..(608): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactcgtggggtcccagacagattcagcggcaggtggtcagacactgatttcacactagaaaatcagcgaggggtggaggcgtaggagggagttggttcggggtttaactacgtgcagtgaccgtaggggtaccacgttcgtcgggtcccgtttctacgttttcgggccgtaacgggggtaaccaaacgtgggaatacgtacgaagtaccgaaacgtggtcggctcggacctaccgattccttgttccttacctacttcccttccccgacctacttccgtacgtaccttacggttacctaccgtcgtacgggacggtccggggtacgtcgggaccgaaacggggccgacgtaacgtggngngngcncnncnnn

SEQ ID NO: 368017 - DNA, 631 bp, Homo sapiens
  misc_feature: GZ8MTXP02GU5BV.17.21.B10.1.454.CMB.2.raw
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgataggaaacatctactcatgtgttcagcagaggccggacaatctacaaggcgtctttattataaggtctcgtggaccggtatcgtcggggtcccccagacagtacttcgagcggcgaggtggggtacagactactgtatttacaacactaagaaaatcaagcgaggggtggacggcgtaggaggtagttggttacgggggtttaacctagtggactaagtcggacgtaacggggtaactaccgttccggtacgggtacccgtttacgtaaacggtttttcgggaacccggtaaacgggggaaaccctaaaaccggttacgggaaaacgttattaaccgaaaggtaaaccggtaaaccgttagggttcggaccgttcggaccgtaaacccg

SEQ ID NO: 368018 - DNA, 562 bp, Homo sapiens
  misc_feature: GZ8MTXP02HX0Y4.17.21.B10.1.454.CMB.2.raw
  modified_base (253)..(253): a, c, t, g, unknown or other
  modified_base (268)..(268): a, c, t, g, unknown or other
  modified_base (285)..(285): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacacgcccggcctccatctcctgcaggtctagtcaaacgcctcgtccacagtgatggaaacntctactcatgtgttnagcagaggccggcatcncagctcttattatagtctctgaccggactcgtcgggtccccagacagacttcgaggcggcgtaggtgggtacagacactgtacttcacactagaaatcgagacgaggggtggaggcgtggagtagttgggttacgggtttacgtacgtgtacgagtcgcggtacggtactacgtcgtcggtccgtttacgtacgttttcgggaccgtaaacggggaaccgtaaacgtaggaacttacgtacgaacgacggtaacgtcggtaggcctcggacctaacg

SEQ ID NO: 368019 - DNA, 544 bp, Homo sapiens
  misc_feature: GZ8MTXP02JQXYI.17.21.B10.1.454.CMB.2.raw
  modified_base (533)..(533): a, c, t, g, unknown or other
  modified_base (535)..(535): a, c, t, g, unknown or other
  modified_base (537)..(538): a, c, t, g, unknown or other
  modified_base (540)..(544): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgccacagtgatggaaacatctacttcatgtggtttcagcagaggccggccaatctccaaggcgtcttatttataaggtctctgaccgggactcgtggggtcccagacagattcagcggcaggtgggtcagcactgatttcacactagaaaatcagcgaggggtggaggctggaggatggtcggggtttactacgtgcagtgcgtagggtacacgtctcgggtccgtttctacgttttcggacccgtagggggaaccaaagttggaatatacgagacgaactgtgctgcacatctgtcttcacttccttcccgctactcgtcgtacttacggtctaaccgtcgtcgacggtcggggtcgtcgggaccgaaagggccgacgaacgtacgngngnncnnnnn

SEQ ID NO: 368020 - DNA, 526 bp, Homo sapiens
  misc_feature: GZ8MTXP02JDDT4.17.21.B10.1.454.CMB.2.raw
  modified_base (400)..(400): a, c, t, g, unknown or other
tcagcgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgataggaaacatctacttcatgtggttcagcagaggccggccaagtctccaaggcgtcttatttataaggtctctgaccgggatcgtggggtcccccagacagacttcagcgcagtgggtcagacactgatttcactactagaaaatcagcagggtgaggngagagagtggttcggttacgtagtgagagtgacgacggtacgtacgtcgtcgtcgttcgtacgttcggtacgacggaacgaacgtacgtacgtactacgaacgacgacgtacgtgtcgtacgacac

SEQ ID NO: 368021 - DNA, 543 bp, Homo sapiens
  misc_feature: GZ8MTXP02HTVX6.17.21.B10.1.454.CMB.2.raw
  modified_base (534)..(543): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactagaaaatcagcagggtggaggctgaggagtggtcggggttatacgtgcatgcagggtacatccgtggtccgtttcgtacgttttcggcccgtagggggaacctaaaacgtgatatacagacgaactggtaggctagccgacctatcgtgttacttctacttccttcccgacctactctcgtacttacgtcctacggtctaggacggtcgggtcgttcgggacgaaagggccgacgaagttggnnnnnnnnnn

SEQ ID NO: 368022 - DNA, 622 bp, Homo sapiens
  misc_feature: GZ8MTXP02IRU8Y.17.21.B10.1.454.CMB.2.raw
  modified_base (254)..(254): a, c, t, g, unknown or other
  modified_base (426)..(426): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtacaaagccctcgtccacagtgataggaaactntctacttcatgtgttcagcagacggccggaccaatctaccgaaggtcgttacgtttaatttaagtaacgggttcctcgtacggacccgggtactcggtacggggtccccccagaccaagtacttcgaaggcgcgagtcggggtacacgactacgtgtatttccacacgtaanaaaatcagacgaggggtaggaaggtcgtagaggtagttacgggttacggggtttaacgtacgtgacgagtgcgacgggtacacgtcgtacggtcgttacgtagtttcggaccgtaacgggggtaaaccaaacgtaggtaacttacgtaacgaagtaaccggtaaacgttcggtacggtaccttacggacctaaccg

SEQ ID NO: 368023 - DNA, 609 bp, Homo sapiens
  misc_feature: GZ8MTXP02FZNBK.17.21.B10.1.454.CMB.2.raw
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgataggaaacatctacttcatgtggttcagcagaggccggccaatctccaaggcgtctttattataaggtctctgaccgggatcgtggggtcccccagacagattcagcgcagtggtcagacactgatttcactactagaaaatcagtacgaggggtggagcgtagagggtagttgggttacgggggtttactacgttcgacgtagtcgacgtagggtacctacgttcgtacggtcccgtttactaaacgtttttcgggaccggtaacgggggtaaacccctaaaacggttacgggtaaacttaacgttaccgtaaaacggaaccggtaaaaccgttagggttcgggtaccgttcggaccgtaaacccg

SEQ ID NO: 368024 - DNA, 536 bp, Homo sapiens
  misc_feature: GZ8MTXP02I2KAI.17.21.B10.1.454.CMB.2.raw
  modified_base (524)..(524): a, c, t, g, unknown or other
  modified_base (528)..(528): a, c, t, g, unknown or other
  modified_base (530)..(536): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcaggtgggtcagacactgatttcacactagaaaatcaagcgaaggggtggaggcgtaggagggtagttggttacggggttttaactacgtgtacagtgcgaggggtaccacgtccgtcggtccgtttctaccgttttggcccgaggggaaccaaacgtggatatcgagaacgtaactgtggactcgacaccatctcgttcttctacgttcctcccgctacgtcctgacttcgtactcgctgacgcggctacggcaaggcncgangnnnnnnn

SEQ ID NO: 368025 - DNA, 565 bp, Homo sapiens
  misc_feature: GZ8MTXP02GODRH.17.21.B10.1.454.CMB.2.raw
  modified_base (252)..(252): a, c, t, g, unknown or other
  modified_base (438)..(438): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactcctccctgcccgtcacccttggacacgccggcctccatctcctgcaggtctagtcaaacgcctcgtccacagtgatggaacntctatcatgtgttacagcaggacggccggcaatcctaccgaaggtcgttactttaattataggtctcgacggaccggtactcggtcggggtccccccaaggactagtacttcgaggcggcgtagggttcggacagtactacgtgtacttacaactactagaaaatcgaagacgaggggtagacggngtaggaggtagttagggttcgggtttaactacgtgacgagtacgcggtaggtacacgtcgtaggtcgttacgtaagttcgacgacgggacaacgtgatcacgaagacgacgtagcgctacgactacg

SEQ ID NO: 368026 - DNA, 558 bp, Homo sapiens
  misc_feature: GZ8MTXP02H2DTF.17.21.B10.1.454.CMB.2.raw
  modified_base (252)..(252): a, c, t, g, unknown or other
  modified_base (287)..(287): a, c, t, g, unknown or other
  modified_base (296)..(296): a, c, t, g, unknown or other
  modified_base (310)..(310): a, c, t, g, unknown or other
  modified_base (363)..(363): a, c, t, g, unknown or other
  modified_base (421)..(421): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgccccgtcacccttggacagccggcctccatcctcctgcaggtctagtcaaagcctcgtccacagtgatggaaacntctacttcatgtggttcagcagaggccggcaatcncaaggtctntttattatagtctntgaccggtactcgtcggggtccccagacagattcaggcgcagtggtccagacnctgattcacactagaaaatcagcgagggtggagctagaggtattggttcggggtttanacgtgctagtcgacgagggttacactcgtcggtaccgtttacgtaagttttcgggaccgtaaacgggggtaaacccaaacgtttaggaacttagtacgaacggaacgtaacgtggttacgggcttacggactaaccg

SEQ ID NO: 368027 - DNA, 592 bp, Homo sapiens
  misc_feature: GZ8MTXP02I3TL2.17.21.B10.1.454.CMB.2.raw
  modified_base (250)..(250): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacntctacttcatgtgttcagcagacggccggacaatctccaaggtcgtcttattataaggtctacgtcgaccggtactcgtcggggtccccccagacagtattcagcggctaggtgggtccagactacgtgtactttacactactagaaaactcgaagcgagggtggaggcgtaggaggtagtcggttacggggtttacctagtgctagtcgacgtacgggtactacgttcgtcggttaccgttactaaacggttttcggaccggttaacgggggaccctaaacggtacgggtaattacgacgaacggtaacgtaacgtggtacggtcctaggacccgtaaccg

SEQ ID NO: 368028 - DNA, 530 bp, Homo sapiens
  misc_feature: GZ8MTXP02GC11Q.17.21.B10.1.454.CMB.2.raw
  modified_base (474)..(474): a, c, t, g, unknown or other
  modified_base (520)..(521): a, c, t, g, unknown or other
  modified_base (523)..(530): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggccaatctccaaggcgtcttatttataaggtctctgaccgggactctggggtcccagacagattcagcggcaggtggtcagacactgtatttcacactagaaaatcagcgagggtggaggcgtggaggattggttacggggtttactagtgctagtgcgagggtacacgtcgtggtccgttctacgttttggaccgaagggggtaacaaacgtgggaacttagtacagaacgaacgtgtggctgacaccgatcttcgtcttactactccttcccgcatccngtactgtactacgctgacgcgggtctgggcaaggtcgacgaagtgnngnnnnnnnn

SEQ ID NO: 368029 - DNA, 522 bp, Homo sapiens
  misc_feature: GZ8MTXP02HTNE5.17.21.B10.1.454.CMB.2.raw
  modified_base (331)..(332): a, c, t, g, unknown or other
  modified_base (335)..(335): a, c, t, g, unknown or other
  modified_base (346)..(346): a, c, t, g, unknown or other
  modified_base (394)..(394): a, c, t, g, unknown or other
  modified_base (443)..(443): a, c, t, g, unknown or other
  modified_base (512)..(513): a, c, t, g, unknown or other
  modified_base (515)..(522): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggctcttatttaataaggtctctgaccgggactcgtggggtcccagacagattcagcggcagtgggtcagacactgattcacactagaaaatcagcagggtgagctgagatgtcgggttatacgnnagngacgaggtacncgtcgtcgtccgttctacgtttcggaccgaacggaaccaaagtgatanacgaagacgacgtgtcgctcgacactatctgttctactacttcctcccncctactctacgtacgtacgtacgtacgtacgtacgacggcggcggacggacgacggacgacgacgtagnngnnnnnnnn

SEQ ID NO: 368030 - DNA, 590 bp, Homo sapiens
  misc_feature: GZ8MTXP02HMTHX.17.21.B10.1.454.CMB.2.raw
  modified_base (258)..(258): a, c, t, g, unknown or other
  modified_base (300)..(300): a, c, t, g, unknown or other
  modified_base (314)..(314): a, c, t, g, unknown or other
  modified_base (341)..(341): a, c, t, g, unknown or other
  modified_base (487)..(487): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactcctccctgcccgtcacccttggacagccgcctccatcctcctgcaggtctagtacaaacgtccctcgtccacgagtgataggaaactntctactcatgtgttcagcagacggccggacatcacaggtctnttattataggtctncgacggtactcggtcgggccccagacngtacttcgaggcggctagggtcggtacaagaccacgtgtaacttcaaccaataagaaaactcgaacgtaggaggggtaggaacggtgtaggaaggtagtttcgggttacgggtttaactacgtgtacgaagtgacgtagggtaccncgttcggtccggtccgttacgttacgtttcggggaccgtaacgggaaccctaaacgttggaactagtacgaagacgtaacgtggacgtacgtcgtactaaccg

SEQ ID NO: 368031 - DNA, 676 bp, Homo sapiens
  misc_feature: GZ8MTXP02JUNUN.17.21.B10.1.454.CMB.2.raw
  modified_base (275)..(275): a, c, t, g, unknown or other
  modified_base (675)..(675): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggccaatctccaaggcgtcttatttataaggtctctgaccgggactcgtggggtcccagacagattcagcggcagtgggtaanacactgatttcacactagaaaatcagcaggtggagctgaggatggtcggggtttactacgtgctagtcgcgtaggggtacacgtcgtcggtccgtttctacgttttgggacccgtaagggggtaaccctaaaacggtgggtaactaacgtacgaacggaacgtaaacgtggtacgggacttcggacctaacccgtacttaccgttcgttaacctttccgtaaacgtttcccctttcccccgaccttaacgttcccttacggtaaacctttaacgggttcccttaaccggtcccgtttaagggaccgggacccggggtacgttcgggggtaaccgtaaaacggggtcccgggtaaacgtaaacggtacgacgacgaacgtcgacgtacacgacgacgacgng

SEQ ID NO: 368032 - DNA, 470 bp, Homo sapiens
  misc_feature: GZ8MTXP02J3FWQ.17.21.B10.1.454.CMB.2.raw
  modified_base (464)..(470): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggccaatctccaaaggcgtcttatttataaggtctctgaccgggactctggggtcccagacagattcagcggcagtgggtcagacactgatttcacactgaaaatcagcaggtgaggctgagatgtcgggttactactgcatgcaggggtacactctgccgtcacttttggcaggggacaaactggatatcagacgaaactgtggctgcaccatctgtcttcatcttcccgcatctgactagtctacgctgagcgggctggcaagcgcatannnnnnn

SEQ ID NO: 368033 - DNA, 533 bp, Homo sapiens
  misc_feature: GZ8MTXP02JVJIN.17.21.B10.1.454.CMB.2.raw
  modified_base (525)..(533): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcgagggtggaggctagagggtagtggttcggggtttactacgtggcagttggccgaggggtaccacgttcgtcgggtccgtttcgtaacgtttttgggacccgaagggggtaaccccaaaagttgggaattagttacaaggtaacgaactgtgacgtgacaccatctgtcttcattccttcccgcctatctagtactagtctacgctgagcggctgcagcgacannnnnnnnn

SEQ ID NO: 368034 - DNA, 571 bp, Homo sapiens
  misc_feature: GZ8MTXP02JBJMM.17.21.B10.1.454.CMB.2.raw
  modified_base (238)..(238): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacngtgatggaaacatctacttcatgtggttcagcagaggccggcaatctccgaaggcgtctattataaggtctctgaccggactcgtggggtcccccagacagattcgagcgcgaggtggtacagactactgatttacactaactagaaaatcaagacgagggtgaggctaggaggtaatggtacgggtttactaacgttgactagcgcgtaacggggtacctacgttcggtcggtacccgttacgtaaacggttttcggacccggtaacggggaacccgtaaaacgtcggaacttagacgaacgaacgtaacgtgttacggctcggactaaccg

SEQ ID NO: 368035 - DNA, 503 bp, Homo sapiens
  misc_feature: GZ8MTXP02I4RBH.17.21.B10.1.454.CMB.2.raw
  modified_base (493)..(494): a, c, t, g, unknown or other
  modified_base (496)..(503): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggcaatctccaaggctcttatttataaggtctctgaccgggactcgtggggtcccagacagattcagcgcagtgggtcagacactgatttcacactgaaaatcagcgagggtgaggctggagatggtacgggtttactactgcatgcaggtacacgtctggccgttctacgtttggaccgaggggaacaaacgtggactatcagacgaactgtagctagcaccatctgtcttcacttcgttcccgctactctgacttacgtctacgctgacggcggcgtggacgaagggccacgacgtgnngnnnnnnnn

SEQ ID NO: 368036 - DNA, 485 bp, Homo sapiens
  misc_feature: GZ8MTXP02JUEY8.17.21.B10.1.454.CMB.2.raw
  modified_base (472)..(472): a, c, t, g, unknown or other
  modified_base (475)..(476): a, c, t, g, unknown or other
  modified_base (478)..(485): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcaggtggaggctgaggatgtcggggtttatactgcatgcaggggtacactctggccgttcacttttggccagggggaccaaactgggatatcagacgaactgtggctgcaccatctgcttcatcttccgccatctgactagtctacgctgagtcggctgcgaaggcgcgaanagnngnnnnnnnn

SEQ ID NO: 368037 - DNA, 480 bp, Homo sapiens
  misc_feature: GZ8MTXP02IFH6B.17.21.B10.1.454.CMB.2.raw
  modified_base (353)..(353): a, c, t, g, unknown or other
  modified_base (472)..(480): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactcnggccgttcacttttggccaggggaccaaacgtggatatcagacgaactgtgctgcacatctgtcttcatctcccgcatcctgactagtctacgctgacgcggctggcaaggcgcatagnnnnnnnnn

SEQ ID NO: 368038 - DNA, 748 bp, Homo sapiens
  misc_feature: GZ8MTXP02FJN1O.17.21.B10.1.454.CMB.2.raw
  modified_base (206)..(206): a, c, t, g, unknown or other
  modified_base (239)..(239): a, c, t, g, unknown or other
  modified_base (248)..(248): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggctcatcncctgcaggtctagtcaaagcctcgtccacagtnatggaaacntctatcatgtggttcagcagaggccggcaatcctacaaggtccttacttaatttagaaggtcctacgtggaccggggtactcgtcggggtaccccccagtacctaggtacttcgaacggtcgggtaccgtaacgggttcgggttaccaacggtaaccttaccgttaggtaaccgttttaccgaaccgttaaaccgttaacggtaaaaacgttccgtaaacgggtaccggtaacgggggttacgggaacgggttaccgttaggggtaacgggttacggtttacgggtttaccgggggttttaacctaacgggttacggtaccggttaaagttaccggtaaccggttaacggggttaaccgtaaccgttcggtaccgggttacccgtttacgttaaaacggttttccggggaaccgtaacggggtaaccctaaacggttcggtaacgttacgtaccgtaacggtacgtaacgttacggtacgtacgtacggtaccgtaaccg

SEQ ID NO: 368039 - DNA, 569 bp, Homo sapiens
  misc_feature: GZ8MTXP02G5WDD.17.21.B10.1.454.CMB.2.raw
  modified_base (553)..(553): a, c, t, g, unknown or other
  modified_base (559)..(560): a, c, t, g, unknown or other
  modified_base (562)..(569): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcaggtgggtcaggacactgatttcacactagaaaatcagcgaggggtggaggcgtggaggattggtcggggtttactacgtgcagtgcgtaggtacactacgtcggtccgtttctacgttttcggaccgtacgggggtaacccaaacgttcggaatataccgaagtaacggaacgtggtaggcctaggtccaaccgtactccgttcggttcctttacgaccgttccttaccccgctactcgtacgtacctagtctacgcgtgacggtcggcgtagacgaaggccgtacncgtagnngnnnnnnnn

SEQ ID NO: 368040 - DNA, 594 bp, Homo sapiens
  misc_feature: GZ8MTXP02F7PMI.17.21.B10.1.454.CMB.2.raw
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctactcatgtgttcagcagacggccggacaatctaccaaggcttctttattataaggtctcgtggaccggactcgtcggggtacccccagacagacttcgagcgggctagggtcggggtacagactacgtgtactttacacgaactagaaaatcgaagacgaggggtaggaggcgtaggaggtagttcgggtacgggtttaactacgtagtacgagtacgacggtagggttaccacgtcgtacggtaccgttacgtaacggttttcgggaccggtaacgggaaacctaaacgtggaacttagtacgaacggaccgtaaacgtggtacggcgtacgacctaacc

SEQ ID NO: 368041 - DNA, 653 bp, Homo sapiens
  misc_feature: GZ8MTXP02JBOM1.17.21.B10.1.454.CMB.2.raw
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggttcagcagaggccgggaccaagtctccgaaggcgttctttatttataaggtctcgtcgaccgggtactcgtcggggtccccccaggaccagattcgagcggcagtgggtcagacactgacttcacgactagaaaatcagcgagggtggaggtctaggaggtagtcgggttacgggggtttaaactcgttgacgtaagttcggacgtacggggtacacggttcgttacgggtcccggtttaaccgttaaggtttttacccggggacccgtaaacgggggtaaacccccgttaaaacggttacgggggtaaacttaaccggttaccaaacggggtaaaaccccggtaaacgttcggggtaacggggtccttaccgggacttaaaaccccgg

SEQ ID NO: 368042 - DNA, 640 bp, Homo sapiens
  misc_feature: GZ8MTXP02JSXEM.17.21.B10.1.454.CMB.2.raw
  modified_base (255)..(255): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccaggtggggatgttgtgatgactcagtctccactctccctgcccgtcacccttggacagccggcctccatcctcctgcaggtctagtacaaacgcctcgtccacagtgataggaaacntctactcatgtgttcagcaggacggccggacaatcctaccgaaggtcttattaattagacgtctcgtggaccggtactcggtcggggtaccccagtacgagtacttcgacggtcggcggtagggtcggggtacagactacgtagtacttaccaaacgtaaccgtaagtaaaactcgaaggtaccggtagggggtagggtacgggtacgtagggaacgggttagtttcgggggttaaccggggtttaactacgtggacgtagcgacggtaacgggtactacggttcgtacgggttacgttaacgttaacggtttccggaacggtaacgggaaaccctaagtacgaactaacgtacgaacgaacgtacgtggtcgactcgactaccg

SEQ ID NO: 368043 - DNA, 632 bp, Homo sapiens
  misc_feature: GZ8MTXP02IMEYF.17.21.B10.1.454.CMB.2.raw
  modified_base (283)..(283): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtgttcagcagaggccggcatcncaaggcgtcttattataaggtctctgaccggctcgtcggggtccccagacagtattcaggcggctaggtcggggtacagacctacgtagtactttcacactagaaaactcaagacgagggggtaggacggtacgtaggagggtaagttcgggtttaccgggggtttaacttacgtcggtaccgtagtcggacgtacggggtacacgttcgttacgggtcccgtttacgttaccggttttcgggaccggtaaacgggggtaaaccctaaaaccggttagggtaaacttacgtaccgtaaacggaaccggtaaacccgttgggtacgggtaccgttacggacctaaacccg

SEQ ID NO: 368044 - DNA, 631 bp, Homo sapiens
  misc_feature: GZ8MTXP02H6C03.17.21.B10.1.454.CMB.2.raw
  modified_base (251)..(251): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatcctcctgcaggtctagtcaaagcctcgtccacagtgatggaaacntctactcatgtgttcagcaggaggccggaccaatctaccaaggtcttacttaatttataagggttctcgtcgaccgggtactcggtcggggtcccccagacctagacttcgaggcggcgtagggttcgggtacagaccacgtgtactttaccaactactagaaactccgagtacgaggggtggacggtcgtaggaggtagttcgggttaccgggggtttaactacgtcggtactagtacggacgtacgggttacctacggttacgtcggtccgtttacgttacggtttcgggtaccggtaacgggtaaccgtaaacgtcggtaacttacgtacggtaagtaccggtaacgtcggtacggtaccgtacggtacctaacccg

SEQ ID NO: 368045 - DNA, 600 bp, Homo sapiens
  misc_feature: GZ8MTXP02IQLAH.17.21.B10.1.454.CMB.2.raw
  modified_base (257)..(257): a, c, t, g, unknown or other
  modified_base (367)..(367): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacacgcccggcctccatcctcctgcaggtctagtcaaagtccctcgtccacagtgataggaaactntctactcattgtgttcagcaggacggccggacaatcaccgaaggtcttatttattagtaagttctcgtcggaccggtctcgtcgggtccccagacagtactcgacggcgngtaggtcggtacacgactctagtattacactactagaaactcaggtcgaggggtggagcgtggaaggtgttacgggttacggggtttaactcgtgacgtagtacggcgtaacgggtacctcgttcgtcggtccgtttaccgtacggtttcggaaccggaacgggtaaacctaaaggttacgtactacgtaacgaacggtaacgtacggtcggtcgtaccgtacggtacctacg

SEQ ID NO: 368046 - DNA, 585 bp, Homo sapiens
  misc_feature: GZ8MTXP02I9OI6.17.21.B10.1.454.CMB.2.raw
  modified_base (250)..(250): a, c, t, g, unknown or other
  modified_base (436)..(436): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccgcctcatctcctgcaggtctagtcaaagcctcgtccacagtgataggaaactntctacttcatgtggttcagcagacggccggcaatcctacgaaggtcttacttaattagtaacggtctacgtcggaccggtactcggtacggggtcccccagacagtacttcgacggcggcgtagggtcgggtacagtacctagtgtactttacactaacgtagaaactcgagtcgagggtgacggntaggagtagttcgggttacgggttactagtgactagtcgacgtaggtactcgtcgtcggtccgttacgtacggttacggaccgtacgggaaccctaaaggtcgtacttacacgaacgtacgtaacgtcggtacggtcctacgctaaccg

SEQ ID NO: 368047 - DNA, 637 bp, Homo sapiens
  misc_feature: GZ8MTXP02FTN1Y.17.21.B10.1.454.CMB.2.raw
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagccctcgtccacagtgataggaaacatctactcatgtgttcagcagaggccggcaaagtcaccgaagtcgtactttaatttagtaaggtctcgtggaccgggtacttcggtcggggtacccccaagacctaaggtacttccgagccgggcgtaaggtcgggggttacaacgacctacgtggtaactttacaaactaacgttaacgaaaactcgaagacgaggggtaggaagggtctaggagggtagttagggttaccggggtttaactacgtcgtacgagtacgacgtacggggtactacgttcgtcggtacgttaccgtaaagtttcgggaccgtaaacgggtaaaccgtaaacgtacggtaaactacgtacgaaacggtacgtaacgtggtacgtcgtacgacctaacg

SEQ ID NO: 368048 - DNA, 634 bp, Homo sapiens
  misc_feature: GZ8MTXP02HEQSY.17.21.B10.1.454.CMB.2.raw
  modified_base (238)..(238): a, c, t, g, unknown or other
  modified_base (252)..(252): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacacgccggcctcatcctcctgcaggtctagtcaagccctcgtccanagtgataggaaacntctacttcatgtgttcagcaggacggccggacaatcctacgaaggtcgttactttattagtaacggtctacgtggaccggtactcggtcggggtccccagactagtacttcgacggcggcgtaggtgggacacgactacgtagtacttacactaacttaagaaacgtcgaaggacggtagggggtacggagggtcgtaggacgggtagttacggggtttaccggggtttactacgtggtacgtagtacggtacgtacgggttactacgttccgttacgggttccgtttacgttaccggttttaccggaccggtaaccgggtaaaccgtaaacgtgggtaactacgtacgaacgtacgtaacgtggtacggctccgactaccg

SEQ ID NO: 368049 - DNA, 715 bp, Homo sapiens
  misc_feature: GZ8MTXP02JL32M.17.21.B10.1.454.CMB.2.raw
  modified_base (253)..(253): a, c, t, g, unknown or other
  modified_base (287)..(287): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccaggtggggatgttgtgatgactcagtctccactctccctgcccgtcacccttggacacgccggcctcatctcctgcaggtctagtacaaagcctcgtccacagtgataggaaacntctacttcatgtggttcagcagaggccggcatcncgaaggtctatttattataaggtctcgtggaccggtatcggtcggggtacccccagaccaagtacttacgaggccggtcgagggttggtaccgaagtaaccgtacgttgttaaactttaccaaacctaaaccgttaagtaaaaacttcgaaagggacggtagggggtagggaacgggtacgtagggaagggttaaggttcggggtttacgggggtttaactacgggtagtaccgtagttacggacggtaacggggttacctacgttccggttaccgggttaccgtttaccgttaacgggttttaccgggaacccgggttaaacgggggaaaccccttaaaagggttacggtaaacgttaacgtaaccggtaacgggtaaaccgtaaccggttagggtaccggtaccgttaccggacctttaaacccgg

SEQ ID NO: 368050 - DNA, 551 bp, Homo sapiens
  misc_feature: GZ8MTXP02GMJU0.17.21.B10.1.454.CMB.2.raw
  modified_base (536)..(536): a, c, t, g, unknown or other
  modified_base (540)..(542): a, c, t, g, unknown or other
  modified_base (544)..(551): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggcaatctccaaggcgtcttatttataaggtctctgaccggactcgtgggtcccagacagattcagcggcagtgggtcagacactgattcacactagaaaatcagcgagggtggaggctaggaggagttgggttacggggtttactacgtgcagtgacgaaggtacacgtcgtcggtcccgttcgtacgttttcggaccgtaacgggggaacctaaaacgtggtaactatacgaagaacgacgtgtagctgaccactatctacgttcttcacttcctcccgtctactccgtacgtacttacgtactaccgtagacgtcggtacgtcggacgaacggcgtacganacgnnngnnnnnnnn

SEQ ID NO: 368051 - DNA, 685 bp, Homo sapiens
  misc_feature: GZ8MTXP02FXBLZ.17.21.B10.1.454.CMB.2.raw
  modified_base (673)..(673): a, c, t, g, unknown or other
  modified_base (675)..(675): a, c, t, g, unknown or other
  modified_base (677)..(677): a, c, t, g, unknown or other
  modified_base (680)..(685): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggcaatctccaaggcgttcttatttataaggttctctggaccgggtactcgtcggggtcccagacagtattcgagcggcaggtgggcagacactgtatttccaactaacgtagaaaactcgaggacgtaacggggtggaggacgtagggaagggtagttcgggttaccggggttttaactacgtggactagtcgacgtaaggggtactacgtccgttcggtcccgtttacgttacgttttcgggacccgtaacgggggtaaaccctaaaggtacgggtaacttaacgttaccgaacggtaaacggtaaacgttggtacggtacgttacgacctaccgtaacgttccgtttcgttaccctttactacccgtttcccgttcccccgtaccttacgttaccgttacgtaccgtttaacgttaccgtacgtacgtacggtacggggccgggtacgtacgggaccgaaacgggccgacgaagtagngngngcnnnnnn

SEQ ID NO: 368052 - DNA, 512 bp, Homo sapiens
  misc_feature: GZ8MTXP02H5URY.17.21.B10.1.454.CMB.2.raw
  modified_base (501)..(501): a, c, t, g, unknown or other
  modified_base (503)..(503): a, c, t, g, unknown or other
  modified_base (505)..(512): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggccaatctccaaggcgtcttatttataaggtctctgaccgggactctggggtcccagacagattcagcggcagtgggtcagacactgatttcacactgaaaatcagcagggtgaggctgaggatggtcggggtttacactgcatgcgaggggtacactcgttcggccgtttctaacgttttcggccgaaggggtaccgaaactgggatagtacacgaacgaacctagtggctcgcaccatctcgtcttctattcttctcgcctatctgactagtcttacgactgacgtcggctggcaacggcgcaagngngnnnnnnnn

SEQ ID NO: 368053 - DNA, 521 bp, Homo sapiens
  misc_feature: GZ8MTXP02GHHHC.17.21.B10.1.454.CMB.2.raw
  modified_base (502)..(502): a, c, t, g, unknown or other
  modified_base (511)..(512): a, c, t, g, unknown or other
  modified_base (514)..(521): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactcgtggggtcccagacagattcagcggcaggtgggtcagacactgatttcacactgaaaatcagcgagggtggagcgtggaggagtggttcggggtttactagtgcagtgacgagggtacacgtcgtggtccgttctacgttttcggaccgtacggggaaccaaacgtgaatatacgagacgacgtgtgctgcacatctgtctctactcctcccgctactctgacttagtctacgtctgacggcgggtcgtcggcgaagggccncgaacgtgnngnnnnnnnn

SEQ ID NO: 368054 - DNA, 568 bp, Homo sapiens
  misc_feature: GZ8MTXP02HIZ74.17.21.B10.1.454.CMB.2.raw
  modified_base (557)..(557): a, c, t, g, unknown or other
  modified_base (559)..(559): a, c, t, g, unknown or other
  modified_base (561)..(568): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccggactcgtggggtcccagacagattcagcggcagtgggtcagacactgatttcacactagaaaatcagcgaggggtaggaggcgtggaggtagtgggttacgggtttactagtgcatcgacgagggtacacgtcgtgggtcccgtttctacgttttcgggacccgtaagggggtaacccaaacgtgggaattacgtacgaagacgtaaactggtcgtcgagaccaacctatcttacgtcctttcacttcccgttcccgaccaacttccgttacacgttacgtcacgtctcgacggcgggcgtacggacgaaggccgacgagagngngnnnnnnnn

SEQ ID NO: 368055 - DNA, 638 bp, Homo sapiens
  misc_feature: GZ8MTXP02HFTA7.17.21.B10.1.454.CMB.2.raw
  modified_base (628)..(629): a, c, t, g, unknown or other
  modified_base (631)..(638): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggcaatctccaaggctcttatttataaggtctctgaccgggtactcgtcggggtcccagacagattcagcggcaggtgggtcagacactgatttcacactagaaaatcagcgaggggtggaggctggaggtagtgggttacggggtttaactacgtgctagtgacgtagggtacctactcgtcggtcccgtttctaacgttttcgggacccgtaagggggtaaccctaaaagtcgggtaattaacgtacccgaaaggtaaccgtaaaacgttgggtacgggtaccgttacggaccctaaccgtaacttccgttacggtttccctttaaccgtaactttccccgttacccccgtacctaacttccgttacgaaccgtttacgtaccgttaccgtcgttacgacggtcggtacgttcggacgaacgggcacacgtagnngnnnnnnnn

SEQ ID NO: 368056 - DNA, 543 bp, Homo sapiens
  misc_feature: GZ8MTXP02G8AD0.17.21.B10.1.454.CMB.2.raw
  modified_base (407)..(407): a, c, t, g, unknown or other
  modified_base (534)..(534): a, c, t, g, unknown or other
  modified_base (536)..(543): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactcgtggggtcccagacagattcagcggcaggtggtcagacactgatttcacactagaaaatcaagcagggtggaggctagaggatggtcgggttatactgcatgcagggtacacgtctgggtccttctaactttcggaccgaagggggaaccaaaacgtggaaattaanacgaagaacgaagtgtcgctgacacattcgtcgtcttactacttcccttacccgacctactactacgtactacgtacgtacgtacgtcgacggacggcggacggacgaacggacgacgaacgagagngnnnnnnnn

SEQ ID NO: 368057 - DNA, 638 bp, Homo sapiens
  misc_feature: GZ8MTXP02IQY54.17.21.B10.1.454.CMB.2.raw
  modified_base (379)..(379): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaagccctcgtccacagtgatggaaacttctacttcatgtggtttcagcaggacggccggcaaatctaccgaaggtcgttcttaatttagtaacggtctcgtcggaaccgggtctacggtcggggtcccccaaggtaccagtacttcgaggccgggngaggttgggggtacaagtaccacgttagtactttaccactacttaagaaaatcgagtacgtagggggtaggtacgggcgttaggaggtaggttcgggttaccgggggtttacttacgtgtacgtagtcgacggtaggtacctactcggttcggtaccgtttcgtacggtttcgggaaccggtacgggaaacccgtaagttacggtaacgtacttacgaagtaaccggtaaacgttggtcggtacttacggactaacccg

SEQ ID NO: 368058 - DNA, 580 bp, Homo sapiens
  misc_feature: GZ8MTXP02G4M56.17.21.B10.1.454.CMB.2.raw
  modified_base (344)..(344): a, c, t, g, unknown or other
  modified_base (361)..(361): a, c, t, g, unknown or other
  modified_base (570)..(571): a, c, t, g, unknown or other
  modified_base (573)..(576): a, c, t, g, unknown or other
  modified_base (578)..(580): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggctctttatttataaggttctcgtgaccgggatcgtcggggtcccagacagtattcagcggcaggtgggtcagacactgatttcacaactagaaaatcagcaggggtgagcgtgagtgtggttacgggttactacgngcagtcgacgaggtacnctcgtcggtccgttactacgtttcggaccgtaacgggggaacctaaacgttggatagtcgaacgaacgaactgtgcctgccacctatccgttagttccttacgtactttcccgttaccccgacttactccgttaacgtaccgttacgttacctaccgtcgtacggtacgggtccgggtcgtgggaacgaaacggggcctacgaacgtgnngnnnncnnn

SEQ ID NO: 368059 - DNA, 648 bp, Homo sapiens
  misc_feature: GZ8MTXP02GVQ73.17.21.B10.1.454.CMB.2.raw
  modified_base (258)..(258): a, c, t, g, unknown or other
  modified_base (639)..(639): a, c, t, g, unknown or other
  modified_base (642)..(642): a, c, t, g, unknown or other
  modified_base (644)..(644): a, c, t, g, unknown or other
  modified_base (647)..(647): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggttcagcagaggccggcaatctcaaggcgtcttattataaggtctctgaccggactcgtgggtcccagacagattcagcgnagtggtcagacactgacttcacactagaaaatcgagacgtaggggtaggaggtcgtagagggtgtacgggtttccggggtttaactacgtgacagtcgacgtacggggtactacgttcgtcggtcccgtttcgtacgttttcgggaccgtaacggggaacctaaacgtgggtaaactacgttaacgacggtaaaccgtaaacgttcgggtacgaccgttacggacctaccgtaacgttccttacggtttacccttactaccgtttccccttaccccgtaccttacgtacccgttactaacgttacgtacctacgtcggtacgaccggtcgggtaacgtggaccgtaaacggggtcctacgtaagtccgagcgcgacgtcgngcncncgng

SEQ ID NO: 368060 - DNA, 545 bp, Homo sapiens
  misc_feature: GZ8MTXP02HXT9Q.17.21.B10.1.454.CMB.2.raw
  modified_base (210)..(210): a, c, t, g, unknown or other
  modified_base (372)..(372): a, c, t, g, unknown or other
  modified_base (383)..(383): a, c, t, g, unknown or other
  modified_base (481)..(481): a, c, t, g, unknown or other
  modified_base (535)..(536): a, c, t, g, unknown or other
  modified_base (538)..(545): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggccaatctccaaggctnttatttataaggtctcgtgaccgggactcgtggggtccagacagattcagcggcagtggtcagacactgatttcacactagaaaatcaagcgaaggggtggaggcgtaggagggagttggttacgggtttactacgtggcagtgcgtagggtacacgttcgnggtcccgtttntacggttttcggccgtaaggggacctaaacgtggattataccgagtacgaactgtacggctagcaaccagtctgtcttctacttcctcccgcatccgngtactacgtcttaccgctaggcgcgggtcgtcggacgacggttccgagacgagnngnnnnnnnn

SEQ ID NO: 368061 - DNA, 574 bp, Homo sapiens
  misc_feature: GZ8MTXP02GJCDT.17.21.B10.1.454.CMB.2.raw
  modified_base (564)..(565): a, c, t, g, unknown or other
  modified_base (567)..(574): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggttcagcagaggccgggcaatctcaaggcgtcttatttataaggtctctgaccgggactcgtggggtcccagacagattcagcggcaggtgggtcagacactgtattcaacactagaaaatcaagcgagggtggaggctggaggtagtggttacggggtttactagtgctagtgacgtaggtacactcgtcggtccgttcgtacgttttcgggaccgtaacgggggaacctaaacgtgggaatacgtacgaagaacgaaactggtacgctacgacactattccttagttccttactacttccgttaccccgtactactaccgtcgtaacttacgtaccgttaacgcgtcggacggtcgggcgtcgggacgaacgggcacgacgtagnngnnnnnnnn

SEQ ID NO: 368062 - DNA, 578 bp, Homo sapiens
  misc_feature: GZ8MTXP02HF3DG.17.21.B10.1.454.CMB.2.raw
  modified_base (367)..(367): a, c, t, g, unknown or other
  modified_base (418)..(418): a, c, t, g, unknown or other
  modified_base (560)..(560): a, c, t, g, unknown or other
  modified_base (564)..(564): a, c, t, g, unknown or other
  modified_base (566)..(566): a, c, t, g, unknown or other
  modified_base (568)..(568): a, c, t, g, unknown or other
  modified_base (570)..(570): a, c, t, g, unknown or other
  modified_base (572)..(573): a, c, t, g, unknown or other
  modified_base (575)..(575): a, c, t, g, unknown or other
  modified_base (577)..(578): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggttcagcagaggccggccaatctccaaggcgtcttatttataaggtctctgaccggactcgtcgggtcccagacagattcaggcgcgaggtgggtcagacactgtattcactactagaaatcagcggaggtggaggcgtaggaggtagttgggttccgggtttaacagttgcagtcgacgtacggtaccnctcgtcggtccgttcgttacgtttcggaccgacggggaacaacgtggaatntaccgaagtacgaacgtgtacgctcgcactagttctcgttccttcaccgtttcctacccccgtctagttacctcgtaccttacggtaccttacgcgtaggaacccggtcgggtaccgtgggaaccgacgggacgttacgaanacgngngngncnncncnn

SEQ ID NO: 368063 - DNA, 615 bp, Homo sapiens
  misc_feature: GZ8MTXP02F7P15.17.21.B10.1.454.CMB.2.raw
  modified_base (258)..(258): a, c, t, g, unknown or other
  modified_base (395)..(395): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccaggtggggatgttgtgatgactcagtctccactcctccctcgcccgtcacccttggacacgcccggcctccatcctcctgcaggtctagtacaaagcctcgtccacgagtgataggaacntctactcagtgtgttcagcgaggcggccggactaatccgtaccgaaggtcgttactttaagtttagtaacggttcctcgtacggaccggtactcggtacggggtacccccagacctagtactcgacggcgcgtaggngggtacagactatgtacttacaactactaagaaactcgaagtacggaggggtaggaggtcgaggacggtaggttacgggttacggggtttactacgtgtacgtagtacgacggtaacgggtactaccgttacgtcggtacttacgttacgtttcgggaccgtaacgggaactacggtagacttacgacgaacgtacgtaacgtcggtcgactcgactacg

SEQ ID NO: 368064 - DNA, 618 bp, Homo sapiens
  misc_feature: GZ8MTXP02HQ226.17.21.B10.1.454.CMB.2.raw
  modified_base (251)..(251): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgataggaaacntctacttcatgtggttcagcaggacggccggacaatcgtaccgaaggtcgttactttaagtttataagggttctcgtaggaccgggtactcggtcggggtaccccccagaccagtacttcgacgtcggcgtagggtggtccagtacgactgtacttcactactagaaaatcgagtcgagggtggagtcgaggtaaggtcgttagggttcgggtttaaactcgttgacgtagtacggacgaacgggttacacggttcgtacggttaccgttacgtttaacggtttcgggaccggtaacggggtaaacctaaacggtaggacttaacgacgaacggtacgtaacgtcggtaggtaccgcgtaccgtacc

SEQ ID NO: 368065 - DNA, 634 bp, Homo sapiens
  misc_feature: GZ8MTXP02IGU19.17.21.B10.1.454.CMB.2.raw
  modified_base (251)..(251): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctcgcccgtcacccttggacacgccgcctcatctcctgcaggtctagtcaaagcctcgtccacagtgataggaaacntctacttcatgtgttcagcgagacggccggacaatctacaaggtcttactttaattataaggtctcgtcggacccggtactcggtcggggtccccaagtaccgagtacttcgaggcggtcgtaggttcgggacaacggacctactagtactttacaacaacgtaagaaaactcgaagcgaggggtggaggtcgtaggagtagttcgggtttacggggtttactacgtgactaagtcggacgtaacgggtactacgtcgttacggtccgtttacgttacggtttacgggacggtaacggggtaaacctaaaacggttggtaaaactttacgtaaccgaaaggtaaccgtaaccgttgggtaacggttcccaggtacctaaccgg

SEQ ID NO: 368066 - DNA, 550 bp, Homo sapiens
  misc_feature: GZ8MTXP02FLDNT.17.21.B10.1.454.CMB.2.raw
  modified_base (354)..(354): a, c, t, g, unknown or other
  modified_base (382)..(382): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtcacagtgatggaacatctactcatgtggttcagcagaggccggcaatctcaaggcgtacttattatagtctctgaccggatcgtacggggtccccagacagattcgagcgctaggtcggtnagacatgatttacgactactagaaactnagcgagggtgagctaggagtagtggtacgggtttacacgttgactagtcgacgagggtactacgtcgtacggtcgttacgtaagtttcggaccgtacggggaaactaaacgtgtaacgtacttacgaacggtacgtaaccgtgggtacgtaccgtacgaccttaaccg

SEQ ID NO: 368067 - DNA, 718 bp, Homo sapiens
  misc_feature: GZ8MTXP02INJ49.17.21.B10.1.454.CMB.2.raw
  modified_base (263)..(263): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccaggtggggatgttgtgatgactcagtctccactcctccctcgcccgtcacccgttggacacggccgcctcatcctcctgctaggtctagtacaacgtccctcgtccacgagtgaagtagaaactntactacttcagtgtgttcagcagacggccggacatccacgaaggtcttactttaattagtaacggtctcgtcggaaccggtctcggtcgggtaccccagactagtactcgacgcggcgtaaggtcgggtacaagacctagtagttaactttacgaactacgttaaagaaaactcgaaaggtaccggtagggggtaggtacggtacgtaggggtaggtaacggtttcggggtttaaccggggtttaacttacggtgtacgtaaggttacgggaccggttaagggttaacctacggttccgttacggggttacccgtttacgttaaacggttttccggggaaacccgggtaacggggtaaaaccgtaaacggttacggtaaacgttaacgtaaaccggtaaacggtaaacgtaaccgggttagggttaccggaccgtttacggaccctttaaaccgg

SEQ ID NO: 368068 - DNA, 621 bp, Homo sapiens
  misc_feature: GZ8MTXP02FGB10.17.21.B10.1.454.CMB.2.raw
  modified_base (239)..(239): a, c, t, g, unknown or other
  modified_base (243)..(243): a, c, t, g, unknown or other
  modified_base (252)..(252): a, c, t, g, unknown or other
  modified_base (313)..(313): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacacgccgcctccatcctcctgcaggtctagtcaaacgcctcgtccanagtnataggaacntctactcatgtgttcagcgagaggccggacaatcctaccgaaggtcgttactttatttaanaacggtctcgtacggaccggacttcggtcgggtacccccagaccagtacttgacgcggcgaggtgggtacagactatgtactttacgactatagaaaatcaggcgaggggtacggaggtcgaggtaggtagttagggttacgggtttactagtgacgagttcgacgtaaggtaccgtacgttcggtaccggttccgttacttacggttttacgggaccggtaaacgggggaaaccctaaaggttacggtaacacgttacgaacggtaaaccgtaacggtgggtaccggtactacggaccgtaaacccg

SEQ ID NO: 368069 - DNA, 660 bp, Homo sapiens
  misc_feature: GZ8MTXP02FTVOZ.17.21.B10.1.454.CMB.2.raw
  modified_base (261)..(261): a, c, t, g, unknown or other
  modified_base (646)..(646): a, c, t, g, unknown or other
  modified_base (648)..(648): a, c, t, g, unknown or other
  modified_base (650)..(650): a, c, t, g, unknown or other
  modified_base (652)..(652): a, c, t, g, unknown or other
  modified_base (655)..(660): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgttggttcagcaggaggccggccaatctccaaggcttcttatttaataaggtctctcgaccgggtactcgtggggtcccagacagtntcaggcggcaggtgggtacacggacacgtgtactttcaacactagaaaatcgagacgaggggtgaggtcgtaggaggtcgttaggggttacggggtttaactacggtgctagtcgacgtacgggtactacgtcgtacgggtccgttacttcggtttcggaccgtaacgggggtaacctaaaggttcgggtaaattagtaaccgtaacgggaaaccgtaacggtttacggttacggggtaccctacgggaacccctaccggaacgtttcctacggttttaccttacccggtaactttcccctttccccgacctaacttccgtacgtacttacgttaccgtacgtcgtacggacggtcgggtcgtacggacgaacggcgtacgacgngngngngcnnnnnn

SEQ ID NO: 368070 - DNA, 640 bp, Homo sapiens
  misc_feature: GZ8MTXP02GSUVB.17.21.B10.1.454.CMB.2.raw
  modified_base (165)..(165): a, c, t, g, unknown or other
  modified_base (396)..(396): a, c, t, g, unknown or other
  modified_base (415)..(415): a, c, t, g, unknown or other
  modified_base (629)..(631): a, c, t, g, unknown or other
  modified_base (633)..(640): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgataggaaacntctacttcatgttgttcagcaggacggccggacaatcctcaaggtcgttactttaatttaataacggtctcgtcggaccggtactcggtacggggtcccagacagtacttccaggccggcaggtgggtacacggaccagtgtacttacaaccgtaatagaaaactcgaagcggaaggggtggaggtcgtaggtaagggtaagttcgggtttaccggggttactacgtgacngtacgcgtaacgggtaacncgttaccgtcggttccgtttactacggtttcggaaccggacggtaaacctaaagtcgaatacgtaaacacgtaaccgtaggtgttacggacgtacgtaaccctactacggtctttagttccttactaccgtttccctacccgtctaaacctccggttactacgttacgtaacgcgttaagcggttccggatcggaaacgacgggcaagtacgannngnnnnnnnn

SEQ ID NO: 368071 - DNA, 726 bp, Homo sapiens
  misc_feature: GZ8MTXP02HEWYK.17.21.B10.1.454.CMB.2.raw
  modified_base (355)..(355): a, c, t, g, unknown or other
  modified_base (382)..(382): a, c, t, g, unknown or other
  modified_base (710)..(710): a, c, t, g, unknown or other
  modified_base (712)..(712): a, c, t, g, unknown or other
  modified_base (719)..(720): a, c, t, g, unknown or other
  modified_base (722)..(722): a, c, t, g, unknown or other
  modified_base (724)..(725): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatcctcctgcaggtctagtcaaagcctcgtccacagtgataggaaacatctacttcatgtggtttcagcagaggccggacaatcctaccaaggtcgtcttatttataaggtctctggaccggactcgtcgggtcccagacagacttcgaggcggcaggtggtacaggacatgattcaatactaagaaatcgagacgaggggtagaggcgtaggagggtagttgggtacgggttttanaccgtgcagtcgacgtaagggtaaccncgttccgacgggttcccgttacgttacggttttaccggggacccgtaaacgggggttaaaccctaaaaccgggttgggtaaacttaacgttaccggaaacgtaaaccggtaaacccggtttagggtcggtacgttaccggacccgttaaaaccccgttacgttaccgttaccgtttacccttaccgttaaccccgttttccccgtacccccgtacgttaaccgttacccgttaacgttaaacccgttacggttacccgttaacggtccggtaacgggaccgggtaccgggtacgtaccgggaaaccggaccggtacgacgtagtacgngngcgcgcnncncnng

SEQ ID NO: 368072 - DNA, 669 bp, Homo sapiens
  misc_feature: GZ8MTXP02IDNHW.17.21.B10.1.454.CMB.2.raw
  modified_base (463)..(463): a, c, t, g, unknown or other
tcagcgtagactagcacgaccggtgctcgatttagtgtcgtcgcaagggggactgatcaggactcctcagttcaccttctcacaatgaggctccctgctcagctcctggggctgctaatgctctgggtcccagcatccaggtggggatgttgtgatgactcagtctccactcctccctcgcccgtcacccgttggacacgccggcctccatctcctgcagtctagtacaagcccccccccctgtaccacgagtgataggaaactatctacttcatgttgttcagacaggacggccggacctaatcctaccgaacggtccgttatttaagtttaatacggtcttacgacggtaaccggtactcggtcgggtaccccagacagtactcgaggcgtcgaggttcggtacagacctactgtaactttacactaacgtaaagaaacgtgagcggaggggtaggacggngtaggaggtaggttacgggtttacggggtttacgtaagtggtacgtagtcggaacgtacggggtacaaccgttcgtaccgttacgttaacgttaccggtttacgggaccggttaaacgggtaaacccgttaaaggtacggtaacgtaacgttaccggaaacggtaacggtaaccggttggtaccggtaacgtcggtaccctaaccg

SEQ ID NO: 368073 - DNA, 561 bp, Homo sapiens
  misc_feature: GZ8MTXP02FYZCS.17.21.B10.1.454.CMB.2.raw
  modified_base (292)..(292): a, c, t, g, unknown or other
  modified_base (308)..(308): a, c, t, g, unknown or other
  modified_base (336)..(336): a, c, t, g, unknown or other
  modified_base (360)..(360): a, c, t, g, unknown or other
  modified_base (434)..(434): a, c, t, g, unknown or other
  modified_base (457)..(457): a, c, t, g, unknown or other
  modified_base (554)..(555): a, c, t, g, unknown or other
  modified_base (560)..(560): a, c, t, g, unknown or other
tcagcgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccggccaaatctccaaggcgtcttatttataaggtctctgaccgggactctggggtccagacagatcagcggcagtggtcagacaactgatttcacgactanaaaatcagctaggggngaaggctaggagatggtacggggtttanactagcaagtgcgagggtacactngggtccgttacacgttttcggccaagggggtaaccaaacgtggatatcaagaacaacgtgtagctacgcaccanccttgtcttacactacgttcccncaatccctagactacgtacgtacgtactagtcggaaccgggtacggtcgggtacggaaagggaacccgggtaaacgaaacgtaagagaagagagcannacacng

SEQ ID NO: 368074 - DNA, 518 bp, Homo sapiens
  misc_feature: GZ8MTXP01DG9RD.44.76.G10.1.454.CMB.2.raw
  modified_base (218)..(218): a, c, t, g, unknown or other
  modified_base (295)..(295): a, c, t, g, unknown or other
  modified_base (452)..(452): a, c, t, g, unknown or other
tcagacagtatatacacgaccggtgctcgatttagtcactcatacagggggggtctcaggaggcagcgctctcgggacgtctccaccatggcctgggctctgctattcctcaccctcctcactcagggcacagggtcctgggcccagtctgccctgactcagcctgcccccgtgtctgggtctcctggacagacgatcaccatctcctgcactggaancagcagtgacgttggtgcttatactttgtctctggtatcaacaatatccaggcagacgcccccaaatcatcatttangatgtcagtcatccggccctcgtaggggtttctaatcccgtcttctcgtcggctacccaagtcgtggcaaacacggccctcctgaccatctctgggctcaggctgagcgaggctgattacagtgcagctcatatacaagcagcacgcctaacccttnttcgtcttcggaactgggaccttaggttccaaccgtctggtcacgacccaacggcccctaaccccg

SEQ ID NO: 368075 - DNA, 582 bp, Homo sapiens
  misc_feature: GZ8MTXP01AUEGY.44.76.G10.1.454.CMB.2.raw
  modified_base (219)..(219): a, c, t, g, unknown or other
  modified_base (299)..(299): a, c, t, g, unknown or other
  modified_base (339)..(339): a, c, t, g, unknown or other
  modified_base (357)..(357): a, c, t, g, unknown or other
tcagacagtatatacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcccccgtgtctgggtctcctggacagacgatcaccatctcctgcactggaancagcagtgacgttggtgcttataactttgtctcctggtatcaacaatatccaggcagacgacccccaaatcatcatttangatgtcagtcagtcggccctgtagggtttctatccgcttnctgctacagtctgcaacnccggcctcctgaccatctcgtgggcctccgaggtctggacggacgaggctagtaactttacgacggtgactagccttacaataacgtaacaagcacgacacgtacccctaaccccttattcggttccgttacgggtaaaccgtcgggttaaccgaacgggttacctaaccccggttaccgtaacggtaccgaccggaccccgtaacggaacccccgtaaaccccg

SEQ ID NO: 368076 - DNA, 589 bp, Homo sapiens
  misc_feature: GZ8MTXP01C0KWH.44.76.G10.1.454.CMB.2.raw
  modified_base (292)..(292): a, c, t, g, unknown or other
tcagacagtatatacacgaccggtgctcgatttagtcactcatacagggggggtctcaggaggcagcgctctcgggacgtctccaccatggcctgggctctgctattcctcaccctcctcactcagggcacagggtcctgggcccagtctgccctgactcagcctgcccccgtgtctgggtctcctggacagacgatcaccatctcctgcactggaagcagcagtgacgttgtgcttatactttgctctgtatcaacaatatccaggcagacgcccccaaatcatcatttangatgtcagtcactcggcctgtaggggtttctaagtccgctttctcgtcggcttaacccgaagttctagggacaaaccgccgggccctcccgtagaccctattccgtcgtgggccttcccgagggcctggaaggaccggaggctaggaacttacctaacttcggccgtaagtctactaactaactaacgaacgacgtacgacgacgtacctaacccttacgttcgtacgttacgtaacgtacggacgttacgttacgtaaccgtacgtaacgtacgacgaccgaaccgaaccgaaccg

SEQ ID NO: 368077 - DNA, 592 bp, Homo sapiens
  misc_feature: GZ8MTXP01C32AO.44.76.G10.1.454.CMB.2.raw
  modified_base (236)..(236): a, c, t, g, unknown or other
  modified_base (261)..(261): a, c, t, g, unknown or other
tcagacagtatatacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcccccgtgtctgggtctcctggacagacgatcaccatctcctgcactggaagcagcagtgacgttggtncttatactttgtctctgtatcaacntcatccaagtaaacgccccaaatcatcatctatgacggctaataagacgtccctgtagggtttctaagtcgtcttccactcgcctacaacgtcccgacaacgaccggtccctacccgtagacctaagtcctcgtcgggtcctccgaggctaggaggacgaggctgtattattagttgttacgcttctagtattgttcgtctctattctacttagttcgtacgtttcgggaaacggtcgggaaacccgtaaggttccgtaacccggttccttacgggttccacggaaccccgaacggaaccccgtaacccacgttactccgaacctttcccg

SEQ ID NO: 368078 - DNA, 502 bp, Homo sapiens
  misc_feature: GZ8MTXP01AS6WE.44.76.G10.1.454.CMB.2.raw
  modified_base (217)..(217): a, c, t, g, unknown or other
  modified_base (295)..(295): a, c, t, g, unknown or other
  modified_base (366)..(366): a, c, t, g, unknown or other
  modified_base (416)..(416): a, c, t, g, unknown or other
  modified_base (419)..(419): a, c, t, g, unknown or other
  modified_base (448)..(448): a, c, t, g, unknown or other
tcagacagtatatacacgaccggtgctcgatttagtcactcatacaggggggtctcaggaggcagcgctctcgggacgtctccaccatggcctgggctctgctattcctcaccctcctcactcagggcacagggtcctgggcccagtctgccctgactcagcctgcccccgtgtctgggtctcctggacagacgatcaccatctcctgcactggaancagcagtgacgttggtgcttataactttgtctctggtatcaacaatatccaggcagacgcccccaaatcatcatttangatgtcagtcatcggcctcgtagggtttctaatccgtcttctctggctaccagtctggcacacggcctccngaccagtctcgtggctccgagctgagacgaggctgagttacactgcgtanctnatatacgaagcagcacgcctaacccttancgtcttacggactcgggacaggttccaaccgtctaagcacgccaacgccaaccc

SEQ ID NO: 368079 - DNA, 743 bp, Homo sapiens
  misc_feature: GZ8MTXP01DOERK.44.76.G10.1.454.CMB.2.raw
  modified_base (219)..(219): a, c, t, g, unknown or other
  modified_base (236)..(236): a, c, t, g, unknown or other
tcagacagtatatacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcccccgtgtctgggtctccgtggacagacgatcaccatctcctgcatggaancagcagtgacgttggtncttatactttgtctctgtatcaacatatccaggcagacgaccccaaatcatcaatttatgatgtcagtcatccgcctcgtaggggtttactaactccgtcttctcgtggcctaaccgaaagttcgtacgggaccaaaccgaccggtcccctccgttacgaaccctattcctcgtcgggccttaccgaggcccttaggaacggaacccggaagggtccctaaggtaaacgtttaacccgtacttacgggacctaaacggtcccgttaacctaaatttaaacggtaaacccaaaacgggtacctaaaccggtacccaaaccggtccccttaaaacccccccttttagttaccgggtttacccgtttaaacccggggtaaaaccggtttaccgggggaaaacccttaaacccggggttacccctaaccccgggttaccccgtaaaacgggttacccgaaacccggttaacccccggtaaacccggggaaccccccttaaaaaccccccgg

SEQ ID NO: 368080 - DNA, 626 bp, Homo sapiens
  misc_feature: GZ8MTXP01CSE5H.44.76.G10.1.454.CMB.2.raw
  modified_base (219)..(219): a, c, t, g, unknown or other
  modified_base (236)..(236): a, c, t, g, unknown or other
  modified_base (260)..(260): a, c, t, g, unknown or other
  modified_base (293)..(293): a, c, t, g, unknown or other
tcagacagtatatacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcccccgtgtctgggtctcctggacagacgatcaccatctcctgcactggaancagcagtgacgttggtncttatactttgtctctgtatcaanatatcagcagaccaccccaaatcatctatttangtatgtacagtcctagtccggtaccttgtacggggtttctaacgtccgtctttctcgtcggtcctaaccgtagtcgtacggaccaaaccgccgtcccctccgtacgaccctacttcgtcgtcgggtcctaccggacgtcgtaggacggacgacgtctagtactttaaccacggttcggactagacctagtaactaactaacgaacgacctaacggacctacgtaccctaacccgtttaagttcgttaaccgttcggtaaacggtcgggttaaccgacgttacccgaaccggttaccgtaacgtccgaccgaccccgtaacggcccctaacccg

SEQ ID NO: 368081 - DNA, 681 bp, Homo sapiens
  misc_feature: GZ8MTXP02ISIIQ.44.76.G10.1.454.CMB.2.raw
  modified_base (297)..(297): a, c, t, g, unknown or other
tcagacagtatatacacgaccggtgctcgatttagtcactcatacaggggggtctcaggaggcagcgctctcgggacgtctccaccatggcctgggctctgctattcctcaccctcctcactcagggcacagggtcctgggcccagtctgccctgactcagcctgccccgtgtctgggtctcctggacagacgatcaccatctcctgcactggaagcagcagtgacgttggtgtcttataactttgtctcctggtatcaacaatatccaggcagacgaccccaaatcatctatttangatgtcagtcatcgcctagtagggttctaacgtccgtcttctctcggtcctaccgaagtccgtcgggacctaaaccgaccggtcccttcccgtacgaacccctagttcccgtcgtcggggtcccttcccggaagggtccgtacgggaacgggtacccggaagggtccttaggtaaactttaccttaacgtcggtactacgtcctaacaacgttaacgtaacaaacggtacaacggacctacggacccttaaacccccgtttaagtccggttaacccgttaaccgggtaaacggttaccggggaaaccctaacggggttacccaacccggttaccgtaacgggtacccaaccggtaccccgaaaccggtaccccctaaacccccg

SEQ ID NO: 368082 - DNA, 556 bp, Homo sapiens
  misc_feature: GZ8MTXP02F1CJR.44.76.G10.1.454.CMB.2.raw
  modified_base (323)..(323): a, c, t, g, unknown or other
  modified_base (328)..(328): a, c, t, g, unknown or other
tcagacagtatatacacgaccggtgctcgatttagtcactcatacagggggggtctcaggaggcagcgctctcgggacgtctccaccatggcctgggctctgctattcctcaccctcctcactcagggcacagggtcctgggcccagtctgccctgactcagcctgcctccgtgtctgggtcacctggacagtcgatcaccatctcctgcattggaaccagcagtgacattggtgttataactatgtctctggtaccaacaacaccaggcaaacgcccccaaatcatgattcatgatgtcagtaatcggcctgtagggtttcnggtcncttcctctgctcagtctggcacaccggcctccctgaccatctctgggcctcgaggctgaggcgaggctgacttattactgcagcttacaattaaataaaaacgagaccaaactaacttgttaaatagttaccgggacgggtaacgggaaccgaaacggtctaacggacccgttacgtacggttacaacggtcccgaaaggtcctaccgcccccgtacggtctaacccg

SEQ ID NO: 368083 - DNA, 763 bp, Homo sapiens
  misc_feature: GZ8MTXP02G07VF.44.76.G10.1.454.CMB.2.raw
  modified_base (220)..(220): a, c, t, g, unknown or other
tcagacagtatatacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcccccgtgtctgggtctccgtggacagacgatcaccatctcctgcactggaancagcagtgacgttggtgcttaatactttgtctcctggtatcaacaatactccaggcaagaccgacccccaaaatcatctaatttatgaatgtacagtcactccggccctagtacggggtttactaagtcccgtcttcgtcgtcggtccttaccgtaaagtccgtacggaccaaaccgtacccgggtcccttaccccgtacggtaacccctaattcccttaccggttccggggacccgttacccggaacggggtaccgttaacgggggaacggggtaacccgggaacggggtccgttaacggttaaacctttaaccgttaaccggtcggaaccttacggacccttacaaacgttaacgtaaacaaacggaccgtaacggaccaacgtacccccttaaaaccccctttgttaccggttaccggtttaccgggaaaaccgtttacggggaaaaccctaacggggttaccctaaaccccggttaccgtaaaccggggttacccaacggtaccccccgaaaacccgggtaccccctaaaaccccccgg

SEQ ID NO: 368084 - DNA, 622 bp, Homo sapiens
  misc_feature: GZ8MTXP02GHWFR.44.76.G10.1.454.CMB.2.raw
  modified_base (218)..(218): a, c, t, g, unknown or other
  modified_base (235)..(235): a, c, t, g, unknown or other
  modified_base (302)..(302): a, c, t, g, unknown or other
tcagacagtatatacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgccccgtgtctgggtctcctggacagacgatcaccatctcctgcactggaancagcagtgacgttggtncttataactttgtctcctggtatcaaacaatatccaggcagacgacccccaaatcaatctaatttangatgtcagtctactccggtcccttcgtaggggtttctaacgtcccgtcttcgtctcggcctacgtaagtcgtaggaccaaacgtcccggtccctacctacgtaccctacgtcctcgtcggcctcgacggtctacggacggacgaggtactagtaacttacgtacgtgacgagtccttacaaacttacgtaacaacgacgacgaccacgtaacccttaacccttattcggttaccgttaacgggaacgttacgggaaccgtaaacgggtcctaaacccggtcgtaacggtaccaaccgacccgtaaccggacccaaccccg

SEQ ID NO: 368085 - DNA, 553 bp, Homo sapiens
  misc_feature: GZ8MTXP02HNIVE.44.76.G10.1.454.CMB.2.raw
  modified_base (301)..(301): a, c, t, g, unknown or other
  modified_base (365)..(365): a, c, t, g, unknown or other
  modified_base (407)..(407): a, c, t, g, unknown or other
  modified_base (427)..(427): a, c, t, g, unknown or other
tcagacagtatatacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcccccgtgtctgggtctcctggacagacgatcaccatctcctgcactggaagcagcagtgacgttggtgtcttataactttgtctcctggtatacaacaatatccaggcagacgcccccaaatcatctatttangatgtcagtcatccggccctgtaggggtttctagtcccgtcttctctcgctcagtctagcaacncgcctccagaccatctcgtggcctcgaggtctggagtacggngtctgaattactacgtgacngctagatactaacgagcagacgactaccctacccttagtcgtaccttacgggaaaccttcgggaaaccctagggtaccctaaccgtaccgtacggtaccacgaccccgaaccggacccaacccccg

SEQ ID NO: 368086 - DNA, 663 bp, Homo sapiens
  misc_feature: GZ8MTXP02I2T62.44.76.G10.1.454.CMB.2.raw
  modified_base (219)..(219): a, c, t, g, unknown or other
  modified_base (236)..(236): a, c, t, g, unknown or other
  modified_base (269)..(269): a, c, t, g, unknown or other
  modified_base (302)..(302): a, c, t, g, unknown or other
tcagacagtatatacacgaccggtgctcgatttagtcactcatacagggggggtctcaggaggcagcgctctcgggacgtctccaccatggcctgggctctgctattcctcaccctcctcactcagggcacagggtcctgggcccagtctgccctgactcagcctcgcccccgtgtctgggtctcctggacagacgatcaccatctcctgcactggaancagcagtgacgttggtntcttattactttgtcttctggtatcaactaatntacaggcagacgacccccaaatcatctaatttntgatgtcatcacgtcgtccctagtacggttactactccgtcttctctcggtctaccgaagttcgtacggacctaaaccgcccggtcccttacccgtacgacccctattccgttaccggtcgggcccttaccgaacgggtccgtacgggaacggaccggtacgggtaccttacggttaaactttaacccgttaacgtcggtaccgtacgtccgttaacctaagttaactaacggtaaagaccgaagaccacgtaccccttacccgtttagttcgttaccgttacggaaaccgtaccgggaaccgtacgtaccgtaaccgtaccgtacggtaccaccgtaacccgacggtaccccctaaaccg

SEQ ID NO: 368087 - DNA, 613 bp, Homo sapiens
  misc_feature: GZ8MTXP02IO8D2.44.76.G10.1.454.CMB.2.raw
  modified_base (281)..(281): a, c, t, g, unknown or other
  modified_base (299)..(299): a, c, t, g, unknown or other
  modified_base (307)..(307): a, c, t, g, unknown or other
tcagacagtatatacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcccccgtgtctgggtctcctggacagacgatcaccatctcctgcactggaagcagcagtgacgttggtgtcttataactttgtctcctgtatcaacatcatccgaagtaaaccnccccaaatcatcatctangagctaanagcgcctgtagggtttacatcgtcttccactcgcctacgacgtccgacaccgcgtccctaccgtgaaccatctcgtacgggtcctacgagcgtaggaacggacgaggtcttagtatttattagtttgttgcttacgtagtagtttcggttccgtcgtcttaacgttcttaaacgtttcgttacgttacgttacgggtaacggttacgggtaaacctaacgggttcctaaccggttacgtacggtacccaacggtaaccccgaacggaccccctaaaacccgtcttacgtacccgtaactttccccg

SEQ ID NO: 368088 - DNA, 589 bp, Homo sapiens
  misc_feature: GZ8MTXP02IT042.44.76.G10.1.454.CMB.2.raw
  modified_base (319)..(319): a, c, t, g, unknown or other
tcagacagtatatacacgaccggtgctcgatttagtcactcatacagggggggtctcaggaggcagcgctctcgggacgtctccaccatggcctgggctctgctattcctcaccctcctcactcagggcacagggtcctgggcccagtctgccctgactcagcctgcccccgtgtctgggtctcctggacagacgatcaccatctcctgcactggaagcagcagtgacgttggtgcttataactttgtctcctggtatcaacaatatccaggcagacgcccccaaatcatctatttatgatgtcagtcagtcggccctntaggggtttctaagtccgcttctctggctccgaagtctcggacaaccgaccgtccctcccgtagaccctatcctcgtcgggacctccgaggtcctagggacggtacggaggccgttagtaaactttaccgtacgtgaccagtccttacaattactacaaacggcagactacgaccctaacccttagtcggttacttaccggaaacgtcggggaaaccacggtaccaaccggttcgtaacgtaccgacgaccccaacggacccaaaccccg

SEQ ID NO: 368089 - DNA, 610 bp, Homo sapiens
  misc_feature: GZ8MTXP02IDQRO.44.76.G10.1.454.CMB.2.raw
  modified_base (218)..(218): a, c, t, g, unknown or other
  modified_base (302)..(302): a, c, t, g, unknown or other
  modified_base (400)..(400): a, c, t, g, unknown or other
  modified_base (451)..(451): a, c, t, g, unknown or other
  modified_base (593)..(593): a, c, t, g, unknown or other
tcagacagtatatacacgaccggtgctcgatttagtcactcatacagggggggtctcaggaggcagcgctctcgggacgtctccaccatggcctgggctctgctattcctcaccctcctcactcagggcacagggtcctgggcccagtctgccctgactcagcctgcccccgtgtctgggtctcctggacagacgatcaccatctcctgcactggaancagcagtgacgttggtgtcttataactttgtctcctggtaccagcacgaccccagaaacacgacccccaaatctaatttattangtacgtacaattcgttccgtcccttcggtcgtccctgacgtcgtcttctcgtacgggtacctaagtcgtggactaacgccggtccctccgtgaacctntcctgcgggtcctccgaggctggacggtacgaagtctaggtatttatacgngacacgtctagtaataacgtaacggtaaggtaacgtaacttacgtttacgtacgtaccggacgacggtaacgaacgtaacgtccgtacgtacccgttacgaacggtaccaccgaccgacgtcccgtccgtcccgtacgtccnccgttcctccgtccccg

SEQ ID NO: 368090 - DNA, 766 bp, Homo sapiens
  misc_feature: GZ8MTXP02HGUI0.44.76.G10.1.454.CMB.2.raw
  modified_base (218)..(218): a, c, t, g, unknown or other
  modified_base (234)..(234): a, c, t, g, unknown or other
  modified_base (384)..(384): a, c, t, g, unknown or other
tcagacagtatatacacgaccggtgctcgatttagtcactcatacagggggggtctcaggaggcagcgctctcgggacgtctccaccatggcctgggctctgctattcctcaccctcctcactcagggcacagggtcctgggcccagtctgccctgactcagcctgcccccgtgtctgggtctcctggacagacgatcaccatctcctgcactggaancagcagtgacgttggngtcttatactttgtctcctggtaccagcaacgacccagaaaccacgacccccaaatcaatttagttatcgacggtcaattcgtcctcccgttcggtctaccctggacgccgtcgttctcgtcggtacccaagtccgtcggacctaaaccnccgggtcccttccctacggtaccctacgttcccgtcggtacggggtcccttccgaaggccgttgggaacgggaccggaggttccgtacggttaatttacgtttacgcgacgtacggtaccttaccgtaacttaagttaaacccggtaaagggttaccgggtaaaacctttaacctttaaaccgttaccgtttaccggggaccgtaaccgaaacgggggaaacccctaaaaggtcccggttaccggtaaacccggtttccccgtaaaacgggggtttccccaaacggtacccccggtaaaaggcccccgtttacccccggacccccccgttcggggtaaccccctttacccgttccccggtttttaccccggtccccccccgg

SEQ ID NO: 368091 - DNA, 818 bp, Homo sapiens
  misc_feature: GZ8MTXP02G48EH.44.76.G10.1.454.CMB.2.raw
  modified_base (237)..(237): a, c, t, g, unknown or other
  modified_base (305)..(305): a, c, t, g, unknown or other
tcagacagtatatacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctcgcccccgtgtctgggtctccgtggacagacgatcaccatctcctgcactggaagcagcagtgacgttggntcttaattactttgtcttccgtggtatcaacaatatccaggcagacacccccaaatcatctaatttangatgtcagtcagtccggtcccctaggtaggggtttactaagtcccgtctttcgtcgtggtacctaccgtaacgttcgtacggacctaaaccgtaccggtcccccttaccgtaccggaccctaacgttcccgtacccggttcggggtaccccgttaccggaaaccgggtccgttacggggaacgggtaacccgggtaagggtaccgttacggttaaaaccgtttaaaccgttaaccgtttcgaccggttacgtacccgtttaacccttaaattaaaacggttaaaccctaaacgggtaccctaaacggtacccggaaaccgttacccccgtttaaaacccccttttacggtttacccggtttaacccggttttaacccggggaaaccgggtttaccggggaaaaccccggtaaacgggttttaccccgaaaccccggttttaccggtaaccgggttacccgtaacccggtaaacccccggtaaaacccgggaaccccccgtttaaaaccccccg

SEQ ID NO: 368092 - DNA, 606 bp, Homo sapiens
  misc_feature: GZ8MTXP02IFCQ8.44.76.G10.1.454.CMB.2.raw
  modified_base (209)..(209): a, c, t, g, unknown or other
  modified_base (219)..(219): a, c, t, g, unknown or other
  modified_base (235)..(235): a, c, t, g, unknown or other
  modified_base (307)..(307): a, c, t, g, unknown or other
tcagacagtatatacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcccccgtgtctgggtctcctggacagacgatcaccatctccngcactggaancagcagtgacgttggngtcttataacttgtctcctggtatacaactaatatccaggcaagaccgacccccaaatcaatactatttacngtaatcgtcagtcaacgtcggacccttacgtaggggtttacctaaacgttcccgtacctttccgtcgttacggtccttacccgtaagttccgtgggaaccaccgtacccggtccccttcccgtacacccgtacttcctccgtcgggcctcgacgtcgtaggacggacgagggctagtacttactactgacagtctagactaatacaagcaagcacgtaccctaccttagtctacgtaccggacgtacggacctaagtaccaaccgttacgaggctacgacccgaacgacccctaaaccg

SEQ ID NO: 368093 - DNA, 521 bp, Homo sapiens
  misc_feature: GZ8MTXP01EICL4.13.10.A10.1.454.CMB.2.raw
  modified_base (255)..(255): a, c, t, g, unknown or other
  modified_base (293)..(293): a, c, t, g, unknown or other
  modified_base (337)..(337): a, c, t, g, unknown or other
  modified_base (430)..(430): a, c, t, g, unknown or other
tcagtcacgtactacacgaccggtgctcgatttagcgtcgatctcagggggtctcagagaggagccttagccctggactccaaggcctttccacttggtgatcagcactgagcacagaggactcaccatggaattggggctgagcgtggtttcgtgttagctatttagaaggtgtcagtgtgaggtgcagctggtggagtctgggggagcttggtccagcctggggggtccctgagactctcctgtgcagccctntggattcacctttagagctattggatgagctgggtccncaggctccgagggaagggcgtggagtgggtggcgacataaaganaagtaggagtagagaaatataatagtgatctgtgaggacggattcaccatctccagagacaacgaccaacaacacactataatactagacaanagaacacgcgagagacgacgacgacgacgcgtgtcttatacgttgtgtgagagaggtaagggagggtaaggtagtagacgtaagttggtcg

SEQ ID NO: 368094 - DNA, 324 bp, Homo sapiens
  misc_feature: GZ8MTXP01BQ5KG.13.10.A10.1.454.CMB.2.raw
  modified_base (320)..(324): a, c, t, g, unknown or other
tcagtcacgtactacacgaccggtgctcgatttagcgtcgatctcagggagagccctcacctccttatctatggtgcatccaccttacaaagtgggtcccatcaaggttcagtggcactggatctgggacagatttcactctcaccatcagcagtctgcaacctgaagattttgcaacttattactgtcaacagagtttcagtacgcggacgttcggccaagggaccaaggtggaaatcaaacgaactgtggctgcaccatctgtcttcatcttcccgcatctgaagtacgtgactgagcgggctggcaaggcgcatagnnnnn

SEQ ID NO: 368095 - DNA, 478 bp, Homo sapiens
  misc_feature: GZ8MTXP01EKTBD.13.10.A10.1.454.CMB.2.raw
  modified_base (375)..(375): a, c, t, g, unknown or other
  modified_base (391)..(391): a, c, t, g, unknown or other
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccacataacctgctctggatatttgttgagggatagatatgcttgttggtatcaacagaaggccggcagtcacctacattggttatctatgaagacacgaagcggccctcagggatccctgagcgattcctctggctccaactctgggaacacagccactctgaccatcagcgggaccngcctatggatgaggcngactattactggtcatacatggacaagatatgatgctgtcggcgaggacaaagtgacgcgttggcaagccaagctcgcccctggctc

SEQ ID NO: 368096 - DNA, 517 bp, Homo sapiens
  misc_feature: GZ8MTXP01D8G58.13.10.A10.1.454.CMB.2.raw
  modified_base (332)..(332): a, c, t, g, unknown or other
  modified_base (353)..(353): a, c, t, g, unknown or other
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccacataacctgctctgatattgttgagggatagatatgcttgttggtatcaaacagaaggccggcagtcacctacattggttatctatgaaagacaacgaagccggccctcaggggactccctgagcgatttccnctggctccaactctgggaacncagccactctgaccatcagcgggacccagcctatggatgaggctgactattactggtcatacataggacaagataagttgatggctggtcggcggagggaccaaagtgaacccgttcgttacggttcaacggaccccaagggcctcgccccctcggcctaaccg

SEQ ID NO: 368097 - DNA, 554 bp, Homo sapiens
  misc_feature: GZ8MTXP01DHGHQ.13.10.A10.1.454.CMB.2.raw
  modified_base (350)..(350): a, c, t, g, unknown or other
  modified_base (418)..(418): a, c, t, g, unknown or other
  modified_base (470)..(470): a, c, t, g, unknown or other
  modified_base (473)..(473): a, c, t, g, unknown or other
  modified_base (482)..(482): a, c, t, g, unknown or other
  modified_base (491)..(491): a, c, t, g, unknown or other
  modified_base (502)..(502): a, c, t, g, unknown or other
tcagtcacgtactacacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtactgggcacagaggactcaccatggagtttgggctgaggtggtttttccttggtgctattttaaaaggtgtccattgtgaagtgcccctggtacaatcgtgggggagcttggtcaaggccggggggagtcccctgagactctcctgtgaagcctcaaacattcacttttgctcgtgcctgggtnaccgtgggtcccgcaggctccgaggggaggggctggagtggattggccaatataaggacagacctaanggcgcgacagcacactaccttgaactccgacaaagcagatcatcatctgagngtnacttccganaacacggtntctctccaatnttgagcagccttaagaaacttcggaaggacaacgaggccttataacttcgtg

SEQ ID NO: 368098 - DNA, 327 bp, Homo sapiens
  misc_feature: GZ8MTXP01A597Z.13.10.A10.1.454.CMB.2.raw
  modified_base (323)..(327): a, c, t, g, unknown or other
tcagtcacgtactacacgaccggtgctcgatttagcgtcgatctcagggagagcccctcacctccttatctatggtgcatccaccttacaaagtggggtcccatcaaggttcagtggcactggatctgggacagatttcactctcaccatcagcagtctgcaacctgaagattttgcaacttattactgtcaacagagtttcagtacgcggacgttcggccaagggaccaaggtggaaatcaaacgaactgtggctgcaccatctgtcttcatcttcccgccatctgaagtacgtgactgagcgggctggcaaggcgcatagnnnnn

SEQ ID NO: 368099 - DNA, 497 bp, Homo sapiens
  misc_feature: GZ8MTXP01DOPT3.13.10.A10.1.454.CMB.2.raw
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctggatatttgttgagggatagatatgcttgttggtatcaacagaaggccggcagtcactacattggtatctatgaagacacgaagcggccctcgagggactccctgagcgattcctctggctccaactctagggaacacagcccactctgaccatcagccggaccagcctaatggatgagctgactattactggtacatacagtggaacagatatgtatggctgtcggcgagggacaaagtcgacgttcgttgcaagcccaaggctcgcccctcggttctaaccg

SEQ ID NO: 368100 - DNA, 536 bp, Homo sapiens
  misc_feature: GZ8MTXP01EH7XV.13.10.A10.1.454.CMB.2.raw
  modified_base (337)..(337): a, c, t, g, unknown or other
  modified_base (492)..(492): a, c, t, g, unknown or other
  modified_base (504)..(504): a, c, t, g, unknown or other
  modified_base (520)..(520): a, c, t, g, unknown or other
  modified_base (523)..(523): a, c, t, g, unknown or other
tcagtcacgtactacacgaccggtgctcgatttagcgtcgatctcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctggagactctcctgtgcagcctctggattcacctttagagctattggatgagctgggtccgcaggctccgaggggaaggggctgggagtgggtgccaanataaagcaagttggaagtgaagaaatactaatgtggactcgtagttaaggggccattcaccatctccagagacaacgaccaaagactcactgtatctgacaaatgaaaccagccctagacgagcccggaaggactacgggcctggtctattacgngttgacgagagnggttcggggaagagtntgngaggtcgctaacg

SEQ ID NO: 368101 - DNA, 717 bp, Homo sapiens
  misc_feature: GZ8MTXP01CEVMH.13.10.A10.1.454.CMB.2.raw
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctggatatttgtgagggatagatatgcttgttggtatcaacagaaggccggcagtcactacattggttatctatgaagacacgaagcggccctcgagggactccctgagcgatttcctctggctccaactctagggaacacacgcctactcgtacgaaccatacgacgccggggaaccccagggtaccctagtacgggtattacgggacggccgttaggtaacctttaacgtttaaaccgtttcggggttaacgtaaacttaaaccgtaaggttaacgggggaaaaccctaaaacgggtaactttaaaggtttacggggtaaagttgggggttaccgttgggggtttaacccggggacgggggaaacggggtaaaccccttaaaaccgggttaccggtaacccgggttacccgttaacggggttacccgaaccgggtacccccgaaacgggggtccccttaccccgggttacccccccggttccgggttaacccgttaacccccgg

SEQ ID NO: 368102 - DNA, 565 bp, Homo sapiens
  misc_feature: GZ8MTXP01CCI0Y.13.10.A10.1.454.CMB.2.raw
tcagtcacgtactacacgaccggtgctcgatttagcgtcgatctcagggtcttcgtggctcacgtccaccaccacgcatgtgacctcagggagtccctgagactctcctgtgaagcctcaacattcactttttgctcgtgcctgggtgacctgggtccgccaggctccgagggaagggctggagtggattggccatattaaggacagacctaatggcgcgacagcacactaccttgaatccgtacaaagcagattcatcatctcgagaggtgattccgacaacacggtgtctctccatatgagcagcctagaaaatcgaggacacaggcctatacttactgtgcagtgatgggccacgaccacgtacttttgggagtggtgcgctcgacccgtcggggccccgggaaccgtcggtccaccgtcctccgtcacgccctccgaccgacgggcccagtccggtcccttcccccgtggcccacccctcctacccgaacgcgccaccgttcgtcgggggccacgcgccggcccgttgggcctcgccgtggacacggtccttcgtttcccg

SEQ ID NO: 368103 - DNA, 331 bp, Homo sapiens
  misc_feature: GZ8MTXP01ALENB.13.10.A10.1.454.CMB.2.raw
  modified_base (325)..(331): a, c, t, g, unknown or other
tcagtcacgtactacacgaccggtgctcgatttagcgtcgatctcagggagagcccctcacctccttatctatggtgcatccaccttacaaagtgggtcccatcaaggttcagtggcactggatctgggacagatttcactctcaccatcagcagtctgcaacctgaagattttgcaacttattactgtcaacagagtttcagtacgcggacgttcggccaagggaccaaggtggaaatcaaacgaactgtggctgcaccatctgtcttcatcttcccgccatctgatagtacgtgactgaggcggctggacaaggcgcagtagnnnnnnn

SEQ ID NO: 368104 - DNA, 595 bp, Homo sapiens
  misc_feature: GZ8MTXP01DA7QK.13.10.A10.1.454.CMB.2.raw
tcagtcacgtactacacgaccggtgctcgatttagcgtcgatctcagggtcttcgtggctcacgtccaccaccacgcatgtgacctcagggagtccctgagactctcctgtgaagcctcaacattcacttttgctcgtgcctgggtgacctgggtccgccaggctccagggaagggctggagtggattggccatattaaggacagacctaatggcgcgacagcacactaccttgaaatccgtacaaagacagattcatcatctcgagaggtgattccgaacaacacggtgtctctccatatgagcagcctagaaaatcgaggacacgaggcctatacttactgtgcagtgatcgggccacgaccacgtactttgggagtggtgcgcgtcgacccgtcggggacccgggaacccgtcggtccaccggtcctccctcacgccctccgaacccgaacggggccccacgtcccggtcccttcccccgtcggccctaccccgtccctaccgaacgcgccacccgttcggtcgggggccaaccggcggccggcccgttggggcctggcccgtgggtacgaacgggtccttaacgtttcccg

SEQ ID NO: 368105 - DNA, 487 bp, Homo sapiens
  misc_feature: GZ8MTXP01EL5D4.13.10.A10.1.454.CMB.2.raw
  modified_base (350)..(350): a, c, t, g, unknown or other
  modified_base (432)..(432): a, c, t, g, unknown or other
  modified_base (456)..(456): a, c, t, g, unknown or other
  modified_base (478)..(478): a, c, t, g, unknown or other
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggccttactcagccacccgcaatgtccgtgtccccagggcagacagccaccataacctgctctggatatttgttgagggatagatatgcttgtggtatcaacagaaggccgcagtcacctacattggtatctatgaagacacgaagcggccctaagggactcccgtgagcgattctctcggctcaactctgggaaacacngccactctgaccatcagcggacccagcctatggatgaggctgactatactgtcatacatggacacgatatgatgctgtcggnggaaggacaatcgacgtctagcgngccaaggctcgcccctggttcncttcgtccg

SEQ ID NO: 368106 - DNA, 643 bp, Homo sapiens
  misc_feature: GZ8MTXP01CR2SO.13.10.A10.1.454.CMB.2.raw
tcagtcacgtactacacgaccggtgctcgatttagcgtcgatctcaggggaggagagacccctcccctgggatcctgcagctctagtctcccgtggtgggggcctcaggaagcagcatcggaggtgcctcagccatggcatggatccctctcttcctcggcgtccttgcttactgcacaggatccgtggcctcctatgagctgactcagcccacctcagtcgtcccgtgtccccaggacagacagccagcatcacctgctctaggaaataatggacagaataaatatacttctgtatcagcagacgtcaggcctacgtcccctgtcgctcggtcatctaatcaaaagctcgaccaaacgccggtccctacgacggggtactcccgtagacgtacgtacttcgtccgtcggccttacccgtaacgtcgtacgggtacctaccgacgccctaacgtcgtaacgacctacgtaccgaaccgggacccgggacccgtacgggcgttgggtacgggtaacgttcgggaacgggtccgttaggtaaacctttaagtttaaccggtcggttaccggttacggggttccggggttaagggaaccgtaacggaccgacgggttaccctaaccgttcccggtttaacccccgg

SEQ ID NO: 368107 - DNA, 502 bp, Homo sapiens
  misc_feature: GZ8MTXP01DURQK.13.10.A10.1.454.CMB.2.raw
  modified_base (252)..(252): a, c, t, g, unknown or other
  modified_base (488)..(488): a, c, t, g, unknown or other
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctgatatttgttgagggatagatatgcttgttggtatcaanagaaggccgcagtcacctacattggttatctatgaagacacgaagccggccctcgagggactcccgtgacgcgattcctctcggctccaactctagggaacacacgcccactctgaccatcagccggaccagcctagtcggatgaggctgactattactggtactatacagtaggacaagatattgatgctggtcgcggaggaccaaagtcgaccgttcgttggcaagcccaagcncgcccctgttctcc

SEQ ID NO: 368108 - DNA, 494 bp, Homo sapiens
  misc_feature: GZ8MTXP01AQRDK.13.10.A10.1.454.CMB.2.raw
  modified_base (269)..(269): a, c, t, g, unknown or other
  modified_base (302)..(302): a, c, t, g, unknown or other
  modified_base (326)..(326): a, c, t, g, unknown or other
  modified_base (359)..(359): a, c, t, g, unknown or other
  modified_base (402)..(402): a, c, t, g, unknown or other
  modified_base (410)..(410): a, c, t, g, unknown or other
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctggatatttgtgagggatagatatgcttgtggtatcaacagaaggcgcagtcactanattggtatctatgaagacacgaagccggccctnacgggactccctgagcgattcccnctggcctcaactcgtgggaaccacagccactcncgacatcagccgggaccagcctatggatgagctagactattcngtcatacngtaggaacacgtatagttggatggctggtcgcgggaggaccagcgtaccgcgttgcaagccaaggcctcgcccctcggttctcc

SEQ ID NO: 368109 - DNA, 325 bp, Homo sapiens
  misc_feature: GZ8MTXP01DS519.13.10.A10.1.454.CMB.2.raw
  modified_base (322)..(325): a, c, t, g, unknown or other
tcagtcacgtactacacgaccggtgctcgatttagcgtcgatctcagggagagcccctcacctccttatctatggtgcatccaccttacaaagtggggtcccatcaaggttcagtggcactggatctgggacagatttcactctcaccatcagcagtctgcaacctgaagattttgcaacttattactgtcaacagagtttcagtacgcggacgttcggccaagggaccaaggtggaaatcaaacgaactgtggctgcaccatctgtcttcatctcccgcatctgatagtacgtgactgagcgggctggcaaggcgcatagnnnn

SEQ ID NO: 368110 - DNA, 513 bp, Homo sapiens
  misc_feature: GZ8MTXP01CA51O.13.10.A10.1.454.CMB.2.raw
  modified_base (297)..(297): a, c, t, g, unknown or other
  modified_base (334)..(334): a, c, t, g, unknown or other
  modified_base (396)..(396): a, c, t, g, unknown or other
  modified_base (445)..(445): a, c, t, g, unknown or other
  modified_base (478)..(478): a, c, t, g, unknown or other
  modified_base (482)..(482): a, c, t, g, unknown or other
  modified_base (502)..(502): a, c, t, g, unknown or other
  modified_base (504)..(504): a, c, t, g, unknown or other
tcagtcacgtactacacgaccggtgctcgatttagcgtcgatctcagggggtctcagagaggagccttagccctggactccaaggcctttccacttggtgatcagcactgagcacagaggactcaccatggaattggggctgagcgtggttttcgtgtagctatttagaaggtgtcagtgtgaggtgcagctggtggagtcgtgggggagcttggtccagccgtggggggtccctgagactctcctgtgcagcctcgtggattcacctttagagctagttggatgagcgtgggtccncaggctcgagggggagggctggagtgggtgaccaaanataaagcaaggttggaaagtgaagaaactataatgtggactgtgtagagggccatcacatcncagagacaacgtcaaagactcaactgtatctaggacaatagaacagcgngagagacgagacgacgcgtgtcttatattgtgngagngagtgggaggaaggtagagngngttgtaacg

SEQ ID NO: 368111 - DNA, 575 bp, Homo sapiens
  misc_feature: GZ8MTXP01ETBXO.13.10.A10.1.454.CMB.2.raw
  modified_base (245)..(245): a, c, t, g, unknown or other
  modified_base (292)..(292): a, c, t, g, unknown or other
tcagtcacgtactacacgaccggtgctcgatttagcgtcgatctcagggtcttcgtggctcacgtccaccaccacgcatgtgacctcagggagtccctgagactctcctgtgaagcctcaacattcacttttgctcgtgcctgggtgacctgggtccgccaggctccgagggaaggggctggagtggattggccatattaaggacagacctaatggcgcgacagcacactaccttgaatccgtanaaagacagattcatcatctcgagaggtgattccgaacaacgacggtntctctccatatgagcagcctagaaaatcgagacacgagctatacttactgtgcagtagagtcgggaccacgacctagtacttttgggagtggtgcgcgtccgacccgtcggggaccccggtaaccgtcggtccaccgtcctcctcgacgccctaccgacgaacgggcccacgtccgtccctccccgtcggccacccctcctaccaacgcgccaccgttcggtcggggcacgcggcccggcccgcgggcctcggccgtgggtcaacgggtccttaaccgttccg

SEQ ID NO: 368112 - DNA, 545 bp, Homo sapiens
  misc_feature: GZ8MTXP01B6619.13.10.A10.1.454.CMB.2.raw
  modified_base (346)..(346): a, c, t, g, unknown or other
  modified_base (357)..(357): a, c, t, g, unknown or other
  modified_base (441)..(441): a, c, t, g, unknown or other
  modified_base (469)..(469): a, c, t, g, unknown or other
  modified_base (486)..(486): a, c, t, g, unknown or other
  modified_base (499)..(499): a, c, t, g, unknown or other
  modified_base (502)..(502): a, c, t, g, unknown or other
tcagtcacgtactacacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtactgggcacagaggactcaccatggagtttgggctgaggtggtttttccttggtgctattttaaaaggtgtccattgtgaagtgcccctggtacaatctgggggagcttggtcaaggccggggggatccctgagactctcctgtgaagcctcaacattcacttttgctcgtgcctgggtncctgggtcccncgaggctcgaggggagggctggagtggatggcaatataaggcagacctagtggcgcgacagcacactaccttgaactcccgtanaaagcagtattcatcatctcgagaggtnattccgacaacgcggtntcctctccaatangancagccttagaaacttcggaagacaacgacggcttatcttcgtg

SEQ ID NO: 368113 - DNA, 565 bp, Homo sapiens
  misc_feature: GZ8MTXP01BUFBD.13.10.A10.1.454.CMB.2.raw
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccacataacctgctctggatattgtgagggatagatatgcttgtggtatcaacagaaggccggcagtcacctacattgttatctatgaagacacgaagccggccctcgagggactcccgtgagcgattccctctggctccaactcgtagggaacacacgcccactctacgaccatacgacgaccgggacccagcctagtggatgaggctagactattactggtacatacagtagggactaacgattaagtggtagtggtcgtgggttcggggacgggttaaggggaaacccttaaagtcggtaaccccgttcgttacggttccaacggcccaaaggtccgtccgttcccccgtcgggttccgtaacccg

SEQ ID NO: 368114 - DNA, 588 bp, Homo sapiens
  misc_feature: GZ8MTXP01B28GQ.13.10.A10.1.454.CMB.2.raw
  modified_base (332)..(332): a, c, t, g, unknown or other
  modified_base (355)..(355): a, c, t, g, unknown or other
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctggatatttgtgagggatagatatgtcttgttggtatcaacagaacggccggcagtcacctacattggttatctatagaagacacgaagccgccctgagggactccctgagcgtattccnctggcctccaactctagggaacncacgccactctacgaccatccacgaccgggaccacggcctagtcggatggaggctagtactattacgtggtcgtagggtcggtacggggacacgcgaacgccgtaacgtccgcccgtacttaacgtcggttaccgttacgggaaacgttcgggaaacccgtaacggttcccgttaccgttaccgttaaagcccgaaccgaccccgaacggacccccaaacccttcgtaacccg

SEQ ID NO: 368115 - DNA, 828 bp, Homo sapiens
  misc_feature: GZ8MTXP01CIZO0.13.10.A10.1.454.CMB.2.raw
tcagtcacgtactacacgaccggtgctcgatttagcgtcgatctcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcagcgtggtggagtcgtgggggagcttggtccagccggtgggggtccctgagactctcctgtgcacgcctctggtattcctacctttagagctagttggaatggagcgtcgggtcccgcgagggcctaccggagggggaacgggggtcgtggggagggttcgggggtcggaccgaaacaagtaaaaggctaaagggtttacgggaaaggttaggaaagtaaaacttacgtaaagtcggtggaacttcggtagggtagggaaacgggggccctattacccgaaccctagttacccgaccaaaggaacgaaacccgaaaaccggaccccaaaaaacggtaacccttaccaaccgttaggttactacccgttaaggggaaacccttaaaaggttacgaaaaccgacggttaccccgtaggggaaacggaaccggaccccgggtaaaggggtaaccccgaccgggggttactttaacggggtttacccttttaaaagggtttacccgttggggttaacccgggacgggttaaacgggggaagggttacgggggttttaagggggggggggaaaacccggtttaaaacgggggttaacggttaagggacccggttaaggggttcccgggggttaaaccccg

SEQ ID NO: 368116 - DNA, 608 bp, Homo sapiens
  misc_feature: GZ8MTXP01BDD02.13.10.A10.1.454.CMB.2.raw
tcagtcacgtactacacgaccggtgctcgatttagcgtcgatctcagggtcttcgtggctcacgtccaccaccacgcatgtgacctcagggagtccctgagactctcctgtgaagcctcaacattcacttttgctcgtgcctgggtgacctgggtccgccaggctccgagggaaggggctggagtggattggccatattaaggacagacctaatggcgcgacagcacactaccttgaatccgtacaaagacagattcatcatctcgagaggtgattccgacaacacggtgtctctccatatgagcagcctagaaatcgaggacacaggctatacttactgtgcagtagagtgggccacgaccacgtacttttgggagtggtgcgcgtccgacccgtggggcccgacggggaccctggtccaccgtctccgtcacgccctcccaccgaaccgggccctacgtcccggtcccttcccccgtcggcccctaccccgtccctcccgaaacggcgcccgacccgtccggttcgggggaccaccggaccgggcccgggccccgtcgggggccctcggtcccgtcgggttaccgtaacgggttccctttaacccg

SEQ ID NO: 368117 - DNA, 534 bp, Homo sapiens
  misc_feature: GZ8MTXP01DZ769.13.10.A10.1.454.CMB.2.raw
  modified_base (255)..(255): a, c, t, g, unknown or other
  modified_base (328)..(328): a, c, t, g, unknown or other
  modified_base (470)..(470): a, c, t, g, unknown or other
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctctaatggcctgactcagccacccgcaatgtccgtgtccccagggcagacagccaccataacctgctctggattatttgtgagggatagatatgtcttgttggtatcaacngaaggccggcagtcactacattggtatctatgaagacacgaagcggccctgagggactccctgagcgattccnctggctccaactcgtagggaaccacacggacccactctacggacccatccgacggaccgggacccaggccctaagtcgggaatggacggctagacttattacctggtacataccagtaggacagatatgatggctggtcggnggttacgggacaaacgtcgaccgttcgttgaccaagccaagggctcgcccctggttcctaaccg

SEQ ID NO: 368118 - DNA, 818 bp, Homo sapiens
  misc_feature: GZ8MTXP01D6JCN.13.10.A10.1.454.CMB.2.raw
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctggattattgttgagggatagatatgtcttgttggtatcaaacaggaaggccggccagtccacctactatttggttaatctaatgaaagacaacgaacggccggacccctcgaaggggtactccccgtaggacgcgtactttcccgtcgtcggaccctaccctaaccgttccgtacggggaaccacgaaccgccctaaccgtcctacggaaccctaacgtcccgaacgggcccggggaaccccacggtccccgttaaaggttaccgggaaagttcgggaacgggggtccttaacgggtaacctttaaacgttttaacccgttaggggttaacccgttaaatttaaaccccgtaaagggtttacgggggaaaaccctaaaccggttaaagtttaaacggtttaggggtaaacgtttgggggtaccgtttacgggggtttaacccgggggaacgggggttaaaccgggggtaaacccttaaaacccggtacgggttaacccccggttaccccggttaaggggttaccccgaaaccgggtacccccgttaaaccgggccccggttaccccgggttccccccggtttcccggggttaaccccttcccccg

SEQ ID NO: 368119 - DNA, 619 bp, Homo sapiens
  misc_feature: GZ8MTXP01DZKOS.13.10.A10.1.454.CMB.2.raw
  modified_base (215)..(215): a, c, t, g, unknown or other
  modified_base (223)..(223): a, c, t, g, unknown or other
  modified_base (244)..(244): a, c, t, g, unknown or other
tcagtcacgtactacacgaccggtgctcgatttagcgtcgatctcagggtcttcgtggctcacgtccaccaccacgcatgtgacctcagggagtccctgagactctcctgtgaagcctcaacattcacttttgctcgtgcctgggtgacctgggtccgccaggctccgaggggaaggggctggagtggattggccatattaaggacagacctaanggcgcganagcacactactgaatccgtanaaagcagattcatcatctcgagaggtgacttccgaacaacgacggtgtcctctccatatgagcaagcctaagaaaatcgaggacacaggcctatacttacgtgtgcagtgagtcggggaccaacgacctacgtacgttttgggacgtggtcgcgctccggacccgtcggggacccggaacccgtggtcctaccgtcctcctacgacgtcccctacccgaaccgaacgggccccaacgtcccggtccccttcccccgtcggcccctacccctccctacccgaacgcgcctacccgttcggtacgggggccaccgacggcccggcccgttcggggcctcgccgtcggtaccgaacggtaaccttaacgtttaacccg

SEQ ID NO: 368120 - DNA, 704 bp, Homo sapiens
  misc_feature: GZ8MTXP01CPNUU.13.10.A10.1.454.CMB.2.raw
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctctaatggcctgactcagccacccgcaatgtccgtgtccccagggcagacagccacataacctgctctggattatttgtgagggatagatatgtcttgttggtatacaacaggaaggccggccagtaccacctacattggttatctatgaagacacgaacgccggccctacgagggactcccgtgacgcgtatttcccctcgtacggcctacccaaactccgtagggaaccacgacgacccacctctacgaccagtaccgacggcccgggaaccccaggtccctaggtacggagtggacgggtctacggtaacttactttaccgttaggggtaccctaagtaaccgagttaacggggaaactaaacggtatttaacggtagggtaacgttacggggtcgtttcggggttaacccggggaacggggaaacggggtaaaccccttaaaacggttacccggtaacccggtttacccgttaacggggttacccgaaccgggaacccccgtaacgggtccccgttaccccggttcccccccggttaacggttccctttaaccccg

SEQ ID NO: 368121 - DNA, 709 bp, Homo sapiens
  misc_feature: GZ8MTXP01EJJVL.13.10.A10.1.454.CMB.2.raw
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatcgtccgtcgtccccgagggcagacagccaccataacctgctctggattattgttgaggatagatatgtcttgttggtatcaaacaggaacggccggcagtccacctacatttggttatctatgaagacaacgaacgccggccctcgagggtactcccgtagacgtcgtactttcccgcgtacggtcctaccaacgtacgtacgggaacacgacgaccctactccgtacgacctacgacgacgggacccgggaacccagtacccttaaggtacgggtacgttagggacgggtacttacggtaactttaacgttacccttaggggttaactaaacggttaaaccgtaagggttaacgggaaaccctaaaggttatttaaagggtttgggtaagttcgggtccggttgggttaaccggggaacggggaaacgggtaaacccttaaacggtccgtaaacccggttccgttacggttacccgaaccggaccccggtaacggccccgttacccggacccccgttcgggttcccttcccccgg

SEQ ID NO: 368122 - DNA, 574 bp, Homo sapiens
  misc_feature: GZ8MTXP01B00GL.13.10.A10.1.454.CMB.2.raw
  modified_base (290)..(290): a, c, t, g, unknown or other
  modified_base (481)..(481): a, c, t, g, unknown or other
  modified_base (520)..(520): a, c, t, g, unknown or other
tcagtcacgtactacacgaccggtgctcgatttagcgtcgatctcagggtcttcgtggctcacgtccaccaccacgcatgtgacctcagggagtccctgagactctcctgtgaagcctcaacattcacttttgctcgtgcctgggtgacctgggtccgccaggctccgagggaaggggctggagtggattggccatataaggacagacctaatggcgcgacagcacactaccttgaactccgtacaaagcagattcatcatctcgagaggtgacttccgacaacacggtntctctcatatgagcagcctagaaatcgagacacgaggctatacttactgtgcagtgagtcgggaccacgacctacgtacgtttgggagtggtgcgcgtccgcccggtcggggcccggaaccgtggtacctaccgtctcctcgacgccctaccgaccgaacgggcccacgtccggtcccttccccgcgcccnccctcctaccaacgcgccaccgttcggtcggggcaccgnggcccggcccgcggggcctcggccgtcgggtaccgacggtcccttcgttaaccg

SEQ ID NO: 368123 - DNA, 580 bp, Homo sapiens
  misc_feature: GZ8MTXP01EYZ8Z.13.10.A10.1.454.CMB.2.raw
  modified_base (416)..(416): a, c, t, g, unknown or other
  modified_base (444)..(444): a, c, t, g, unknown or other
  modified_base (575)..(575): a, c, t, g, unknown or other
tcagtcacgtactacacgaccggtgctcgatttagcgtcgatctcagggggtccgggagctctgggagaggagacccagccttttgattcccaagtgttgtcattcagtgatcaggactgggcacagaggactcaccatggagtttgggctgaggttggtttttcctggtgctattttaaaaggtgtccattgtgaagtgcccctggtacaatcgtgggggagcttggtcaaggccgggggatccctgagactctcctgtgaagcctcaactattctacttttgctcgtgcctggggtcgaccgtgggtcccgccgaggcctccgagggggaaggggctgggagtggattgggcctaatagttaagggacagacctaagtcggccgcgacagcacaacttaccttgaaactccganaaagacagattcatcatctgagaggtanacttaccgacaacgacgtgtactctaccattatgacgcacgacctagaaaagtcggaaggaccacgacggccttaattattacttgtcgcaggttgagtcgggcctaacgacctacggttacgttttgggngtggg

SEQ ID NO: 368124 - DNA, 669 bp, Homo sapiens
  misc_feature: GZ8MTXP01BMFW1.13.10.A10.1.454.CMB.2.raw
  modified_base (349)..(349): a, c, t, g, unknown or other
tcagtcacgtactacacgaccggtgctcgatttagcgtcgatctcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctcctgtgcagcctctggattcacctttagagctattggatggagcgtgggtccgccgaggcctccgaagggggaaggggcgtggggaggtgggggtggaccaaanaagtaaagctaaggttaggaaaggtagaagaaaatactaaagtgtggactcgtggtaggaacggggccgtaattccgacctagtccctaccgaaggacgaaccgaaaccggacccaaaacggtaacctacctaacctaggttaacttccgtaacgggaactaaaagttacgaaaaccgtagaccctagggaacggacggacccggaaggggacccacgggtcgttaacggttcttaagtttaccgttggtacggaggttaggaggttagggttggggggaccgggtaaggttacgtacggagtaagggttcggtaacccg

SEQ ID NO: 368125 - DNA, 528 bp, Homo sapiens
  misc_feature: GZ8MTXP01B07N2.13.10.A10.1.454.CMB.2.raw
  modified_base (397)..(397): a, c, t, g, unknown or other
  modified_base (429)..(429): a, c, t, g, unknown or other
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccaccgcaatgtccgtgtccccagggcagacagccaccataacctgctctggaaataaattggcagataaatatacttcctgtatcagcagaagtcaggccagtcccctgtcgctggtcatctatcaagatgaccaagccgccctcgaggctccctgagccgattctctggctccaactcgtgggaacctcacgcctactctacgacccatccgaggccgggacccagaccctangggactgagctagactagttactgtacactanagtggaacaacgattagtggatgggctggttcgggacggaggaacctaaacgttcggaccgttcgtaacggcaacgcccgaggcctccgcccccgtcgg

SEQ ID NO: 368126 - DNA, 586 bp, Homo sapiens
  misc_feature: GZ8MTXP01DUF9R.13.10.A10.1.454.CMB.2.raw
  modified_base (340)..(340): a, c, t, g, unknown or other
  modified_base (470)..(470): a, c, t, g, unknown or other
  modified_base (533)..(533): a, c, t, g, unknown or other
tcagtcacgtactacacgaccggtgctcgatttagcgtcgatctcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtgggggagcttggtccagccgtggggggtccctgagactctccgtgtgcacgcctctggattcacctttagagctagttggatgagcgtggtccgcaggctccgaggggaagggctggagtgggtggaccaanagtaaagcgaagttggaagtgaagaaatactaatggtggactcgtgtaggaacgggcctagttccacctagtcctaccgaagacgaacaaaccgcaaagactcactgtatccgtggaacaaagtgaaacngcctgagaacgcccggaaggaccacggctaaggttccttagttaccgttggtagcggttaagnggaggtttggggggaacgaagggtttagaggaccgtaagggttgggtaacccg

SEQ ID NO: 368127 - DNA, 576 bp, Homo sapiens
  misc_feature: GZ8MTXP01ATTP6.13.10.A10.1.454.CMB.2.raw
  modified_base (232)..(232): a, c, t, g, unknown or other
  modified_base (459)..(459): a, c, t, g, unknown or other
  modified_base (513)..(513): a, c, t, g, unknown or other
  modified_base (518)..(518): a, c, t, g, unknown or other
tcagtcacgtactacacgaccggtgctcgatttagcgtcgatctcagggtcttcgtggctcacgtccaccaccacgcatgtgacctcagggggtcctggagatcatgaggggtgtccttgggttttggggggaagaggaagactgacggtccccccaggagttcaggtactgggcacagaggactcaccatggagtttgggctgaggtggttttctggtgctatttaaaggngtcattgtgaagtgcccctggtacaatcgtgggggagcttgggtcaaggccggggggagtccctgacgactctcctgtgaagcctcaacattcacttttgctcgtgccgtgggtcgaccgtggggtcccgccgaggctccgaggggaggggcctggggagtggattcggaacagtaagttaaggacagacctaagcgggcgcgacagcacactactgaactccgtanaaagacagattacatcgaatcgtacgagtagtgacttccgaacacgtacgggtntcctntccattatggagcgacgcgttaagaaacgtcggacgaacacgacgttactaagttgtg

SEQ ID NO: 368128 - DNA, 578 bp, Homo sapiens
  misc_feature: GZ8MTXP01ET237.13.10.A10.1.454.CMB.2.raw
  modified_base (306)..(306): a, c, t, g, unknown or other
  modified_base (373)..(373): a, c, t, g, unknown or other
  modified_base (444)..(444): a, c, t, g, unknown or other
  modified_base (466)..(466): a, c, t, g, unknown or other
  modified_base (511)..(511): a, c, t, g, unknown or other
  modified_base (546)..(546): a, c, t, g, unknown or other
tcagtcacgtactacacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtactgggcacagaggactcaccatggagtttgggctgaggtggtttttccttggtgctattttaaaaggtgtccattgtgaagtgcccctggtacaatcgtgggggagcttggtcaaggccggggggatccctgagactcncctgtgaagcctcaaacattcactttttgccttcgtgccctgggggtcgacccgttgggggtccccnccaggcctccgagggggaaggggctgggagtggattggccaatattaaggcaagacctaatgggcgcgacngcacactaccttgaactccganaaagacagattcatcatctcgagaggtgattccgacaacacggtntctcctccaattagttgacgcagccttagaaaacncggaaggacaacgaggccttataacgttctgg

SEQ ID NO: 368129 - DNA, 645 bp, Homo sapiens
  misc_feature: GZ8MTXP01D1GP3.13.10.A10.1.454.CMB.2.raw
  modified_base (260)..(260): a, c, t, g, unknown or other
  modified_base (349)..(349): a, c, t, g, unknown or other
  modified_base (467)..(467): a, c, t, g, unknown or other
tcagtcacgtactacacgaccggtgctcgatttagcgtcgatctcagggggtctcagagaggagccttagccctggactccaaggcctttccacttggtgatcagcactgagcacagaggactcaccatggaattgggctgagcttgggttttccttgttgcttattttagaaggtgtccagtgtgaggtgcagcgtggtggagtcgtgggggagcttggtccaggccgtgggggtccctgagctctcctgtgcagcctntggtattcacctttagagcttagttggatggagtcgtgggtcccgcaggctccggaggggaagggctgggaggtgggggtcgaccaaanaagtaaagcgtaaaggttagggaagttagaaagtaaactacgtaagttggtggacttgtggtaggaacggggcctattccacctagtcctacaagacgaaacaaccgacaaagtaccncactgtaactcgttacggaactaaagtacgaaacgacgtaccgtaggaacggaccggaccggtaaggaaccgtaccgggtcttaagttccttagtttaaaccgttgggttacgaccggttaagggttggttaaagggttcgggggaagtaaggttcaggccgtaaggttcggtaaccg

SEQ ID NO: 368130 - DNA, 649 bp, Homo sapiens
  misc_feature: GZ8MTXP01BOZ1A.13.10.A10.1.454.CMB.2.raw
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctggattatttgttgaggatagatatgtcttgttggtatcaacagaaggccgcagtcacctacattggttatctatgaagacacggaagccggccctcgagggactcccgtgagcgattcctctcggcctccaactcgtagggaacactacgcccacgtctagacccatcgacgcgggaccagcctagcggatgacggctagtattattacgtggttacacgttacagttcgggaaacaaagtataagttgggtaagtgggtcgttgggttaaccggggcggggttaaacgggtaaaccccttaaaacgggttccggtaaaccccgggttcccggtttaacgggttaccggtaaacccgggaccccgtaaaccgggggttccccgttaccccggggttaccccccccggtttccgggttaaccccgtttaacccccgg

SEQ ID NO: 368131 - DNA, 580 bp, Homo sapiens
  misc_feature: GZ8MTXP01BFGEN.13.10.A10.1.454.CMB.2.raw
  modified_base (254)..(254): a, c, t, g, unknown or other
  modified_base (277)..(277): a, c, t, g, unknown or other
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctggatatttgttgagggatagatatgtcttgttggtatcaanagaaggccggccagtcacctacnttggttatctatgaagacacgaagccggcctgagggctccctgacgcgattcctctaggcctaccaacgtcgtagggaaccacgaacgccactctacgaccatccgaacggccgggaacccagcctagtacggagtcggaggctagtaccttaattactcggtacaagtaccgagtacgggacctaaagtatagttgagtggtcgtgggttcggcgggttaacggaaccgaaacgtcggtaacccgttccgttaggacaaccggacccaacggccgtccgcccccgtaacggttcctaacccg

SEQ ID NO: 368132 - DNA, 684 bp, Homo sapiens
  misc_feature: GZ8MTXP01EC7ND.13.10.A10.1.454.CMB.2.raw
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcacgccacccgcaatgtcccgtcgtccccagggcagacagccaccataacctgctctggattatttgtgagggatagatatgtcttgttggtatcaaacgaggaacggccgcagtcactactagttgttatctatgaagacacgaagcgccctgaggactccgtgagcgtattccgtctcggcctcccaactccgtacgggaacacacgtacccaacttcgtacgaccgatccgacggccggaccaggcccttaagtacgggagttcggacggtctacgtaacttatttaccgtagggttactaagttaacgtaacggttacggggaaacctaaacgggtaatttaacggttgggtaagtcgggttacggttcggggttaaccgggggacgggttaaccggggtaaaccgttaaaaccggtccggtaaaccccggtttacccggttacgggttacccgtaaccgggtaccccggaagggtccccgtcccgttcccccggtttaaccggttcccgtttaaccccgg

SEQ ID NO: 368133 - DNA, 721 bp, Homo sapiens
  misc_feature: GZ8MTXP01APOBC.13.10.A10.1.454.CMB.2.raw
tcagtcacgtactacacgaccggtgctcgatttagcgtcgatctcagggggtctcagagaggagccttagccctggactccaaggcctttccacttggtgatcagcactgagcacagaggactcaccatggaattggggctgagctgggttttccttgttgcttattttagaaggtgtccagtgtgaggtgcagctggtggagtcgtgggggaggcgttggtccaggccgtggggggtccctggacgactctcctgtcgcacgcctcgtggtacttctacctttagagtctagttggatggagcgtcgggtcccgccgaggccgtccggagggggaacgggggcgtggggaggtggggtcggaccaaacgaagtaaagacgtaaaggttacgggaaaggtagaaagtaaaacgtacgttaaagttgggtaacgggtacttcggtagggtacgggaacggggtacccgtaacttacccgaacccttatcccgtaaccgaagaaccgaaccgaaacccgacctaaaaggaacccttacaacgttgtaacttcctaaggggaacctaaaagtacggaaacccaggcccgtagggaacggaaccgggaccccggaagggaccctaaccgggtcttaacggttaccttagttaccgttgggtagacggttaggaggttagggttggggggaacgtaaggtagacgggcgtaaggttcggtaacccg

SEQ ID NO: 368134 - DNA, 641 bp, Homo sapiens
  misc_feature: GZ8MTXP01AC7CL.13.10.A10.1.454.CMB.2.raw
  modified_base (170)..(170): a, c, t, g, unknown or other
  modified_base (287)..(287): a, c, t, g, unknown or other
  modified_base (361)..(361): a, c, t, g, unknown or other
  modified_base (394)..(394): a, c, t, g, unknown or other
tcagtcacgtactacacgaccggtgctcgatttagcgtcgatctcaggggctgggcctcgggaagcagcatcggaggtgcctcagccatggcatggatccctctcttcctcggcgtccttgcttactgcacaggatcggtggcctcgaatggcctgactcagccacccgnaatgtccgtgtccccaggcagacacgccaccataacctgctctggtatatttgtgaggatagatatgtcttgttggtatcaacagaaggcgcagtcactacattggtatctatgaancacgaagcggccctgagggactcccgtgacgcgtattcctctcggctacccgtaaactcgtaacggggaaaccnccggacgacccctaacttctacggaaccctacnccgaacgggcccgggaacccacgggaccctaagtgggaagtaggaacggtcgtacaaccgtttaatacgttcggtaacctataaaccgtagtaaacgggaacctaaaggtattaaggttggtaagtcggtacgttcgggtcgggaacggtaacgggaaccctaaacggttacgtacccggttcgaacgggttccacggaacccgaacggtccctaccgggtccccttcggtaaccgttcttccccgg

SEQ ID NO: 368135 - DNA, 633 bp, Homo sapiens
  misc_feature: GZ8MTXP01C4FSA.13.10.A10.1.454.CMB.2.raw
  modified_base (380)..(380): a, c, t, g, unknown or other
  modified_base (586)..(586): a, c, t, g, unknown or other
tcagtcacgtactacacgaccggtgctcgatttagcgtcgatctcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcagctggtggaggtcgtggggggaggcttgggtccaggcccggtgggggggtcccctggacgtacctctccctggtgcacgtccctcgtggtacttcctacctttagagtcttagttggatggagtcgtgggtcccgccgaggccgtccggagggggaaggggctggggaggtggggtcggaccaaanagtaaaggctaaaggttggaagtagaagtaaatactaaagtgtggactgtaggtaggaacgggtcctattccacctatccgtaccagaacgaaccaaacgaccaaagtaactcacttgtaacttcaggaactaaatacgaaacgacgccgtaggagaacggccggagaccgacgggtctggtacttattacttggtacgacgaggngttaggggttgggggaggtaaggtagaggcgtaagttcgggtaaccg

SEQ ID NO: 368136 - DNA, 776 bp, Homo sapiens
  misc_feature: GZ8MTXP01CRJXO.13.10.A10.1.454.CMB.2.raw
tcagtcacgtactacacgaccggtgctcgatttagcgtcgatctcagggggtctcagagaggagccttagccctggactccaaggcctttccacttggtgatcagcactgagcacagaggactcaccatggaattggggctgagctgggttttccttgttgctattttagaaggtgtccagtgtgaagtgcagctggtggagtcgtgggggagcttggtacagccgtgcgaccgtccgagacgtctcctcgtgtcgacgcgtcctcggtgtacttacctacgttagtatagttattcgtcgtacctagtcgtaccgtacggggtccgggtccgacgacgtaccgtacggggaacgggggacgggtcggagggtcggtcggtcgtacggttaggtttacggtttagggtagtagttaggttagtaacgtacgtaaggtagtacgtaggtcgggtcgtacgttcggtgggtaacgggaccgggtccttattaccccgaacttcgtaccccgtacgggaacggaaacccgaaccgtaaaccccgaaaccggtaaacctacccccttacggttacggttaacttaccgaaacgaaacgttaaagacccgaagtaccccgtacggtaagaacggtacgttacgggaacggggtacccgaccggttacccgtttaggtttagtttaagtttacgttgggaaaccctaaaagaaaaccccgttaaccctttaaaacccccccgtttaggttacggtttttaacgggtttaaggttaaaccggg

SEQ ID NO: 368137 - DNA, 720 bp, Homo sapiens
  misc_feature: GZ8MTXP01ETB4R.13.10.A10.1.454.CMB.2.raw
tcagtcacgtactacacgaccggtgctcgatttagcgtcgatctcagggtcttcgtggctcacgtccaccaccacgcatgtgacctcaggggtccgggagatcatgagggtgtccttggggttttggggggaagaggaagactgacggtccccccaggagttcaggtactgggcacagaggactcaccatgggagtttgggctggtaggttggtttttccttgggtgtcttaagttttaaaaggtgtccattgtgaagtcgcccctggtacaatcgtgggggagtcttggtcaaggccgggggatccctgagactctcctgtgaacgtcctacaaactatttcctactttttgccttcgtcggcccgttgggggtcgacccgtgggggtccccgaccgtagggcctccggaagggggaacgggggcctggggacggttgggaagtttcggggaccctaaagttaagttaacggggactaaaggtacccgtaaagtcgggacggacgacagacaacactaccttagaactaccgtaacaaagaccaagtacttacaatcaagttctacgggaagtagggttacgacgtttacccggaacaaaccgttacgggtctacccttccgtccaattagttcgaacgccgaacgtaacccgttaaggaaaaacttcgggaaaggaaccaacgtacgggtaaccttaagttaacctttaacgtaaggg

SEQ ID NO: 368138 - DNA, 571 bp, Homo sapiens
  misc_feature: GZ8MTXP01A1ZKB.13.10.A10.1.454.CMB.2.raw
  modified_base (190)..(190): a, c, t, g, unknown or other
  modified_base (368)..(368): a, c, t, g, unknown or other
  modified_base (370)..(370): a, c, t, g, unknown or other
  modified_base (462)..(462): a, c, t, g, unknown or other
  modified_base (467)..(467): a, c, t, g, unknown or other
  modified_base (478)..(478): a, c, t, g, unknown or other
tcagtcacgtactacacgaccggtgctcgatttagcgtcgatctcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggagatgtattgactaacgagtatggttcctggtatcgagcagaggcaggccagccccctgtcctactcattacctttacaaaactcccgaggccggtcccctcgtcgggggtcccctgacgcgtacttcgccccggctccgctcgtcggaaacncngtccactctgacctagcgacggccggaccaggtcctagttagagtggacggtctgtctcttcgtgtccgagggggcgtaggggacaacgagngtcgngtcggtcgggngggaacgggcctaggtctggttccgtcgttacgcgaacgccgttagcccgttccgccccgtcggtcctcgttcccttcgttcccctaaccccg

SEQ ID NO: 368139 - DNA, 706 bp, Homo sapiens
  misc_feature: GZ8MTXP01DMVIG.13.10.A10.1.454.CMB.2.raw
tcagtcacgtactacacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtactgggcacagaggactcaccatggagtttgggctggaggttggtttttcctggtgtcttaattttaaaaggtgtccattgtgaagtcgcccctggtacaatcgtgggggagtcttggtacgaagggccgggggatccctggagtacctctcctgtgaagtccctacaaactattctacttttgcttcgtcgtccgtgggtcgaccgtgggtcccgccgagggcctaccggaagggggaacgggggctacggggaggtgggtagtttcgggacctaaataagttaagggactaagtaaaccctaagtcgggcggacgaacacgactaaccaactaccgttagaaacgttacccggtaaacaaacgtaaccaagtacttacaattaccaagttcccgtacgggtaaaggtaggttacgtaacgttaccccgaagtaaaccggtcgggttacttcctcctaccgtaatacgttgacgttcgaacggtccttaagaaaacgttcggaaggaacaacgacggtaccttatttaacgttcgtaag

SEQ ID NO: 368140 - DNA, 571 bp, Homo sapiens
  misc_feature: GZ8MTXP01BLXBC.13.10.A10.1.454.CMB.2.raw
  modified_base (280)..(280): a, c, t, g, unknown or other
  modified_base (305)..(305): a, c, t, g, unknown or other
  modified_base (503)..(503): a, c, t, g, unknown or other
  modified_base (515)..(515): a, c, t, g, unknown or other
  modified_base (517)..(517): a, c, t, g, unknown or other
tcagtcacgtactacacgaccggtgctcgatttagcgtcgatctcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtgggggagtcttggtccagccgtgggggtccctgagactctctgtgcagcctctggtacttctactttagagntattggatggagtcgtagggtcccncgaggcctcgaggggagggctgggaggtgggtgaccaaagtagtaaagcgtaaagttggaagtagaagtaaatactaagtgtggactcgtaggtaacggcctaattcacatcaccgagacgacctaacgcctaaagaactcgatgtaatctaggactaaaagtcgaacaggtccaggagcgaccggagtaccacggtntgtaactattgngngaggtaggaggttgggttcggggaagtagtaagcgagttagggtcgaactaacg

SEQ ID NO: 368141 - DNA, 643 bp, Homo sapiens
  misc_feature: GZ8MTXP01ARUHQ.13.10.A10.1.454.CMB.2.raw
  modified_base (367)..(367): a, c, t, g, unknown or other
  modified_base (552)..(552): a, c, t, g, unknown or other
  modified_base (577)..(577): a, c, t, g, unknown or other
tcagtcacgtactacacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtactgggcacagaggactcaccatggagtttgggctgaggttggttttccttggtgcttatttaaaaggtgtccattgtgaagtgcccctggtacaatcgtgggggagcttggtcaaggccgggggagtccctggagactctcctgtgaacgcctcaaactattcacttttgctcgtgcctgggtcgacccgtggggtcccncgaggcctaccgaggggaggggctgggaggtggattcgggacctaaagttaagttaagggacaacggtaaccctaaagtcgggcgacgaacagacaaccgtaactaccttagaactcccggtaacaaacgacagtattcatccatctacggaagaggtgacttcccgaacaaaccgtacgggttntacctcctcctaatacgttggaacncgaacgtccttaagaaaacgttcggaaaggacaacgtacggacccttaagttaatttccgtaaggg

SEQ ID NO: 368142 - DNA, 577 bp, Homo sapiens
  misc_feature: GZ8MTXP01AM2KT.13.10.A10.1.454.CMB.2.raw
  modified_base (169)..(169): a, c, t, g, unknown or other
  modified_base (509)..(509): a, c, t, g, unknown or other
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagctgactcagccacctnagtgtccgtgtccccaggacagacagccagcatcacctgctctaggaaataattggacagataaatatacttcctggtatcagacagaagtcaggcctacgtcccctgtcgctggtcagtctatacaagatcgaccaaggccggtaccctagacggggactcccccgtaggacgccgtattccgtcgtcggtccctaccaaacgtcgtacgggaacctcgacgtacccacttcgacgacctacgccgacgggacccgggacctagggactagtagggatggacgtcgtagtacttataccgtgcgagggcggtagggcagcgagccaacgtcggcccgtnttacgtcggtacgttacggacgttcgggaacctaaggtccaccgtcgttaacgtccaacggaaccccg

SEQ ID NO: 368143 - DNA, 600 bp, Homo sapiens
  misc_feature: GZ8MTXP01B43UG.13.10.A10.1.454.CMB.2.raw
  modified_base (239)..(239): a, c, t, g, unknown or other
  modified_base (419)..(419): a, c, t, g, unknown or other
  modified_base (466)..(466): a, c, t, g, unknown or other
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtcgtccccagggcagacagccacataacctgctctggattatttgtgaggatagatatgtnttgttggtatacaacgagaacggccggaccagtccaacctatattaggttatctagtagaagacaacgtaacgccggtccctagacgggactcccgtagacgcgtacttccctcgtgctaccactcgacggaacacacgcccactcacgacatcgagaccggaccagtcctagacggtancggagactagtacttagttacgtacgggtacggacgggtcgaggacngacgacgtccacgtccgtaccgtctacggtcggttaccgttacgggtaaccggttaccggtaaccgtaacgttcccgttaccgttaccgaacgtacccgaacccgacccgaccgacccctaacccgttcgtccg

SEQ ID NO: 368144 - DNA, 646 bp, Homo sapiens
  misc_feature: GZ8MTXP01DHPPU.13.10.A10.1.454.CMB.2.raw
  modified_base (407)..(407): a, c, t, g, unknown or other
  modified_base (435)..(435): a, c, t, g, unknown or other
  modified_base (444)..(444): a, c, t, g, unknown or other
tcagtcacgtactacacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtactgggcacagaggactcaccatggagtttgggctgaggtggtttttccttggtgctattttaaaaggtgtccattgtgaagtgcccctggtacaatcgtgggggaggcttgggtcaaggccggggggagtcccctgagactctcctgtgaagcctcaaactattcactttttgccttcgtgcccgtgggtcgaccgtggggtcccgccgaggctccgagggggaggggctcgggagtggnttggcctaatataaggacagacctaagnggcgcgacngcacactaccttagaactaccgtacaaagacagacttcaatccagttctcggaagaggttacgacttcccgaacaaaccgtacgggttcttacctccttcccgaatacttggacgacaacggtacccttaaaggaaaacttaccggaacgggaaacccaacggaacgggtaccctttaaaggtttaactttaaccggttggg

SEQ ID NO: 368145 - DNA, 672 bp, Homo sapiens
  misc_feature: GZ8MTXP01EDYOR.13.10.A10.1.454.CMB.2.raw
  modified_base (321)..(321): a, c, t, g, unknown or other
tcagtcacgtactacacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtactgggcacagaggactcaccatggagtttgggctggtaggttggtttttccttggtgtcttaagttttaaaaggtgtcctattgtgaagtcgcccctggtacaagtcgtgggggaggcttgggtcgaagggccgggggagtccctggagactcncctgtgaacgcctcaactattctacttttgcctcgtgcccgttgggtcgaccgtgggtcccgcgaggctaccggagggggaacggggctggggagtggattcggggccaaagttaagttaaggacaagtaaccctaaagtcggaccggcaacagccaactactaaccttagaactaccgtaccaaaagacgacgtattacaatcaacgttcgtacgtaaggtacggtgtaaccttacccgaactaaaccggcggttcttactcctaaccaattacgttggaaccgctaacgtccttaaaggaaacttacggaacggaacaacgagggtacccttaagttaacttaacgtgg

SEQ ID NO: 368146 - DNA, 598 bp, Homo sapiens
  misc_feature: GZ8MTXP01BN4SC.13.10.A10.1.454.CMB.2.raw
  modified_base (308)..(308): a, c, t, g, unknown or other
  modified_base (480)..(480): a, c, t, g, unknown or other
  modified_base (516)..(516): a, c, t, g, unknown or other
  modified_base (549)..(549): a, c, t, g, unknown or other
tcagtcacgtactacacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtactgggcacagaggactcaccatggagtttgggctgaggttggtttttccttggtgcttaattttaaaaggtgtccattgtgaagtgcccctggtacaatcgtgggggagcttggtcaaggccgggggatccctgagactcncctgtgaacgcctacaaactattctacttttgcttcgtgtccgtggggtcgaccgtcggggtcccgccgagggtcctccggaagggggaacgggggctggggaggtggagttggacctaaattagttaaggacaggaaccctaagtcgggacgcgaacagacacactacgtnaactccgacaaagcagatcatcatctaggagaggtnacgttccgaacaacgtacggtgtcctctcaatnagagcgagcttaagaaacttcggaagacaacgacgcttataacttcgtg

SEQ ID NO: 368147 - DNA, 877 bp, Homo sapiens
  misc_feature: GZ8MTXP01EB4M4.13.10.A10.1.454.CMB.2.raw
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcacgccacccgcaatcggtcccgtcgtccccgagggcagaccagccaccaataacctgctctggtattagtttgtggagggtatagatatgtcgttgttaggtactacgaaacgaggaacgggcccgacgtacgtccaaccttaacgtagtttaggttatactaagtacgaaacgtaccaacggaacggcccggtaccccgtacggaacgggggtaccttacccggtacggaacgtaccgtacgttttcccccgtacgttaccgggtacccttaaccccgtaaaccgtttaccgggtaaaccggggtaacccctaaaccgaacccggtacccccgtaacccttaacccggttaacccgggaaacccttaacggtacccggaaccgggggtacccccgggaaaccccgtaacgggtaaccccgttaaagggtcgggtaaacggttcggaccgggttaccttaaacggtaaactttaacgttacccgtaaggttaacccgtaaggttaaccgtaaggggtaaccgggaaacctaagttaaggttttaggtagggtaacgttcgggtaccggttttcgggggtaacccgggtaaacggggaccgggtaaacccttaaaacggtcccgggttaaccccgttacgggttacgacccggaacccgtaccccggtaacgggttccccggtccccggttaccccgttccgggttccttaacccccg

SEQ ID NO: 368148 - DNA, 720 bp, Homo sapiens
  misc_feature: GZ8MTXP01D6FPC.13.10.A10.1.454.CMB.2.raw
  modified_base (561)..(561): a, c, t, g, unknown or other
tcagtcacgtactacacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtactgggcacagaggactcaccatggagttgggctggtaggttggttttcctggtgtacttaagtttaaaggtgtctagttgtagagtcgccctggtacaagtcggtgggggacgtcgttggtacgaacgggccgggggactcccgtgacgtactcgtccgtgtagaacgcctacaaactacttcctacttttcgcgttcgtcgtccggttgggtacgtaccggttcgggggtccccgcgacgggtccgtaccggggaaggggggtaacggggtcgtaggggagggttgggtaacgttcgggacctaaaagttaagttaacggactaaacgtacccgtaaaggtcgggacgacgaacgacgactaaccgtactacgttagaaccgttacccgtaanaaacgacattactactactacgtagtcgacggtaaggtaggtacgaaccgttacccgaaagaaccggtacggttctcctacctacaagttcaggacgacgtagaccgttaaaagttacgaggaacgaacaacggtacgtacttaagttaagttcgtaag

SEQ ID NO: 368149 - DNA, 479 bp, Homo sapiens
  misc_feature: GZ8MTXP02HPUEZ.13.10.A10.1.454.CMB.2.raw
  modified_base (377)..(377): a, c, t, g, unknown or other
  modified_base (434)..(434): a, c, t, g, unknown or other
  modified_base (436)..(437): a, c, t, g, unknown or other
  modified_base (439)..(439): a, c, t, g, unknown or other
  modified_base (441)..(441): a, c, t, g, unknown or other
  modified_base (455)..(455): a, c, t, g, unknown or other
  modified_base (471)..(471): a, c, t, g, unknown or other
tcagtcacgtactacacgaccggtgctcgatttagcgtcgatctcaggggaggagagacccctcccctgggatcctgcagctctagtctcccgtggtgggggcctcaggaagcagcatcggaggtgcctcagccatggcatggatccctctcttcctcggcgtccttgcttactgcacaggatccgtggcctctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaaagccgccctcgagggactccctgagcgattcncttggctccaactctgggaactcacgccactctgaccatcagccggaccaggctagngnngngntgactatcgcgcgnggcgtggacagcagcncgtcgccg

SEQ ID NO: 368150 - DNA, 499 bp, Homo sapiens
  misc_feature: GZ8MTXP02HGJD2.13.10.A10.1.454.CMB.2.raw
  modified_base (255)..(255): a, c, t, g, unknown or other
  modified_base (307)..(307): a, c, t, g, unknown or other
  modified_base (349)..(349): a, c, t, g, unknown or other
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggccagacagccaccataacctgctctggatatttgttgagggatagatatgcttgttggtatcaacngaaggccggccagtcactacattggtatctatgaagacacgaagcggccctnagggatccctgagcgattccgtctggctccaactctgggacncagccactctgaccatcagcggacccagcctatgatgaggctgactatactgtcatacatggacacgatattggatgactggttcggcggagggaccaaagtcgaccgtcctaggtcaacgcccaaggcctcgcccccgtcggtccaccg

SEQ ID NO: 368151 - DNA, 514 bp, Homo sapiens
  misc_feature: GZ8MTXP02IW3FI.13.10.A10.1.454.CMB.2.raw
  modified_base (309)..(309): a, c, t, g, unknown or other
  modified_base (350)..(350): a, c, t, g, unknown or other
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctggatatttgttgagggatagatatgcttgttggtatcaacagaaggccggccagtcacctacattggttatctatgaagacacgaagcggcccctnagggatccctgagcgattcctctggctccaactctgggacncagcccatctgaccatcagcggacccagccctatcggatgaggctgactattactgtctatacatggacaacgatatggatggctggttcggcggtagggaaccaaacgtcgaccgtacctacggtcaacgtcccgaaaggcctacgccccctcggttccaccg

SEQ ID NO: 368152 - DNA, 511 bp, Homo sapiens
  misc_feature: GZ8MTXP02FTG0Q.13.10.A10.1.454.CMB.2.raw
  modified_base (255)..(255): a, c, t, g, unknown or other
  modified_base (405)..(405): a, c, t, g, unknown or other
  modified_base (413)..(413): a, c, t, g, unknown or other
  modified_base (419)..(419): a, c, t, g, unknown or other
  modified_base (424)..(424): a, c, t, g, unknown or other
  modified_base (430)..(430): a, c, t, g, unknown or other
  modified_base (432)..(432): a, c, t, g, unknown or other
tcagtcacgtactacacgaccggtgctcgatttagcgtcgatctcagggggtctcagagaggagccttagccctggactccaaggcctttccacttggtgatcagcactgagcacagaggactcaccatggaattggggctgagcgtggtttcgtgttaggctatttagaaggtgtccagtgtgaggtgcagctggtggagtctgggggaggcttggtccagcctggggggtccctgagactctcctgtgcagcnctggattcacctttagtagctattggatgagctggtcgccaggctccaggaaggggcgtggagtgggtggcgacataagacagttgagtgagaatactaatgtggatctgtgaagggccggattcacatctcccagagacaacgaccaanaacacacntatctnacaanagacancngagacgacgagacgacgcgtcgtactatacgtgtacgcgagagaggtaagggacggaaggtagtagacgacgacggacg

SEQ ID NO: 368153 - DNA, 524 bp, Homo sapiens
  misc_feature: GZ8MTXP02IZ2C7.13.10.A10.1.454.CMB.2.raw
  modified_base (279)..(279): a, c, t, g, unknown or other
  modified_base (380)..(380): a, c, t, g, unknown or other
  modified_base (382)..(382): a, c, t, g, unknown or other
  modified_base (394)..(394): a, c, t, g, unknown or other
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctggatatttgttgagggatagatatgcttgttggtatcaacagaagccggcagtcactacattgtanctatgaagacacgaagcggccctcagggatccctgagcgattctctggctccaactctgggacacagccactctgaccatcagcggacccagcctatggangngcagactatatntacatacagtaggaacaagatagtaggatacgtgtaggtcggacgggaacggaaaccaaacgtacgaaccgtaccgtaacggtaccgaacggacccgtaacggcctaccggtcccccgtacgtacctacg

SEQ ID NO: 368154 - DNA, 573 bp, Homo sapiens
  misc_feature: GZ8MTXP02GN4QW.13.10.A10.1.454.CMB.2.raw
  modified_base (307)..(307): a, c, t, g, unknown or other
  modified_base (349)..(349): a, c, t, g, unknown or other
tcagtcacgtactacacgaccggtgctcgatttagcgtcgatctcaggggctgggcctcaggaagcagcatcggaggtgcctcagccatggcatggatccctctcttcctaggcgtccttgcttactgcacaggatcggtggcctcgaatggcctgactcagccacccgcaatgtccgtgtccccagggcagacagccaccataacctgctctggattatttgttgagggatagatatgcttgttggtatcaacagaaggccggcagtcacctacattggtatctatgaagacacgaagcggccctnaggggatcccctgagcgattcctctgctccaatctagggacncagccactctgaccatcagccggacccagccctagtacggagtagacggctagacttaattaccgtgtacctaataccagtagggaaaccaaaggtattaagttggaagttcggcttaggttccgggacgggtaacggggaacccaaaacgtcggaacccgtaccgtaacggtaccgaacggccccgaaaggccctacggacccccctacggtaccctaacccg

SEQ ID NO: 368155 - DNA, 690 bp, Homo sapiens
  misc_feature: GZ8MTXP02HRTFY.13.10.A10.1.454.CMB.2.raw
tcagtcacgtactacacgaccggtgctcgatttagcgtcgatctcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggaggcttggtccaggccgtggggggtccctggagactctcctgtgcagcctctggattcacctttagtagctattggatggagcgtggggtcccgccagggcctccgaggggaaggggctggggaggtggggtggaccaaacgaataaagcaaaggttggaaagtgaagaaatactagtgtggaacttcgtaggttaaacggggcccgtatttaccaaccctaattccctacccgaaaggacgaaacccaaaaccgcccaaaaggaacctacaacctagtaaacttccgtagaacctaaaagttggaaaacctagggccctagggaaggaaccgacccgggtaagggaacccgaacggggtcctttaggtacccttaaaagtttttaccggtaggtacgggacggtaaagggtacggttaacggggttaggggggaacggtaaagggtaacgtacggacgtaggtacgggaccgtaacg

SEQ ID NO: 368156 - DNA, 558 bp, Homo sapiens
  misc_feature: GZ8MTXP02GON4R.13.10.A10.1.454.CMB.2.raw
  modified_base (362)..(362): a, c, t, g, unknown or other
  modified_base (437)..(437): a, c, t, g, unknown or other
  modified_base (454)..(454): a, c, t, g, unknown or other
tcagtcacgtactacacgaccggtgctcgatttagcgtcgatctcaggggctgggcctcaggaggcagcatcggaggtgcctcagccatggcatggatccctctcttcctcggcgtccttgcttactgcacagaatccatggcctcctatgagttgactcagccaccctccatcgtccgtcgtcccccggacagacagcctacatcacctgctctggagatgtattgactaacgagtatggttctggtatcagcagaggcaggccacgccccctgccctactcatctttacaaaactccgaggccgccctcgtcggggtccctgacgcgacttccgccccggctccgctcgtaggaaccacngtccactctagaccatcgagccggacccagcctattgatgacggctgtctactctggtcaggcgtaggacaacgngagtgcgtggtccgggnggaggaccgtgtcgtcggtaccggttcgttacggaccgacggaccccgaaggtcccgtcccggcccccgtcgggtccaccgttcctccggttccccctaccccg

SEQ ID NO: 368157 - DNA, 497 bp, Homo sapiens
  misc_feature: GZ8MTXP02F9UBA.13.10.A10.1.454.CMB.2.raw
  modified_base (254)..(254): a, c, t, g, unknown or other
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctggatatttgttgagggatagatatgcttgttggtatcaacngaagccggcagtcactacattgtatctatgaagacacgaagcggccctcagggatcccctgagcgattcctctggctccaactctgggacacagccactctgaccatcagcggacccagcctatcgatgaggctgactattactgtcatacatggaacacgatattggatggctggttcggcggtagggaccaaacgtcgaccgtctaggtcaacgcccgaaggctcgcccctcggtctaccg

SEQ ID NO: 368158 - DNA, 525 bp, Homo sapiens
  misc_feature: GZ8MTXP02GADVQ.13.10.A10.1.454.CMB.2.raw
  modified_base (216)..(216): a, c, t, g, unknown or other
  modified_base (282)..(282): a, c, t, g, unknown or other
  modified_base (435)..(435): a, c, t, g, unknown or other
tcagtcacgtactacacgaccggtgctcgatttagcgtcgatctcaggggaggagagaccccctcccctgggatcctgcagctctagtctcccgtggtgggggcctcaggaagcagcatcggaggtgcctcagccatggcatggatccctctcttcctcggcgtccttgcttactgcacaggatccgtggcctctatgagctgactcagccacctnagtcgtccgtgtccccaggacagacagccagcatcacctgctctaggaataaatgacagataaatntactctgtatcagcagaagtcaggccacgtcccctgtcgctcggtcatctatcaaagatcgaccaagccggaccctcgacgggtactcccgtagacgcgtattctctggcctaccaactcgtagggaacctcgacgcctagtctacgacctancgaacgccgggaccaggtctaagtggatggaggtctagtaccttattacgtgtacgaggtcggaaggacagccgagactacgtcgacccg

SEQ ID NO: 368159 - DNA, 515 bp, Homo sapiens
  misc_feature: GZ8MTXP02GCYBG.13.10.A10.1.454.CMB.2.raw
  modified_base (250)..(250): a, c, t, g, unknown or other
  modified_base (302)..(302): a, c, t, g, unknown or other
  modified_base (345)..(345): a, c, t, g, unknown or other
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccacataacctgctctggatatttgtgagggatagatatgcttgtgtatcaacngaaggccggcagtcacctacattggtatctatgaagacacgaagcggccctnagggactccctgagcgattcctctggctccaactctagggacncagccactctagaccatcagccgggacccagcctagtcggatgaggctagactattactgtcatacagtgggaacaacgatagttggatggctggttcggcggaggaccaaacgtcgaccgtacgtaggtacaacgtcccgaaggcctaccgccccgtcggtacctaccg

SEQ ID NO: 368160 - DNA, 608 bp, Homo sapiens
  misc_feature: GZ8MTXP02HDG2K.13.10.A10.1.454.CMB.2.raw
  modified_base (242)..(242): a, c, t, g, unknown or other
  modified_base (291)..(291): a, c, t, g, unknown or other
  modified_base (350)..(350): a, c, t, g, unknown or other
tcagtcacgtactacacgaccggtgctcgatttagcgtcgatctcagggtcttcgtggctcacgtccaccaccacgcatgtgacctcagggagtccctgagactctcctgtgaagcctcaacattcacttttgctcgtgcctgggtgacctgggtccgccaggcctccgagggagggctggagtggattggcatataaggacagacctaatggcgcgacagcacactaccttgaatccgtanaaagacagattcatcatctcgagaggtgacttccgaacaacgacgggtntcctctccatagtgagcagcctaagaaaatcggaagacacgaggcctatacttactgtncagtgagtcggggaccacgaccgacgttcgttttgggacgttgggtcgcgtcgtcccggaccccggtcgggggaccccggaaccgttcggacctacccggtctccgtcacgccctaccgaaccgaacggcccacgtccgtccctccccgtcggccctaccctccctaccgaacgacggacctacccgtcgggtcggggaccacgcggcccggtcccgtgggcctcggccgtcggtacaacggtacctaccgtttaccg

SEQ ID NO: 368161 - DNA, 579 bp, Homo sapiens
  misc_feature: GZ8MTXP02I01BW.13.10.A10.1.454.CMB.2.raw
  modified_base (436)..(436): a, c, t, g, unknown or other
  modified_base (511)..(511): a, c, t, g, unknown or other
  modified_base (563)..(563): a, c, t, g, unknown or other
tcagtcacgtactacacgaccggtgctcgatttagcgtcgatctcagggggtctcagagaggagccttagccctggactccaaggcctttccacttggtgatcagcactgagcacagaggactcaccatggaattggggctgagcgtggtttccgtgttaggctatttagaaggtgtccagtgtgaggtgcagctggtggagtcgtgggggaggcttggtccagccgtggggggtccctgagactctcctgtgcagcctctggattcacctttagagctattggatgagcgtgggtccgccaggctccgaaggggaaggggctgggaggtggggtcggaccaaacgaataaaagcgtaaaggttgggaaatgaaagaaatactagtgtcggacttctaggtaggaaggggccattccaacctattccacccagganaaccaacgccaaagactcatgtatcgtgaactaaagtcaaacgcgcctaggaagacggaccgaggactaccggtnttacgtacttatacgtgacgacgagtaggtagggtaaggggaagtaaggtanaggcgtaggtacgacg

SEQ ID NO: 368162 - DNA, 558 bp, Homo sapiens
  misc_feature: GZ8MTXP02FOWUA.13.10.A10.1.454.CMB.2.raw
tcagtcacgtactacacgaccggtgctcgatttagcgtcgatctcagggtcttcgtggctcacgtccaccaccaagcatgtgacctcagggagtccctgagactctcctgtgaagcctcaacattcacttttgctcgtgcctgggtgacctgggtccgccaggctccagggaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatggggccacgaccacgacttttggagtggtgcgctcgaccccgtgggggcccgggaaccctggtcaccgtctcctcacgcctccaccaacgggcccagtccggtccttccccctcggccacccctcctcccaacgacgccacccgtccgtcgggggcacgacgccggcccgtggggccgtcgccgtcgggtccaacggacctactttacccg

SEQ ID NO: 368163 - DNA, 557 bp, Homo sapiens
  misc_feature: GZ8MTXP02FK9YR.13.10.A10.1.454.CMB.2.raw
tcagtcacgtactacacgaccggtgctcgatttagcgtcgatctcagggtcttcgtggctcacgtccaccaccacgcatgtgacctcagggagtccctgagactctcctgtgaagcctcaacattcacttttgctcgtgcctgggtgacctgggtccgccaggctccagggaagggctggagtggattggccatattaaggacagacctaatggcgcgacagcacactaccttgaatccgtcaaagcagattcatcatctcgagaggtgattccgacaacacggtgtctctccatatgagcagcctagaaaatcgaggacacaggcctatacttactgtgcagtgatggggccacgaccacgtactttggagtggtgcgctcgacccgtggggcccggacctggtcaccgtctcctcacgccctaccaccgaacgggcccacgtccggtcccttcccccgtcggcccacccctccctaccaacgacgccaccgtcgtcgggggccacgacgccgcccgtcgggcgtcgccgtcggtcaacgggaccttacgttaccg

SEQ ID NO: 368164 - DNA, 533 bp, Homo sapiens
  misc_feature: GZ8MTXP02JZS7N.13.10.A10.1.454.CMB.2.raw
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctggatatttgttgagggatagatatgcttgtgtatcaacagaagccgcagtcacctacattggtatctatgaagacacgaagcggacccctgagggactcccgtgagcgattcctctggctccaactctgggacacagcccatctacgaccatccaggccggacccagccctatggatgaggctagactattactgtacatacagtacgggaacaaacgtataagttggatgggacttgggttacggcgggtacgggaccaaacgtcgacccgtcgtaacggtcaacgcccgaacggctaccgcccccgtacggtctaccg

SEQ ID NO: 368165 - DNA, 624 bp, Homo sapiens
  misc_feature: GZ8MTXP02F3CO5.13.10.A10.1.454.CMB.2.raw
tcagtcacgtactacacgaccggtgctcgatttagcgtcgatctcagggtcttcgtggctcacgtccaccaccacgcatgtgacctcagggagtccctgagactctcctgtgaagcctcaacattcacttttgctcgtgcctgggtgacctgggtccgccaggctccgagggaaggggctggagtggattggccatattaaggacagacctaatggcgcgacagcacactaccttgaatccgtcaaagacagattcatcatctcgagaggtgattccgacaacacggtgtctctccatatgagcagcctagaaaatcgaggacacgaggacctatacttacgtgtgcgagtgagtcggggccacgaccacgtacgtttggagtggtgcgctccggacccgtcggggccccggacccgtcggtccacccgtcctccctcgaccgtccctacccgacccgaccgggcccctacgtcccggttccccttcccccgtcggtcccctacccctcccgtacccaacgaccgaccgtacccgtccggtacgggggccaacggccggcccgggtccccgtcgggtccgtccggccggttcggtaccgaacgggtaccttaccgtttacccgg

SEQ ID NO: 368166 - DNA, 518 bp, Homo sapiens
  misc_feature: GZ8MTXP02I2271.13.10.A10.1.454.CMB.2.raw
  modified_base (471)..(471): a, c, t, g, unknown or other
  modified_base (482)..(482): a, c, t, g, unknown or other
tcagtcacgtactacacgaccggtgctcgatttagcgtcgatctcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagcctgggggtccctgagactctcctgtgcagcctctggattcacctttagtagctattggatgagctgggtccgccaggctccgaggggaaggggctgggagtggggtggccaacataaagcaagttggaagtgagaaatactatgtggactctgttaagggccgattcacatctcagagacaacgcaagactcactgtatctgacaaatgaacagcctgagagccgaaggcacggctgtctattacngtgacgagagngttgggggaacgtaaggtataggcaggtgactaacg

SEQ ID NO: 368167 - DNA, 556 bp, Homo sapiens
  misc_feature: GZ8MTXP02IR1V5.13.10.A10.1.454.CMB.2.raw
  modified_base (252)..(252): a, c, t, g, unknown or other
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccaccgcaatgtccgtgtccccagggcagacagccaccataacctgctctggatatttgttgagggatagatatgcttgttgtatcaacngaaggccgcagtcacctacattggtatctatgaagacacgaagccggccctacgagggactccccgtgagcgattcctctggcctccaactcgtagggacacagcccactctagaccatcacgccggacccagccctagtgactgaggctagactattactgtcatacagtaggacaacgattagttaggatggtactcgggttacgggacggaacgggaccgtaaaacgtcggtaacccggttaccgtacgggtaccaacggaccccgtaaacggcccgtaccgcccccgtcggtcctacccg

SEQ ID NO: 368168 - DNA, 529 bp, Homo sapiens
  misc_feature: GZ8MTXP02GA05H.13.10.A10.1.454.CMB.2.raw
  modified_base (405)..(405): a, c, t, g, unknown or other
  modified_base (478)..(478): a, c, t, g, unknown or other
tcagtcacgtactacacgaccggtgctcgatttagcgtcgatctcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagagctattggatgagctgggtccgccaggctccgaggggaagggctgggagtgggtgccaacataaagcaagttggaagtgaagaaatactatgtggactcgtgttaaggggccattcaccatctccaganacaacgccaaagaactcactgtatctgacaaatgaaacagcctagagagccgaaggcacggctgtctattacngtgcgagagtagttgggggaacgtaaagggtactaggcaggtggactaacg

SEQ ID NO: 368169 - DNA, 554 bp, Homo sapiens
  misc_feature: GZ8MTXP02GGE6C.13.10.A10.1.454.CMB.2.raw
  modified_base (238)..(238): a, c, t, g, unknown or other
  modified_base (265)..(265): a, c, t, g, unknown or other
tcagtcacgtactacacgaccggtgctcgatttagcgtcgatctcaggggaggagagacccctcccctgggatcctgcagctctagtctcccgtggtgggggcctcaggaagcagcatcggaggtgcctcagccatggcatggatccctctcttcctcggcgtccttgcttactgcacagaatccatggcctcctatgagttgactcagccaccctcatcgtccgtcgtcccccgganagacagcctacatcacctgctctgganatgtattgactaacgagtatggttcctggtatcagcagaaggcaggccagccccctgtcctactcactctttacaaaataccaggccgccctgtcgggtccctggacgcgacttcctccggctcccgcctcgtacgggaacacgacgtcactctcgaccatacacggccgggacccagccctattgactgacggtctcgtctacgttctgtcgacggcgtcggggacaaacgcggtccgtgtcgtggttccggacgggacgggtacccaggttccgtcggttaacccgg

SEQ ID NO: 368170 - DNA, 547 bp, Homo sapiens
  misc_feature: GZ8MTXP02HI19T.13.10.A10.1.454.CMB.2.raw
  modified_base (447)..(447): a, c, t, g, unknown or other
tcagtcacgtactacacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtactgggcacagaggactcaccatggagtttgggctgaggtggttttcctggtgctattttaaaaggtgtccattgtgaagtgcccctggtacaatcgtgggggagcttggtcaaggccgggggatccctgagactctcctgtgaagcctcaacattcacttttgctcgtgcctggggtgaccgtggggtcccgccaggcctccgaggggaaggggctgggagtggattggcctatattagggacagacctaagtggcgcgacagcacactacctgaatccgtanaaagacagatcatcatctgagaggtgatccgaacaacgacggtgtctctcctatagtgacgcacgcctagaaatcgaagacacaggacctatacttactg

SEQ ID NO: 368171 - DNA, 629 bp, Homo sapiens
  misc_feature: GZ8MTXP02HDQ57.13.10.A10.1.454.CMB.2.raw
  modified_base (252)..(252): a, c, t, g, unknown or other
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctggattattgttgaggatagatatgcttgtggtatcaacngaaggccggcagtccactacattggttatctatgaagacacggaagcggccctacgagggactcccgtgagcgtattcccctcgtgctacccaacttcgtaggggaccacgacgccctactcctacgaccctatccgacggaccgggacccaggtaccctaagtcggagtggacgggtctagacctttaattacttggtaccaagttacgaacggttacggggaaaccctaaacggtattaaagttgggtaagttcgggtacgttcggggttaccggggacggggtaaacgggtaaacccaaacgtccggtaacccgtccgtacgggtaccaaccggacccgaacggtcctcccgtacccccgtcggtccctaaccg

SEQ ID NO: 368172 - DNA, 327 bp, Homo sapiens
  misc_feature: GZ8MTXP02H5LKH.13.10.A10.1.454.CMB.2.raw
  modified_base (323)..(327): a, c, t, g, unknown or other
tcagtcacgtactacacgaccggtgctcgatttagcgtcgatctcagggagagcccctcacctccttatctatggtgcatccaccttacaaagtgggtcccatcaaggttcagtggcactggatctgggacagatttcactctcaccatcagcagtctgcaacctgaagattttgcaacttattactgtcaacagagtttcagtacgcggacgttcggccaagggaccaaaggtggaaatcaaacgaactgtggctgcaccatctgtcttcatcttcccgccatctgatagtactgactgagcgggctggcaaggcgcatagnnnnn

SEQ ID NO: 368173 - DNA, 542 bp, Homo sapiens
  misc_feature: GZ8MTXP02FWXC7.13.10.A10.1.454.CMB.2.raw
  modified_base (339)..(339): a, c, t, g, unknown or other
  modified_base (409)..(409): a, c, t, g, unknown or other
tcagtcacgtactacacgaccggtgctcgatttagcgtcgatctcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtagctattggatgagctggtccgccaggctccgaggggaaggggctgggagtgggtggccaaanataaagcaagtggaagtgaagaaatacgtatgtggactcgtgtgaaggggcgattcaccatctaccaganaacaacgccaaagaactcactgtatctgacaaaatgaaaacagacccgtgagagaccggaggaacacgctggtctaattcgtaggtgacgtagaggtagttgggggacgtaaaggtagtagacgaggtgaacg

SEQ ID NO: 368174 - DNA, 609 bp, Homo sapiens
  misc_feature: GZ8MTXP02H82QZ.13.10.A10.1.454.CMB.2.raw
  modified_base (302)..(302): a, c, t, g, unknown or other
  modified_base (395)..(395): a, c, t, g, unknown or other
  modified_base (417)..(417): a, c, t, g, unknown or other
  modified_base (541)..(541): a, c, t, g, unknown or other
  modified_base (588)..(588): a, c, t, g, unknown or other
tcagtcacgtactacacgaccggtgctcgatttagcgtcgatctcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggagcttggtccagccgtgggggtccctgagctctcctgtgcagcctctggattcacctttagtagcttagttggatggagcgtcgggtccnccgaggcctccggaaggggaaggggctggggaggtggggtcggaccaaacagtaaagctaaggttggaagtgaagaaatactagtgtggactntgtagaagggccattcacctancctcgagagaccgaacgccaaagacctcactgtaactcctagactaaatacgaaaccacgtacccgtaggaacgacggaccggaaggaccgtaaccgggcttaggttaccttaaagtttaccgnggttacgacgacggtaggtagggtttcggggggacgtaaaaggttanaacgggcgtacggtacggacg

SEQ ID NO: 368175 - DNA, 586 bp, Homo sapiens
  misc_feature: GZ8MTXP02I4ITE.13.10.A10.1.454.CMB.2.raw
  modified_base (275)..(275): a, c, t, g, unknown or other
tcagtcacgtactacacgaccggtgctcgatttagcgtcgatctcaggggctgggcctcaggaaggcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctggattatttgtgaggatagatatgtcttgttggtatcaacagaaggccggcagtcacctanattggttatctatgaagacacgaagccggccctacgagggactccccgtagacgtcgtattccctcgtggcctacccaacttcgtagggaccacgacgccctactctacggaccagtccgacggcccgggacccagcccttagtaggacttggacggtctagacttaattcgtagtctaatacagtagggaacctaagattagtggatgggtactggtacgggcggacggaaccgtaacgtcggacccgttcgtaacggtaccaacggaccccgaacggtccgtacccgtcccccggtcggtacctacccg

SEQ ID NO: 368176 - DNA, 626 bp, Homo sapiens
  misc_feature: GZ8MTXP02I31CJ.13.10.A10.1.454.CMB.2.raw
tcagtcacgtactacacgaccggtgctcgatttagcgtcgatctcagggggtctcagagaggagccttagccctggactccaaggcctttccacttggtgatcagcactgagcacagaggactcaccatggaattggggctgagctggtttcctgtgctatttagaggtgtccagtgtgaggtgcagctggtggagtcgtgggggagcttggtccagccgtggggggtccctgagactctcctgtgcagcctctggattcacctttagagctattggatgagtcgtgggtccgccgagggcctccgaggggaacggggctgggaggtggggtcgccaaacagtaaagcgtaaaggttggaaagtgaaagtaaaatactaagttggtggtaacttcgtaggtaggaacggggtcccaagttccaacctatccctaccaagaacgaacaaccgaccaaaagaacctcacttgtaactcctagaaccaaagtcgaaaacgacgaccaggaacgacggaccggaacggaccgaacgggtccttagtacttaagttacgttggacgtacggaagtaggtaggttaagggggaacggtaaagggttacgaggacgtagggttacggtaaccg

SEQ ID NO: 368177 - DNA, 565 bp, Homo sapiens
  misc_feature: GZ8MTXP02I405M.13.10.A10.1.454.CMB.2.raw
tcagtcacgtactacacgaccggtgctcgatttagcgtcgatctcagggtcttcgtggctcacgtccaccaccacgcatgtgacctcagggagtccctgagactctcctgtgaagcctcaacattcacttttgctcgtgcctgggtgacctgggtccgccaggctccagggaagggctggagtggattggccatattaaggacagacctaatggcgcgacagcacactaccttgaatccgtcaaagcagattcatcatctcgagaggtgattccgaacaacacggtgtctctccatatgagcagcctagaaaatcgaggacacaggcctatattactgtgcagtgatggggccacgaccacgtacttttggagtggtgcgcgtccgacccgtcgggggccccgggaacccgtcggtccacccgtcctcccgtcacgccctccacccgaacgggccccagtcccggtcccttccccgtcggccacctccctccaacgcgcaccttcgcgggggcacgacgccgcccgtcgggcgtcgccgtcggtacaacggacttacgtttaccg

SEQ ID NO: 368178 - DNA, 614 bp, Homo sapiens
  misc_feature: GZ8MTXP02GDZAD.13.10.A10.1.454.CMB.2.raw
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacacgccaccataacctgctctggatatttgtgaggatagatatgtcttgtgtatcaacagaaggccgcagtcacctatagttgtatctatgaagacacgagccgcctgaggactcccgtagagcgtattccctcgtcggtcctaccaacgtcgtaggggaacccacgacgtcccactccgtacgaaccactacgacggacccggacccagtaccctagtaggacgtaggacggtctacgtaacttacgttacgtacgtactaacgtacgtaagggtacggaaacctaaagtagttaggttagtagtggtacgttcgggttacgggacggggaaacggtaaccaaacgtaccggtaccgtaccgtacggtaccaacggacccgaacggtcccgtacccggtccccgtacggtaccctacccg

SEQ ID NO: 368179 - DNA, 568 bp, Homo sapiens
  misc_feature: GZ8MTXP02GEL6T.13.10.A10.1.454.CMB.2.raw
  modified_base (300)..(300): a, c, t, g, unknown or other
  modified_base (329)..(329): a, c, t, g, unknown or other
  modified_base (335)..(335): a, c, t, g, unknown or other
  modified_base (367)..(367): a, c, t, g, unknown or other
  modified_base (373)..(373): a, c, t, g, unknown or other
  modified_base (395)..(395): a, c, t, g, unknown or other
  modified_base (400)..(400): a, c, t, g, unknown or other
  modified_base (440)..(440): a, c, t, g, unknown or other
tcagtcacgtactacacgaccggtgctcgatttagcgtcgatctcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgtggggggtccctgagactctcctgtgcagcctctggattcacctttagtagctattggatgagctgggtccncaggctccgaggggagggctggagtgggngccaanataagcaaggttggaagtgagaaatactatgnggactntggtgaagggcattcaccatcncaganacaacgccaagactcactgtatctagacaaaatcgaaacngccctaggacgacggacccggaaggaccgaacgggtcttaggttaccttaagttaccgtggtacgacggtaagtacggtaggttcggggggacgtaaagggttacgtaggacgtagggtcggtaaccg

SEQ ID NO: 368180 - DNA, 678 bp, Homo sapiens
  misc_feature: GZ8MTXP02IRQ2L.13.10.A10.1.454.CMB.2.raw
  modified_base (182)..(182): a, c, t, g, unknown or other
  modified_base (295)..(295): a, c, t, g, unknown or other
tcagtcacgtactacacgaccggtgctcgatttagcgtcgatctcaggggtccgggagctctgggagaggagacccagccttttgattcccaagtgttgtcattcagtgatcaggactgggcacagaggactcaccatggagtttgggctgaggtggttttcctggtgctatttaaaaggtntccattgtgaagtgcccctggtacaatcgtgggggaggcttggtcaaggccgggggagtccctgagactctcctgtgaagcctcaacattcacttttgctcgtgcctggggtnacctggggtcccgccaggcctccgaggggaggggctggagtggattggcctatagttaagggacagacctaaagtggccgacgacagcacacttactgaatccgtacaaagacagtattcatcatctacgagagggtagacgtttaccggaactaaaccgacggttgtaccttaccttaccaagttacgtaggacgaccgaagtacccgtaaggaaaaacgtcgggaaaggaaccgaaacgtaacgggtacccttaaagtttaaactttaaccgttaggttacggtaccgtaagggtttacggaacggttccgggggtaaccccaaacccgggtaaccccgtaaacggtttaccggttttttacgggggaagggtttcggggg

SEQ ID NO: 368181 - DNA, 552 bp, Homo sapiens
  misc_feature: GZ8MTXP02GP8SS.13.10.A10.1.454.CMB.2.raw
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctggattatttgtgagggatagatatgtcttgttggtatcaacagaaggccgcagtcacctactattggttatctatgaaagacacgaagccggccctgagggactcccgtgacgcgtattccctcgtcggtctacccaacttcgagggacacacgtccaactctacgaccatcgacgcccggacccaggacctagtggactggacgactagaacttattacgtatactatacagtacggaacaacgtatagtagagtggtcgtggttacggcggtaacggaaccaacgtcgaccgtacgtaggcaacgccgaacgccaccgtccccgtcggtactacccg

SEQ ID NO: 368182 - DNA, 562 bp, Homo sapiens
  misc_feature: GZ8MTXP02GH3XJ.13.10.A10.1.454.CMB.2.raw
  modified_base (287)..(287): a, c, t, g, unknown or other
  modified_base (425)..(425): a, c, t, g, unknown or other
tcagtcacgtactacacgaccggtgctcgatttagcgtcgatctcagggtcttcgtggctcacgtccaccaccacgcatgtgacctcagggagtccctgagactctcctgtgaagcctcaacattcacttttgctcgtgcctgggtgacctgggtccgccaggctccagggaaggggctggagtggattggccatattaaggacagacctaatggcgcgacagcacactaccttgaatccgtcaaagcagattcatcatctcgagaggtgattccgacaacacggtntctctccatatgagcagcctgaaaatcgaggacacaggcctatacttactgtgcagtgatggggccacgaccacgtactttggagtggtgcgctcgaccccgtgggggccccggaaccctgggtccaccgtctccctnacgccctccaccgaacggtccccgattcccggtccttcccccgtggcccaccctccctaccaacgacaccgacccttcggcgggggcacgacggccgcccgtggcgtcgacctcgggtacaacggtactacgttccg

SEQ ID NO: 368183 - DNA, 643 bp, Homo sapiens
  misc_feature: GZ8MTXP02HK8NF.13.10.A10.1.454.CMB.2.raw
tcagtcacgtactacacgaccggtgctcgatttagcgtcgatctcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgttggggggtccctgagactctcctgtgcagcctctggattcacctttagtagctattggatgagcgtgggtccgcaggctccgaggggaagggcgtggaggtggggtgaccaaacagtaaagcaaggttggaagtagagaaatactagtgtggtacttgtaggttaaacggggccgtatttaccgaaccatcctacccgaaagagaacccaaacgacccaaaaggaacctacaacttcgtaactcttagacctaaaagtcgaaactacgaccctagaacggacggaccggaaagggaccaaccggggtctacggttacttaacgtttaccgtggttacggacggaaggtaacggtagggtttaggggggaacggtaaaggttacgtagggactaaggggtcggtacttaaaccgg

SEQ ID NO: 368184 - DNA, 542 bp, Homo sapiens
  misc_feature: GZ8MTXP02FYI7M.13.10.A10.1.454.CMB.2.raw
  modified_base (460)..(460): a, c, t, g, unknown or other
  modified_base (506)..(506): a, c, t, g, unknown or other
tcagtcacgtactacacgaccggtgctcgatttagcgtcgatctcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtgggggtccctgagactctcctgtgcagcctctggattcacctttagagctattggatgagcgtgggtcccgcaggcctccggaggggaagggctgggaggtgggtcgccaaacagtaaagcaaggttaggaagtgaaagtaaatactagtgtgactcgtgtagacgggcgattccacatcctacagacgacaacgccaaagaactcactgtatctagacaaatgaacagaccngacgacgccgagaacgtcggactcgtctaattcgagtcgacgaagngtaggtggggaagtaagtcgtagcgaggtcgtaacg

SEQ ID NO: 368185 - DNA, 661 bp, Homo sapiens
  misc_feature: GZ8MTXP02FH904.13.10.A10.1.454.CMB.2.raw
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccacataacctgctctggagataaattgggggataaatatgcttgctggtatcagcagaagccaggccagtcccctgtgctggtcatctatcaagataccaagccgccctcgagggactcccgtgacgcccgattcctctcggctcccaaacttccgtggggaaacactacgccctaactctacgaacccatcccaacggccggggtaacccccagggccgttaggtagggaactgggacgggtccgttaggaacccttaagtttacctgggttaccaaggggtccggtagggggaccaagggccaacggccaacgttccgacccctttacccgttaccggggaaaccgttcgggggaaaccctaaaacgggtccctaaacccggttcccgttaacggggtcccgaacggacccccgtaaaacggggacccccctaaaaccccccgtacgttaccgttaaccccg

SEQ ID NO: 368186 - DNA, 508 bp, Homo sapiens
  misc_feature: GZ8MTXP02IX1MB.13.10.A10.1.454.CMB.2.raw
  modified_base (230)..(230): a, c, t, g, unknown or other
  modified_base (248)..(248): a, c, t, g, unknown or other
  modified_base (266)..(266): a, c, t, g, unknown or other
  modified_base (272)..(272): a, c, t, g, unknown or other
  modified_base (280)..(280): a, c, t, g, unknown or other
  modified_base (295)..(295): a, c, t, g, unknown or other
  modified_base (345)..(345): a, c, t, g, unknown or other
  modified_base (370)..(370): a, c, t, g, unknown or other
  modified_base (386)..(386): a, c, t, g, unknown or other
tcagtcacgtactacacgaccggtgctcgatttagcgtcgatctcaggggctgggcctcgggaagcagcatcggaggtgcctcagccatggcatggatccctctcttcctcggcgtccttgcttactgcacaggatcggtggcctcgaatggcctgactcagccacccgcaatgtccgtgtccccagggcagacagccacataacctgctctgatatttgtgaggatagntatgcttgttgtatcaanagaagccgcagtcactanatgtanctatgaanacacgaagcggcctnaggatcctgagcgattcgactgctccaaatcgtaggaacacagccactcnaccatcagcggacccagctatgagngagctagactattacngtactatacagtagaacgaacgatagtagtagtgtgtgtacggacggacggaaacgaaacgtacgtacgtacgtacgtacgacgaaccgacgaccgtccgacccgtaccgtaccgtacctcg

SEQ ID NO: 368187 - DNA, 612 bp, Homo sapiens
  misc_feature: GZ8MTXP02H6PR6.13.10.A10.1.454.CMB.2.raw
  modified_base (233)..(233): a, c, t, g, unknown or other
  modified_base (514)..(514): a, c, t, g, unknown or other
  modified_base (534)..(534): a, c, t, g, unknown or other
tcagtcacgtactacacgaccggtgctcgatttagcgtcgatctcagggtcttcgtggctcacgtccaccaccacgcatgtgacctcaggggtccgggagatcatgagggtgtccttgggttttggggggaagaggaagactgaccggtccccccaggagttcaggtactgggcacagaggactcaccatggagtttgggctgaggtggttttcctggtgctatttaaaggtntccattgtgaagtgccctggtacaatcgtgggggagcttggtcaaggccgggggatccctgagactctcctgtgaagcctcaacattcacttttgcttcgtgcccgtggggtgaccccgttggggtcccgccgtagggctccgaagggggaaggggccttggggaagtggattcggggcctagttaattaggggaccaaggaacccttaaatggggcgcgacagcaacactaccttagaacttccgtacaaagacaagattcaatcaatctacgagaggtnacgtaccgaacaacgacgtntctctaccatagagacgacacgacctaagaaaactaacgaacggaacgaacgacgtaccgtaacttaacttaacgtcg

SEQ ID NO: 368188 - DNA, 860 bp, Homo sapiens
  misc_feature: GZ8MTXP02HR18R.13.10.A10.1.454.CMB.2.raw
tcagtcacgtactacacgaccggtgctcgatttagcgtcgatctcagggtcttcgtggctcacgtccaccaccacgcatgtgacctcaggggtccgggagatcatgagggtgtccttgggtttggggggaagaggaagactgacggtcccccaggagttcaggtactgggcacagaggactcaccatggagtttgggctgaggtggttttcctggtgctattttaaaggtgtccattgtgaagtgccctggtacaatcgtgggggaggtcttggtcaaggccgggggagtccccgtgacgactctccgtgtgaagcctcaacatttcacttttgctcgtgcctgggtgaccgtgggtcccgccaggcctccgaggggaacggggctaggggaggttggggatttggggaccctaagttaagtttaacgggggactaacggtaaacccttaaagttcggggaccggtaccggaaaccgaacgggacccaaacccgtaaccctttaaaccccgttttacggaaaaccgttttacccccggtaaaccgtaaaaaacggaacccaaagggttaaaccttttaccgaaactttcccgtaaaactttcccggtttaaaccggggaaagggtaaccgggggtttaggtaaaccttttacccccgggaaaactaaaacccgtaaccgggtttacggttcccgtttaaccgtacccccgtaacttaaccgttacgggaacggtaccaaaccgggttaccccctaacggaaaaaaaacccgttccggggaaaacggggtaaaacccctaaaaccggtaaaccgggggaaccccctttaaaacggttaacgttttaacccgtttaaacggg

SEQ ID NO: 368189 - DNA, 643 bp, Homo sapiens
  misc_feature: GZ8MTXP02ICKYW.13.10.A10.1.454.CMB.2.raw
  modified_base (243)..(243): a, c, t, g, unknown or other
  modified_base (308)..(308): a, c, t, g, unknown or other
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagcccacccgcaatgtccgtcgtccccagggcagacagccaccaataacctgctctggtatatttgtgagggatagatatgtntttgttgtatcaacagaaggccgcagtcacctacattggttatctatgaagacacgagccgcccngaggactccgtgacgtcgtattcccgtcgtcggtacctaccacgttcgtacgggaccacgacgccctaacttcctacgaacctactaccgacggcccggacccacggtacccgtagtaggacgttaggacggtaccgttacgtaacttactttaacgttacggtactaaagttaccgtaggttacgggtaaaccaaaggtattaggttaggtagtcgggtcgttacggggttccgggacgggtaaaccggaaccgtaaacgtcggtaaacccgtcggttacggacgaaccggaccgaacgtcccgtcccgtcccccggttcggtaacccttcccg

SEQ ID NO: 368190 - DNA, 770 bp, Homo sapiens
  misc_feature: GZ8MTXP02F1GC7.13.10.A10.1.454.CMB.2.raw
  modified_base (258)..(258): a, c, t, g, unknown or other
tcagtcacgtactacacgaccggtgctcgatttagcgtcgatctcaggggctgggcctcaggaagcagcatcggaggtgccctcagccatggcatggatccctctcttcctcggcgtccttgcttactgcacaggatcggtggcctcgaatggcctgactcagcccaccgcaatgtcccgtgtccccagggcacgacagccaccataacctgcctctggattagtttgttgaggatagatatgtcttgtgtatcaagngaaggccggcagtcacctacattggttatctagtgaagtacacggaaagtccggcccctagagggtacttccccgaggacgtaccgtatttccccgtcgttcgggaccctttacccgaaacttcccgttaggggaacccaaccccggccctaaacgttcccgtaggaacccctaaagttcccggaaacggcccggggaaccccctacggtacccgttaacgtagggtaaagttcggaaacggggtccctaaggtaaccttaacgttttaaaccgtaacggttccgtaaactaaaccgtaagtttaacggggaaaccgtaaaccgtaagttaacggtttaggtagttaacgggtcgtacggggtttacccgggacgggaaaccggggtaaacccgtaaaccggttaacggtaccccggttaccgtttaaacggtacccggtaaccgtcccggaaaaccggtcccgttaccccgggtacccccccggttaggtcccggtaacctttacccccgg

SEQ ID NO: 368191 - DNA, 589 bp, Homo sapiens
  misc_feature: GZ8MTXP02IVBP6.13.10.A10.1.454.CMB.2.raw
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccaccgcaatcgtccgtgtccccagggcagacagccacataacctgctctgattattgttgaggatagatatgcttgtggtatcaacagaaggccgcagtccaactactattcggttatctaatgaaagacgacgaagcggccctgagggactccctgaacgcgtattccgtctggcctaccaacttcgacgggaacacagcccaactctacgaccatcgacgccggacccacgcctaagtacggtagagaacggtctacggtaacttaacgttacttacggtactaattaccgagttacgggaaacacggtatagttggagtgtcgtacggttcgggacggtaacgggaacctaaacgtacggtacccgttacgttacgaccgaacggaccctaacggtcctccgcccccgtcggacccttacccg

SEQ ID NO: 368192 - DNA, 551 bp, Homo sapiens
  misc_feature: GZ8MTXP02JWJOH.13.10.A10.1.454.CMB.2.raw
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctctaatggcctgactcagccacccgcaatgtccgtgtccccagggcagacagccaccataacctgctctggatatttgttgagggatagatatgcttgtggtatcaacagaaggccggcagtcacctacattggttatctatgaagacacgaagcggcccctgagggatccctgagcgattcctcgtggctaccaactcgtagggaccacacgccactctagaccatcagccggacccagcctatgatgagctagactattactgtacatacagtaggaacaacgtatagtggagtggactggttccgggagggtaacgggaaccgaaaacgtcggaacccgtaccgttacgggtaccaacggaccccgaaaggccctaccggccccccgttacggtacctaccccg

SEQ ID NO: 368193 - DNA, 667 bp, Homo sapiens
  misc_feature: GZ8MTXP02GLT17.13.10.A10.1.454.CMB.2.raw
  modified_base (215)..(215): a, c, t, g, unknown or other
  modified_base (306)..(306): a, c, t, g, unknown or other
  modified_base (325)..(325): a, c, t, g, unknown or other
tcagtcacgtactacacgaccggtgctcgatttagcgtcgatctcagggggtctcagagaggagccttagccctggactccaaggcctttccacttggtgatcagcactgagcacagaggactcaccatggaattggggctgagcgtggttttccgtgttaggctatttagaaggtgtccagtgtgaggtgcagctggtggagtctgggggaggnttcccgggtccaggccgtggggggtccctggagactctcctgtcaagcctctgggttcagcttcagtgtatatggatgagctggggtcccncagacgcggaggggagggngtgggaggtgggacgaccaaacaataaacacgaggaaccggaagtacgaacctatacgtagtcggccgtactcgtaggtagggaacgggtacctacttaccacctactcctacgaagaacgaaaccgaaacgacctaaacgaacctactaacttaagttaacgtttacgaacgtaaacgtaccggtaccgtaccgtacggaacggaacggaacggaacggaacggaaccggtacgtagttacgttaacgttacgttaggtacggtacggaacggaacgacgtaggaggtaaggtacggtacggtacggtacgggtacgggggtaccggggtaaccggtacgg

SEQ ID NO: 368194 - DNA, 600 bp, Homo sapiens
  misc_feature: GZ8MTXP02I2PXF.13.10.A10.1.454.CMB.2.raw
tcagtcacgtactacacgaccggtgctcgatttagcgtcgatctcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtgggggagcttggtccagccgtgggggtccctggagactctcctgtgcagcctctggattcacctttagtagctattggatgagcgtgggtccgccaggctccgaaggggagggcgtgggaggtgggtgaccaacgaataaagcaagttggaagtgaagaaatactagtgtggactgtagtagaacgggcgaattccaccattccaccagacaacaacgccaaagactcactgtactcagactaaaatgaaaacacgacccgtagacgaacggtcccggaaggaacccgacgggtcttacggtacctttaaagttaccggtgtacggaccgaaggacggtaaggttcggggggaaggaaagggttaacgagtccgaaagggttcggaaacccg

SEQ ID NO: 368195 - DNA, 537 bp, Homo sapiens
  misc_feature: GZ8MTXP02FYHG3.13.10.A10.1.454.CMB.2.raw
  modified_base (346)..(346): a, c, t, g, unknown or other
  modified_base (383)..(383): a, c, t, g, unknown or other
  modified_base (409)..(409): a, c, t, g, unknown or other
  modified_base (451)..(451): a, c, t, g, unknown or other
  modified_base (522)..(522): a, c, t, g, unknown or other
tcagtcacgtactacacgaccggtgctcgatttagcgtcgatctcagggggtctcagagaggagccttagccctggactccaaggcctttccacttggtgatcagcactgagcacagaggactcaccatggaattggggctgagctgggttttcctgttgctattttagaaggtgtccagtgtgagtgcagctggtggagtcgtgggggaggcttggtccagccgtgggggggtccctggagactctcctgtgcagcctctggattcacctttagagctattggatgagctggggtccgccagggctaccgaggggaaggggctgggaggtggggtggccaaacanaaagcaaagttggaagtgaagaaaatctatgtgactntgtgaagggcgatcaccatctcaganacaacgaccaaagaactcactgtatctagacaaaatgaaacngccctaggagagcccgaggactacgggctgtctattactgtagcgaagagtagtgggggacgtaaaggtanagacgaagtcggacc

SEQ ID NO: 368196 - DNA, 623 bp, Homo sapiens
  misc_feature: GZ8MTXP02GXIA8.13.10.A10.1.454.CMB.2.raw
tcagtcacgtactacacgaccggtgctcgatttagcgtcgatctcagggtcttcgtggctcacgtccaccaccacgcatgtgacctcagggagtccctgagactctcctgtgaagcctcaacattcacttttgctcgtgcctgggtgacctgggtccgccaggctccgagggaaggggctggagtggattggccatattaaggacagacctaatggcgcgacagcacactaccttgaatccgtacaaagacagattcatcatctcgagagtgattccgacaacgacggtgtcctctccatatgagcagcctagaaaagtcgaaggacacgagccttatacttactgtcgacagtgagtcggggaccaacggacctagtaccgttttagggagtggtcgcgccgtccgaccccggtcggggaccccgggaccgtcggtccacccgtcctccgcgaccgccgtacccaccgaaccgggccctacggtcccgtcccgttcccccgtacggtcccaccccgtcctaccgaaacgccgaccgtacccgtcggtaccgggggaccaccggacggcccgggccgtcggggtcctcggccgtacggtacgaacgtaccttaccgtttaccg

SEQ ID NO: 368197 - DNA, 773 bp, Homo sapiens
  misc_feature: GZ8MTXP02IW2SD.13.10.A10.1.454.CMB.2.raw
  modified_base (376)..(376): a, c, t, g, unknown or other
tcagtcacgtactacacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtactgggcacagaggactcaccatggagtttgggctggaggttggtttttccttggtgcttattttaaaaggtgtccattgtgaagtgccctggtacaatcgtgggggagcttggtcaaggccgggggagtcccgtgagactctccgtgtgaacgcctacaactattcctacttttgccttcgtgccgttggggtcgacccgttggggtcccnccgaggcctaccgaagggggaacggggcgtaggggaggtcgggtagtttcggggacctaaagttaacgtttaacgggggaactaaacgggtaaccccgttaaaagtccggggacgaccgaacgaacggacccaaaccgtaacccgttaaccgtttagaaaaccttacccggtaacaaaaacggtacccaaaggtaactttcgaaacttactacttaccgttacgaaggtaggggttacaacgtttacccggaaactaaacggtacgggttcgtacccttacgttaccctaagttacgtggaacgtaccgaacgtacccgtaaaaggtaaaaactcccgggaaaaggaacccctaacggaaaccggtaccctttaaaatttacgtttaaaccgttcgg

SEQ ID NO: 368198 - DNA, 725 bp, Homo sapiens
  misc_feature: GZ8MTXP02F7RJR.13.10.A10.1.454.CMB.2.raw
tcagtcacgtactacacgaccggtgctcgatttagcgtcgatctcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcagcgtgggtggagtcggtgggggagtcttgggtcccaggtcccggtcggggggtcccctggacgaccttctccgtgtgcagcctgtggacttcacctttagagctagttggatggagtcgtcggggtcccgccgagggcctaccggaagggggaacgggggtcgtagggggtaggtcgggggtacgaacccgtaaacgaaagtaaaacggacgtaaagggtttagggaaaggttaggaaacgtaaaattacgttaagttggtagggtaccttgtagggtacgggaacgggggtacctaactttcccgaaacctacgttccctaccgaagacgaaaccaaccgaccaaagaacctcaacgtgtaaactctaagaaactaaagtacgaacgacgacccgtagggaacgacggaccggaaggaccgacgggtaccttcggttacttaagttacggtggtagtacggaaggtaggtagggggttaagggggaaacggtaaaggttaccaaaggtggttaccggacgtttaaaccgg

SEQ ID NO: 368199 - DNA, 572 bp, Homo sapiens
  misc_feature: GZ8MTXP02JNOFC.13.10.A10.1.454.CMB.2.raw
  modified_base (286)..(286): a, c, t, g, unknown or other
  modified_base (297)..(297): a, c, t, g, unknown or other
  modified_base (337)..(337): a, c, t, g, unknown or other
  modified_base (340)..(340): a, c, t, g, unknown or other
tcagtcacgtactacacgaccggtgctcgatttagcgtcgatctcagggtcttcgtggctcacgtccaccaccacgcatgtgacctcagggagtccctgagactctcctgtgaagcctcaacattcacttttgctcgtgcctgggtgacctgggtccgccaggctccagggaagggctggagtggattggccatattaaggacagacctaatggcgcgacagcacactaccttgaatccgtcaaagcagattcatcatctcgagaggtgattccgacaacacggtntctctccatangagcagcctagaaaatcgaggacacgaggcctatactacngtncagtgatggggccacgaccagtctttggagtggtgcgctccgacccgtcggggccccggaaccgtcggtccaccgtctcctcacgccctaccgacccgaacgggccctacgtccggtcccttcccccgtacggcccaccccttcccaccgaacgacgacccacccgtcgtcgggggccacgacgccggcccgtgggccgtcgccgtcggtccgaacggtacctactttaccg

SEQ ID NO: 368200 - DNA, 576 bp, Homo sapiens
  misc_feature: GZ8MTXP02GRO7P.13.10.A10.1.454.CMB.2.raw
tcagtcacgtactacacgaccggtgctcgatttagcgtcgatctcagggtcttcgtggctcacgtccaccaccacgcatgtgacctcagggagtccctgagactctcctgtgaagcctcaacattcacttttgctcgtgcctgggtgacctgggtccgccaggctccagggaaggggctggagtggattggccatattaaggacagacctaatggcgcgacagcacactaccttgaatccgtcaaagacagattcatcatctcgagaggtgattccgacaacacggtgtctctccatatgagcagcctagaaaatcgaggacacaggcctatattactgtgcagtgatggggccacgaccacgtactttggagtggtgcgctcgacccgtggggcccggacctcggtcaccgtctcctcacgccctccacccgaacgggccccacgtcccggtcccttcccccgtcggccctaccccgtccctacccaaacgacgtccacccgtccgtcgggggaccacgacgccggcccgtcggggccgtcggccgtcgggtaccaacggtacctactttacccg

SEQ ID NO: 368201 - DNA, 851 bp, Homo sapiens
  misc_feature: GZ8MTXP02IP5FG.13.10.A10.1.454.CMB.2.raw
  modified_base (271)..(271): a, c, t, g, unknown or other
tcagtcacgtactacacgaccggtgctcgatttagcgtcgatctcaggggtccgggagctctgggagaggagacccagccttttgattcccaagtgttgtcattcagtgatcaggactgggcacagaggactcaccatggagtttgggctgaggtggttttccttggtgctattttaaaaggtgtccattgtgaagtgcccctggtacaatcgtgggggaggcttgggtcaaggccgggggatccctgagactctctgtgaagcctcaacnttcacttttgctcgtgccgtggggtcgaccgtggggtcccgccgacggcctccggaggggaagggggctggggaggtgggtagtttcgggacctaagttaagttaaagggacctaaaggaaccctaaaggtcgggacccgaccgaacacggaccaacctaccgttaacccttggtaaacttccccggtaaacaaaaacggactaggtaactttaccgaacttacctaaacttacccgttacgggaaagggtaacggggtttacgtaaaccgttttaaccccggaaaaccgtaaaccgggtacccggggtttacggttacccctttacccttacccccgtaaaagtttaacgttacggtaaccggacgtaaaccggtacccgttaaaaggaaaaaaaccgttccggggaaaacgggtaacccaaaccggtaaccggggtaacctttaaaacgtttaaacgttttaaccgttagggttaacggaccgttaagggttacggaacggttaaccgggggacccaaacccgggtaaccccgttaaccgggtttaaccgtttttcgggggtaaacggtttccggggg

SEQ ID NO: 368202 - DNA, 638 bp, Homo sapiens
  misc_feature: GZ8MTXP02IRSN3.13.10.A10.1.454.CMB.2.raw
  modified_base (584)..(584): a, c, t, g, unknown or other
tcagtcacgtactacacgaccggtgctcgatttagcgtcgatctcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccgaggcccggtggggggtcccctggacgactctccgtgtgcacgcctgtggtattctacctttagtagtcttagttggatggagtcgtcgggtccgccgaggcctccggaaggggagggcgtggggacggtggggtacggaccaacgaaagtaaacgcgtaaggtaggaagtagaagtaaactacgtagtgtcggactcgtaggtaggaacgggtcgtattaccaacctattccacccgaagaacgaacccaaaccgacaaaagtaaccttcgaacttgtaactccgtagaacctaaaagtccgaaacacgcccgtaggacggacgcccggaaggtaccacggtcttacgtacttagttacgngtcgacgaaggtcggtaggtgggggaacgtaaggtcaacggcgtaggacggtac

SEQ ID NO: 368203 - DNA, 648 bp, Homo sapiens
  misc_feature: GZ8MTXP02FSYKO.13.10.A10.1.454.CMB.2.raw
  modified_base (170)..(170): a, c, t, g, unknown or other
  modified_base (249)..(249): a, c, t, g, unknown or other
  modified_base (272)..(272): a, c, t, g, unknown or other
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgnaatgtccgtgtccccagggcagacagccacataacctgctctaggaaataatggacagataaatatacttctgtatcancagagtcaggccacgtcccctgngctggtcatctatacaagtatgaccaaggcccgccctagacgggtacctcccgtagacgtcccgtatttccgtcgtcggacccttacccaaacgttccgacgggtaaaccttacgaccgccctaactcgtaacgaccctagtaccgacggaccggaacccagggtacctagtacggagttagggacgtcgtaggtaccttagtttacgtggttaccgagggtacggtacggacacgcgaacggcctacgtccgccccgtagttacgtacggttccgttaaccgggaacggttaccgggaaacccgtacggttacccgaacccggttacgtaaacggtaccgaaccggtaccccgaaaccggcccctaaaacccccg

SEQ ID NO: 368204 - DNA, 533 bp, Homo sapiens
  misc_feature: GZ8MTXP02GOQNT.13.10.A10.1.454.CMB.2.raw
  modified_base (283)..(283): a, c, t, g, unknown or other
  modified_base (291)..(291): a, c, t, g, unknown or other
  modified_base (307)..(307): a, c, t, g, unknown or other
  modified_base (409)..(409): a, c, t, g, unknown or other
  modified_base (451)..(451): a, c, t, g, unknown or other
tcagtcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctggattatttgttgagggatagatatgtcttgttggtatcaacagaaggccggccagtcactacattgtanctatgaanacacgaagcggccctnaggatccctgagcgattctctggctcaactctagggacacagtccactctagaccatcaagccggaacccagccctagtggatagaggactgacttattacngtaccgaggtcggtagggacgagtcgagcctagcgccccgtntacgtcgtacgtacggacgtacggacgtacgtaccgaccgtaccgtaacgtccacgacccgaacgaccctaaccctactacg

SEQ ID NO: 368205 - DNA, 671 bp, Homo sapiens
  misc_feature: GZ8MTXP02HGMV1.13.10.A10.1.454.CMB.2.raw
  modified_base (414)..(414): a, c, t, g, unknown or other
tcagtcacgtactacacgaccggtgctcgatttagcgtcgatctcagggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctggatatttgttgaggatagatatgcttgttggtatcaacagaaggccgcagtcactacattggttatctatgaagacacgaagccggccctacgagggatccccgtggacgcgtattcccctacgtcggtcctaccaactcgtaggggaccacgacgcccactctacgaccatcgaggcccgggacccaggtccttaagnggagtggacggctagaccttaattacgtacgtactaagttaccgaaggttacggggaaacctaacggtaagtttaaggtttagggaacgttggggtaccgtttcggggtttaccgggggaacgggggaaccggggtaaaaccccgtaaaacggttccgggtaacccggtttacccgtaagggttacccgaaccgggtaccccgaaacggggtccccgtaccccggtccccccgttaaccgggtcctttaacccccgg

SEQ ID NO: 368206 - DNA, 572 bp, Homo sapiens
  misc_feature: GZ8MTXP02HOUB0.13.10.A10.1.454.CMB.2.raw
  modified_base (294)..(294): a, c, t, g, unknown or other
  modified_base (504)..(504): a, c, t, g, unknown or other
tcagtcacgtactacacgaccggtgctcgatttagcgtcgatctcagggggtctcagagaggagccttagccctggactccaaggcctttccacttggtgatcagcactgagcacagaggactcaccatggaattggggctgagctgggttttcctgttgctatttagaaggtgtccagtgtgaggtgcagctggtggagtcgtgggggagcttggtccagccgtgggggtccctgagactctcctgtgcagcctctggattcacctttagtagctattggatgagctggtccncaggctccgaggggagggctggaggtgggtgccaacataaagcaagttggaagtgagaaatactagtgtggactcgtgtaggaacggggccaattccaaccgtatccctacgaaggacaaccgaacgaccaaagaacctcactgtatccgtagaacctaaaagtcgaaaccacgtccgtagaaggacgccgggaagtaccgaccgggttnttcgttacttatcgtgacgacggtagaggtagggtaaggggacgtaaggtacgagcgtaggtacgacg

SEQ ID NO: 368207 - DNA, 750 bp, Homo sapiens
  misc_feature: GZ8MTXP02F254M.13.10.A10.1.454.CMB.2.raw
  modified_base (374)..(374): a, c, t, g, unknown or other
tcagtcacgtactacacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtactgggcacagaggactcaccatggagtttgggctggtaggttcggtttttccgtggtgtacttaagttttaaaggtcgtcctatttggtagtaagttcgccccgttaggtaacaagttcggtgggggagtcgttagggtcgaaacggggccgggggtacgtccccgtaggacgaccttccgtccgtggtagaacgtccctacaaacctntttccgttacttttcgccgttcgtcgtcccgtggggtccgtaccggtcgggtcccgccggaggtccctaccggggaaggggacggggtcgtaggggacggtgggtagttcggactaagttaaggttacgggaacaacggtaaacctaggtcggggacgccggaaactacgaaccaaccgtaaccttacgttaagtaccgtacccgtaacgaaaacgaacgtagtaacttactagtccctattcgtacggtaagtacggtagtaaccgttaccgaaacctaacggtccggttctaaccgtccctactaaagtgtacgacgacgtaaccgaccgttaagaaaacgtccggaagtacacgtacgtactaatctagtacg

SEQ ID NO: 368208 - DNA, 547 bp, Homo sapiens
  misc_feature: GZ8MTXP02FWWA0.13.10.A10.1.454.CMB.2.raw
  modified_base (308)..(308): a, c, t, g, unknown or other
  modified_base (312)..(312): a, c, t, g, unknown or other
  modified_base (335)..(335): a, c, t, g, unknown or other
  modified_base (464)..(464): a, c, t, g, unknown or other
  modified_base (482)..(482): a, c, t, g, unknown or other
  modified_base (489)..(489): a, c, t, g, unknown or other
tcagtcacgtactacacgaccggtgctcgatttagcgtcgatctcagggtcttcgtggctcacgtccaccaccacgcatgtgacctcaggggtccgggagatcatgagggtgtccttgggtttggggtaagaggaagactgacggtcccccaggagttcaggtactgggcacagaggactcaccatggagtttgggctgaggtggttttcctggtgctatttaaaaggtgtccattgtgaagtgcccctggtacaatctggggagcttggtcaagccggggatccctgagactctcctgtgaagcctnaacnttcactttgctcgtgcctgggtnaccgtgggtccgccaggctccgaggggaaggggctgggagtgattggccatataggcaggacctaagtgcgcgacagcacactaccttgaactccgtcaaaagacagattcatcatctacgagacggtnattccgacaacgacggtntccgtcncatatgacgctacgaccctagaaaactccgaaggacaacgacggccctatactactag

SEQ ID NO: 368209 - DNA, 741 bp, Homo sapiens
  misc_feature: GZ8MTXP02FNA99.13.10.A10.1.454.CMB.2.raw
  modified_base (342)..(342): a, c, t, g, unknown or other
tcagtcacgtactacacgaccggtgctcgatttagcgtcgatctcagggtcttcgtggctcacgtccaccaccacgcatgtgacctcagggggtccgggagatcatgagggtgtccttggggttttggggggaagaggaagactgaccggtccccccaggagttcaggtactgggcacagaggactcaccatggagtttgggctggtaggttggttttttccttgggtgtcttaagttttaaaaggtgtccattgtgaagtcgcccctggtacaatcgtgggggaggcttggtcgaaggccgggggagtccctggacgctctcctggtgaacgcctcaactntttcctactttttgcttcggtgtccgtggggtcgtacccgtcggggtcccgccgtagggccgtaccggaaggggggaacggggtctaggggaggtgggtagtttcggggaccctaaagttaagtttaacgggaccaaacggtaaccttaaaggtcgggacgaccggaacgacgacctaaacctaacttaacccgttagaaaccgttacccgtaacgaaaaacgactaagtaacttacacttacacttaccgtacggaggtacgggtagtaaccgttaccgaacgaaaccggtcgggttactccctctacctaattacgtggacgaccgacggtaccgtaaaagaaaacgttaccggaaacggtaaccgaacgtacggtaccttaagttacttacgtagg

SEQ ID NO: 368210 - DNA, 706 bp, Homo sapiens
  misc_feature: GZ8MTXP02FT8D3.13.10.A10.1.454.CMB.2.raw
tcagtcacgtactacacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtactgggcacagaggactcaccatggagtttgggctgaggttggttttcctggtgcttatttaaaaggtgtccattgtgaagtgcccctggtacaatcgtgggggaggcttggtcgaaggccgggggagtccctgagactctcctgtgaagcctcaacatttcacttttgcttcgtcgccgtggggtcgtacccgtcgggtcccgccgacgggcctccgaggggaacggggcgtgggaggtggagttcggccaagttaagttagggacaggtaacctaaagtcgggacgcgacagccacactaccttgaaactcccgtacgaaaagaaccgagtaacttacgaattaccaacttacctacggtagggtaaacgggttagtaaacccgtttaacccggaaaacccaaaccggttaaccgggggtttcgttacccgtacccgtttacccaaaatttacgtacgaacggtacgaacggtacccgtaaagaaaacgtacggaacgggaacctaccggacggtaccttaataacgtttacgtacgg

SEQ ID NO: 368211 - DNA, 600 bp, Homo sapiens
  misc_feature: GZ8MTXP02G7ONO.13.10.A10.1.454.CMB.2.raw
  modified_base (333)..(333): a, c, t, g, unknown or other
  modified_base (394)..(394): a, c, t, g, unknown or other
tcagtcacgtactacacgaccggtgctcgatttagcgtcgatctcagggggtctcagagaggagccttagccctggactccaaggcctttccacttggtgatcagcactgagcacagaggactcaccatggaattggggctgagctgggttttcctgttgctattttagaaggtgcccagtgtgaggtgcagctggtggagtctggaggaggcttgatccagccgtgggggtccctgagactctcctgtgcagcctcgtggttcaccgtcagtcaacacctacatgagctgggtccgccaggctccgaggggaaggggctgggagtgcgtctntttatttatagtagtgtagtacatactcgcagtactccgtgacgggggccattccaacctntccgtccagacgactaattacccaaagaacacgcttagttcttacgaaaatcgaaacagtacctaaagacgaccgtagagaacaccgggaccgttacgtacttaaacgtcggttagacggtaacgaagggacggtacgggggacccggtaacgtaaaaccgggttactaaccgggtatacgttacggaccggtcggtaaccggggg

SEQ ID NO: 368212 - DNA, 665 bp, Homo sapiens
  misc_feature: GZ8MTXP02FUX3W.13.10.A10.1.454.CMB.2.raw
  modified_base (280)..(280): a, c, t, g, unknown or other
tcagtcacgtactacacgaccggtgctcgatttagcgtcgatctcaggggtccgggagctctgggagaggagacccagccttttgattcccaagtgttgtcattcagtgatcaggactgggcacagaggactcaccatggagtttgggctgaggttggtttttccttggtgcttattttaaaaggtgtccattgtgaagtgcccctggtacaatcgtgggggaggcttgggtcaaggccgggggacgtccctggagactctcctgtgaacgcctcaactnttctactttgctcgtcgccgttgggtcgaccgtgggtcccgccgacggcctaccggaggggacggggcgtgggaggtggtagttggacctagtaagtaacggacaagacctaagtcggccgacgacagcaactaccttactgactccgtacgaaaagacaagtattacatactactcgtacgaggtagtcgtaaccttaccgaacaaccgtacgggttctccttacctaccagttacgtcgaacggaccacgtaccgtaaaagtaaacgtacgggacggaaacaacgacggtaccttaagttactttaacgtgttacggagtacggtagacggtaaccggacccgtaaccgaccgtaccgtttacggtttagggacggtttcggg

SEQ ID NO: 368213 - DNA, 699 bp, Homo sapiens
  misc_feature: GZ8MTXP02JZSQF.13.10.A10.1.454.CMB.2.raw
  modified_base (206)..(206): a, c, t, g, unknown or other
  modified_base (253)..(253): a, c, t, g, unknown or other
tcagtcacgtactacacgaccggtgctcgatttagcgtcgatctcagggggtctcagagaggagccttagccctggactccaaggcctttccacttggtgatcagcactgagcacagaggactcaccatggaattgggctgagctgggttttccttgttgcttattttagaaggtgtccagtgtgaggtgcagctggtggagtcgngggggagcgttggccagccggtgggggtccctgagactcctcgtgcncagcctgtgtacttctacctttagactcttagtggactggacgtccggttcgggccccgaccgcgggtcccgtaccgggagggggaacggggtcgtaggggtacgggtggggtcggaacccgaaagaaacgttaaaggacgtaaggttaggaaacgtaggaaagtaaacttattaaggtgggtcggtacttcgtagggtagggaacggggccttacgttccaacccttactccgtaacccgaaggaaaccgaacccaaacccggacctaaaagtaaccctacttacgtagttaactcgtaagactaaaagtacgaaacgtcggaccgtaggaagaccggacgaggtaccgtacggttcttacgtacttaaattccggaggtacgacggaaggtaacggtggggttaacgggggacgtaaaggtcaggacggaggttacgaaaccgg

SEQ ID NO: 368214 - DNA, 606 bp, Homo sapiens
  misc_feature: GZ8MTXP01DONPO.2.34.D01.1.454.CMB.2.raw
  modified_base (400)..(400): a, c, t, g, unknown or other
  modified_base (446)..(446): a, c, t, g, unknown or other
  modified_base (507)..(507): a, c, t, g, unknown or other
tcagacgctcgacacacgaccggtgctcgatttagatcgtctgtgttgggtttggggtacgatttgatgttacctgattcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacagaatattaacctgttcccatcgactacgcctttcggcctcgccttaggggtcactcaccctgccccgattaacgtggacaggaaccttggtcttcggcgagcgggtctttcgacccgtacgtttactcgttactttagngtcagtcattccgctcttctgactaccctccagcatcgctcacacncacactcacacgactacacacaccctacccctaacccaaccaaccacactaacgcgtcgcncgccgcgacgtcgttcggtcgcgtacgttacggtttaccgtacccgttaccgttcttccgttccgtccgccgacggccgaccgtaaccgaaccgtaacg

SEQ ID NO: 368215 - DNA, 604 bp, Homo sapiens
  misc_feature: GZ8MTXP01EJQ8C.2.34.D01.1.454.CMB.2.raw
  modified_base (264)..(264): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgcccccctccgcgtccgggtctcctggacagtcagtcaccatctcctgcactggaatcagcagtgacctgagtccttataactatgtctctgtaccaacaacaccagcaaacgccccaaatcattattangaagtcacaagcgccctcgagggtccctgatcgcttctctggctccaagtctggcgagaccggcctccctgaccgtctcgtcgggcctcgaggctagaaagatgagctagatttattactgcagctcatatgcgaggcaagacaaacaagtggtagacgtagggttcggggacggggaacgggaacccgaaagccgtacggaccggttacgtcgggtaccgacgaccccgaaaggtcccgtcccggttccccccgtcgggttccctacccgttccgttcccgtttccccgttcccttcccgtcgttcggttaccggcggttccgttcgttcggtccgggg

SEQ ID NO: 368216 - DNA, 529 bp, Homo sapiens
  misc_feature: GZ8MTXP01CKVV5.2.34.D01.1.454.CMB.2.raw
  modified_base (340)..(340): a, c, t, g, unknown or other
  modified_base (393)..(393): a, c, t, g, unknown or other
  modified_base (461)..(461): a, c, t, g, unknown or other
  modified_base (502)..(502): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacacccaggcaaacgcccccaaatcattatttatgaagtcactaagcggccctcgaggggtccctgatcgcttctctggctccaagtctggcgagaccggcctcccngaccgtctcgtcgggcctcgaggctagaaaagatggaggtctgtattattacngcagctacatatgcaggcagcaacaatgtggcaggttcgggacgggagggacaagcctggaccgtcgnggtcagcccgaagctcgcccctggccacgtcttcgttcccnccctcctctcgtcgagcgtcgttgcgg

SEQ ID NO: 368217 - DNA, 608 bp, Homo sapiens
  misc_feature: GZ8MTXP01D0EL8.2.34.D01.1.454.CMB.2.raw
  modified_base (267)..(267): a, c, t, g, unknown or other
  modified_base (367)..(367): a, c, t, g, unknown or other
  modified_base (389)..(389): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgcccccctccgcgtccgggtctcctggacagtcagtcaccatctcctgcactggaatcagcagtgacctgagtccttataactatgtctcctggtaccaacaacaccaggcaaacgccccaaatcattattangaagtcactaagcggccctcgagggtccctgactcgcttctctggctccaagtctggcgagacggcctcctgaccgtctctcgggctcgaggctgaaagntgagctagattatatgcagctnatatgacaaggcagacaaacaagtgagctaagggttcggggcgggaaagggacccgtaaaggccgtacggtaacccgttccgtggggtccaacgggccccgaaacggggtccttcccggccccccgttcgggttcctacccgtttccgttcccggtttcccccaccccgtttccctccgttccggttccgcggttccggttccgttggggaacccgggg

SEQ ID NO: 368218 - DNA, 517 bp, Homo sapiens
  misc_feature: GZ8MTXP01DA4JK.2.34.D01.1.454.CMB.2.raw
  modified_base (266)..(266): a, c, t, g, unknown or other
  modified_base (511)..(511): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcacgccccctccgcgtccgggtctcctggacagtcagtcaccatctcctgcactggaatcagcagtgacctgagtccttataactatgtctcctggtaccaacaacaccaggacaaagccccaaactcattattangaagtcactaagcgccctcgaggggtccctgatcgcttctctggctccaagtctggcgagacggcctccctgaccgtctcgtcgggctcaggctgaaagatgagctagattatactgcagctcatatgcaggcagacaaacaatggtagcaggttcgggcggaggaccaagctgaccgtccgtgggtcagcccaaggctcgcccctggctactcttcgttcccaccctcctctcgtcgcgctcgngaacgg

SEQ ID NO: 368219 - DNA, 591 bp, Homo sapiens
  misc_feature: GZ8MTXP01CI7RS.2.34.D01.1.454.CMB.2.raw
  modified_base (266)..(266): a, c, t, g, unknown or other
  modified_base (372)..(372): a, c, t, g, unknown or other
  modified_base (392)..(392): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcacgcccccctcgcgtccgggtctcctggacagtcagtcaccatctcctgcactggaatcagcagtgacctgagtccttataactatgtctcctggtaccaacaacacccaggcaaacgccccaaatcattattangaagtcaactaagccgccctgacggggtccctgatcgcttctctggctccaagtctggcgagaccggcctccgtgaccgtctcgtcgggcctcgaggctagaaagntgaggtctgtattagttacngactagctacatatgcgaggcagacaaactaagtggtcggtactaacggggttcggggacggggacgggaaccgaagccgtacggacccgtcgtacgggtccacggtccccgaaggtcctccgcccccgttcggcctaccgttcgttccgttccttccgtccccttcgtccgttcgacgttccgtcgttaacggccggg

SEQ ID NO: 368220 - DNA, 521 bp, Homo sapiens
  misc_feature: GZ8MTXP01A6ELQ.2.34.D01.1.454.CMB.2.raw
  modified_base (370)..(370): a, c, t, g, unknown or other
  modified_base (387)..(387): a, c, t, g, unknown or other
  modified_base (509)..(509): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacacccaggcaaacgcccccaaatcattatttatgaagtcactaagcggccctcaggggtccctgatcgcttctctggctccaagtctggcgagacggcctccctgacccgtctctcgggctccgaggctgaaagntgaggctgattattacngcagctcatatgcaggcagcaacatgtgcaggttcggcggaggaccaagctcgaccgtccgtgggtcacgcccaaggcctcgcccctcggttcacgtcttcgttccccgcctcctctgtcgngcgtcttggcgg

SEQ ID NO: 368221 - DNA, 549 bp, Homo sapiens
  misc_feature: GZ8MTXP01C1PBO.2.34.D01.1.454.CMB.2.raw
  modified_base (212)..(212): a, c, t, g, unknown or other
  modified_base (263)..(263): a, c, t, g, unknown or other
  modified_base (282)..(282): a, c, t, g, unknown or other
  modified_base (420)..(420): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgccccctccgcgtccgggtctcctggacagtcagtcaccatctcctgcactggaatcagcagtgacctgagtccttanaactatgtctctgtaccaacaacaccagcaaacgccccaaatcattattangaagtcacaagcggccctnagggtccctgatcgcttctctggcctccaagtctggcgagccggcctcctgaccgtctctcggggcctcagggcctagaaaacgatgagggctagtaattagttactgcagtctcatatgacaggcagacaacaatgngcaggtcggcggagggaccaagtctcgaccgtccgtggtacacgcccgaaggcctacggcccccgtcggcctaccgtccgttaccgttccccaccccttcctctcggtccgagttccgtccgttgcggg

SEQ ID NO: 368222 - DNA, 609 bp, Homo sapiens
  misc_feature: GZ8MTXP01A8KNI.2.34.D01.1.454.CMB.2.raw
  modified_base (560)..(560): a, c, t, g, unknown or other
tcagacgctcgacacacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgccttcggcctcgccttagggtcactcaccctgccccgattaacgtgacagacccttggcttccggcgagcggcttttcaccgtctttatcgtttacttatgtcagtctaattcgctacttctgactacctcagccatcgccctcacacgccaacctaccttcaccacggaccttaacaacgtaaaccgcctaccccctaaacccaaaccaaacgccaacgtaacgcgtccgctcggcccgcacgtcttcggcgtcttagttcggtttacnccccgttacttacgtcctccggcgcgacggcccgtaacgttccggaacg

SEQ ID NO: 368223 - DNA, 525 bp, Homo sapiens
  misc_feature: GZ8MTXP01EJ1B2.2.34.D01.1.454.CMB.2.raw
  modified_base (378)..(378): a, c, t, g, unknown or other
  modified_base (385)..(385): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacacccaggcaaagccccaaatcattattatgaagtcactaagcggccctcgaggggtccctgatcgcttctctggctccaagtctggcgagacggcctcctgaccgtctctcgggctcaggctgaaagatgagctgattatacngcagctnatatgcaaggcagacaaacaatgtaggacaggttcgggacgggagggacccaaaggcgtcgaccgtccgtgggtcacgcccaaggctcgcccctcggttcactcttcgttcccaccctctctgtcgagcgtcgttcgcgg

SEQ ID NO: 368224 - DNA, 730 bp, Homo sapiens
  misc_feature: GZ8MTXP01C3ANJ.2.34.D01.1.454.CMB.2.raw
tcagacgctcgacacacgaccggtgctcgatttagatcgtctgtgttgggtttggggctttgcctgggctctgctcctcctcaccctcctcactcagggcacagggtcctgggcccagtctgccctgactcagcccccctcgcgtccggtctcctggacagtcagtcaccatctcctgcactggaatcagcagtgacctgagtccttataactatgtctcctggtaaccaaacaacacccaggacaaaacgcccccaaactcaattatttaatgaagtacacgtaaagccggccctcgacggggtccctgactcgcttctctcggctccaaagtctggcgaacgaccggccttccctgacccgtctcgtcggggcctaccgaggcctaggaaaaagagtcggaagggtccttagtaacttttaacgttaccgtgacgtactctactagtagtacgacgaaggacgaagaaccaaagtaagtcggtacggtacgtaacggggttaccggggacggggtaaacgggaacccgtaaacggtccggttaccggtacccggttaccggtacggggtacccgaaccggtaaccccggaacgggtccccgttccccggttacccccggtttaccggttacccgttacccgttcccgtttaccccggttccccccttaccccgtttccgttccggtaacggtccggtacggttccggttccgttaacggggtaacggg

SEQ ID NO: 368225 - DNA, 558 bp, Homo sapiens
  misc_feature: GZ8MTXP01AMD8B.2.34.D01.1.454.CMB.2.raw
  modified_base (370)..(370): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacacccaggcaaacgcccccaaactcattatttatgaagtcactaagcggccctcgaggggtccctgatcgcttctctggctccaagtctggcgagaccggcctccctgaccgtctctcgggctcaggctgaaagntgagctgtattatactgcagctcatactgcaggcagacaacgatgtgcaggttcgggcggagggaccaagctggaccgtcccgtgggtccacggcccaagggcctccggcccccgtcgggccgtacccttcgttccgttccccaccccttcctctaacggttcgcggttccgttcgttcggaaccggg

SEQ ID NO: 368226 - DNA, 542 bp, Homo sapiens
  misc_feature: GZ8MTXP01DJQ5F.2.34.D01.1.454.CMB.2.raw
  modified_base (266)..(266): a, c, t, g, unknown or other
  modified_base (284)..(284): a, c, t, g, unknown or other
  modified_base (368)..(368): a, c, t, g, unknown or other
  modified_base (415)..(415): a, c, t, g, unknown or other
  modified_base (513)..(513): a, c, t, g, unknown or other
  modified_base (538)..(538): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcacgcccccctccgcgtccgggtctcctggacagtcagtcaccatctcctgcactggaatcagcagtgacctgagtccttataactatgtctcctggtaccaacaacaccaggcaaacgccccaaatcattattangaagtcacaagcgccctnagggtccctgatcgcttctctgctccaagtctggcgagaccggcctccctgacccgtctcgtcgggcctcgaggctaggaaaanatggagcttagatttattactgcagctacatatgcaggcagacaaanagtgtgctagggtcggacggaacgacgaagcgtacgaccgtcgtcggtaccacgacccgaacgcctccgcccctcgttcctcctccttccgttccccnccctcctcgtcgtcgcgttcgtcgngcgg

SEQ ID NO: 368227 - DNA, 582 bp, Homo sapiens
  misc_feature: GZ8MTXP01DXP6S.2.34.D01.1.454.CMB.2.raw
  modified_base (263)..(263): a, c, t, g, unknown or other
  modified_base (372)..(372): a, c, t, g, unknown or other
  modified_base (419)..(419): a, c, t, g, unknown or other
  modified_base (424)..(424): a, c, t, g, unknown or other
  modified_base (544)..(544): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctctgtaccaacaacaccaggacaaacgccccaaatcattattangaagtcaactaagccgccctgacggggtccctgactcgcttctctgctccaagtctggcgacgaccggtcctccctgacccgtctcgtcgggcctcgaggctagaaagntgaggctgtaatttatacgtgcagtctcatatgcaggcagaccaaanaatgnggctagggttcgggacgggaagggaacccaaggtcctacggacccgttccgtggggtccaacgccccaaggccctccggttccccctcgggttccctaccgttccttccggttacccccncccttcctcgtcgtcgacgttccgtcgttggaaccggg

SEQ ID NO: 368228 - DNA, 630 bp, Homo sapiens
  misc_feature: GZ8MTXP01BBDAM.2.34.D01.1.454.CMB.2.raw
tcagacgctcgacacacgaccggtgctcgatttagatcgtctgtgttgggtttgggggctttgcctgggctctgctcctcctcaccctcctcactcagggcacagggtcctgggcccagtctgccctgactcacgccccctccgcgtccgggtctcctggacagtcagtcaccatctcctgcactggaatcagcagtgacctgagtccttataactatgtctcctgtaccaacaacaccaggcaacgccccaaatcattattatgaagtcactaagcggccctcgagggtccctgactcgcttctctggctcaagtctggcgagcgcctccctgaccgtctctcgggctcgaggctagaaagatgagctagatttattactgcagtctacatagtgacgaggcaacgaaccaaagaagtcggtaggacgtacggggttcggggacggggaacgaaccgaagtccgtaccgaccgttcggtcggtaccgacggtaccccggaaggtcccgtccccggttcccccggttcgggacccttaccggttcccttaccccggttccccttacccccgtttcccttccggtccgggtcccggtacggttccccggtttcgggttcgggtcccggggg

SEQ ID NO: 368229 - DNA, 585 bp, Homo sapiens
  misc_feature: GZ8MTXP01AFIKE.2.34.D01.1.454.CMB.2.raw
  modified_base (356)..(356): a, c, t, g, unknown or other
  modified_base (371)..(371): a, c, t, g, unknown or other
  modified_base (384)..(384): a, c, t, g, unknown or other
  modified_base (431)..(431): a, c, t, g, unknown or other
tcagacgctcgacacacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggcaacatagccttctccgtcccccttcgcagtaacaccaagtacaggaatattaacctgtttcccatcgactacgcctttcggcctcgccttaggggtcactcaccctgccccattaacgtgacaggacccttggcttcggngagcggctttcaccnttatcgtacttangtcagcaattcgctactctgactacctccagtcattcgcctcacacncacaccttcacacggacttacacgaacacctcccctacccaaccaaccgacacaacgcgcgccgtcgccgcgcgtcgtcgttcgtcgttacgttacgttaccgttcccgttacttactccgtccgtccgcgacggaccgtccgttccgtaaccg

SEQ ID NO: 368230 - DNA, 618 bp, Homo sapiens
  misc_feature: GZ8MTXP01AQYZ9.2.34.D01.1.454.CMB.2.raw
  modified_base (263)..(263): a, c, t, g, unknown or other
  modified_base (294)..(294): a, c, t, g, unknown or other
  modified_base (305)..(305): a, c, t, g, unknown or other
  modified_base (372)..(372): a, c, t, g, unknown or other
  modified_base (405)..(405): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctctgtaccaacaacaccaggcaaacgccccaaatcattattangaatcactaagccggccctcgacgggtcccngatcgctttcnctggctcaagtctggcgagaccggcctcccgtgaccgtctcgtcggggcctccgaggcctagaaagntggagctagactttattactgaccagctcaatntgcgtaggcaagacaaacgagtcggtacgacgtaggggttacggggacggggaacgggaacccgaaaggtccgtacggaaccggttaccggtcggggtaccaacggcccgaacgggtccctcccggcccccggtggttacctaccgttccgttcccggttccccttcccgttcctcgttccggtaccggcgttccggttcgcgggtaaccggg

SEQ ID NO: 368231 - DNA, 751 bp, Homo sapiens
  misc_feature: GZ8MTXP01ES3VE.2.34.D01.1.454.CMB.2.raw
  modified_base (266)..(266): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctgtaccaacaacaccaggacaaacgccccaaatcattattangagtcacaagcggccctcgagggtcctgatcgcttctctggctccaagtctggcgacgaccggtcctcctcgaccgtctcgtcgggcctccgagggtctaggaaaacgagtggaagggcttaggtaattttaacttaaccgtgggtcctacgtcctactaattacgtacggaccgaagggacaaacggacctaaacgaaagttgggtacgggtaccttaacgggggtttaccgggggaacgggggtaaacgggggaacccctaaaggcccgtacgggtaaccccggtacccgggttgggggtaccccaacgggtacccccggaaacggggtccccgttccccggttaccccccccgggtttcggggttcccctaaacccgttttcccggttaccccgtttccccccccttaaccccgttttcccccgttcggtttcccggttccgggacgggttcccggtttccggttccggggtaacccggggg

SEQ ID NO: 368232 - DNA, 580 bp, Homo sapiens
  misc_feature: GZ8MTXP01CP5NL.2.34.D01.1.454.CMB.2.raw
  modified_base (314)..(314): a, c, t, g, unknown or other
  modified_base (328)..(328): a, c, t, g, unknown or other
  modified_base (354)..(354): a, c, t, g, unknown or other
  modified_base (378)..(378): a, c, t, g, unknown or other
  modified_base (572)..(572): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcacgccccctcgcgtccgggtctcctggacagtcagtcaccatctcctgcactggaatcagcagtgacctgagtccttataactatcgtctcctaggtaaccaacaacacccaggaccaaacgccccaaatcatttattatgaacgtcactaagcggccctgacgggtccctgactcgctttcnctgctccgaagtcnggcgagaccggcctccgtgacccgtntcgtcggcctcgaggctagaaagntgagtctgtattatactgcagtctacatatgcaggacagacaaactagtgtagacgtagggttcgggagggacggaaccgaagccgtacgaccgtccgtcgggtcgacgcccgaacggcctacccggccccgtcggacctccgtccttccgttcccccacccttccgtcgtaacgttccggacgttccgttcgnggtccggg

SEQ ID NO: 368233 - DNA, 539 bp, Homo sapiens
  misc_feature: GZ8MTXP01DDBSS.2.34.D01.1.454.CMB.2.raw
  modified_base (267)..(267): a, c, t, g, unknown or other
  modified_base (508)..(508): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacacccaggcaaacgccccaaatcattatttangaagtcactaagcggccctcgaggggtccctgatcgctttctctggctccaagtctggcgagacggcctccctgaccgtctctcgggcctccgaggctagaaaagatggaggtctagtatttattactgcagctcatatgacaggcagcaaacaatgtgcaggttcggcgggaacggaccaagcgtcgaccgtcgtcggtcacgcccaaggctcgcccctcggttcactcttccgttcccncccgtcctcgtcgtcgcgttcgtcgttgcgg

SEQ ID NO: 368234 - DNA, 537 bp, Homo sapiens
  misc_feature: GZ8MTXP01A7PN3.2.34.D01.1.454.CMB.2.raw
  modified_base (362)..(362): a, c, t, g, unknown or other
  modified_base (387)..(387): a, c, t, g, unknown or other
  modified_base (390)..(390): a, c, t, g, unknown or other
  modified_base (503)..(503): a, c, t, g, unknown or other
  modified_base (520)..(520): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgccccctccgcgtccgggtctcctggacagtcagtcaccatctcctgcactggaatcagcagtgacctgagtccttataactatgtctcctgtaccaacaacaccaggcaaacgccccaaatcattattatgaagtcactaagcgccctcgacgggtccctgatcgcttctctggctcaagtctggcgagaccgcctcctgaccgtctctcgggctcgagctgaaagntgagctgattatactgcagctcatntgnaggcagcaaacagtgtgcaggttcggacgggacggacaagccgtcggaccgtcgtcggtccacgcccgaagggtcctccggcccctcggttcaccgttcttacccgttccccncccgttcctctcgtcgngttccgtgttcggcggg

SEQ ID NO: 368235 - DNA, 679 bp, Homo sapiens
  misc_feature: GZ8MTXP01CK6Z8.2.34.D01.1.454.CMB.2.raw
  modified_base (265)..(265): a, c, t, g, unknown or other
  modified_base (296)..(296): a, c, t, g, unknown or other
  modified_base (400)..(400): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctctaggtaccaacaacaccagacaaacgccccaaatcattattangaagtcactaagcggccctcgacgggtcccngactcgcttctcgtggctccgaagtctggacgacgaccggcctaccgtgaccgtctcgtcgggcctcgaggctaggaaacgatggagtcttagaatttactacngcagtctacatgtgacgagggcaagactaaacgaagttggacgacgtaaggggtttaccggggaccggggaaacgggaacccgaaaggccgttacgggaacccggttacccggttgggggtacccaaccggtaccccgaaacggggtcccttccccgggccccccgttacgggttcccctaaccccgttcgttaacccccggtttcccccttacccccggtttcccttccgttaacccgggttccggacggttcccggttcggttcgggtaaccggggg

SEQ ID NO: 368236 - DNA, 713 bp, Homo sapiens
  misc_feature: GZ8MTXP01AEW95.2.34.D01.1.454.CMB.2.raw
  modified_base (262)..(262): a, c, t, g, unknown or other
  modified_base (375)..(375): a, c, t, g, unknown or other
  modified_base (395)..(395): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgccccctcgcgtccgggtctcctggacagtcagtcaccatctcctgcactggaatcagcagtgacctgagtccttataactatgtctctgtaccaacaacaccagacaaacgccccaatcattattangaagtcactaagcggccctcgaggggtccctgactcgctttcgtctcggctaccaagtctggcgagaccggcctccctgacccgtctcgtcggggcctcgaggctagaaacgntggagctagtatttattacngcagctcatgtgcgacggcaagaccaaagaagttggtacgggtacgtaacggggtttcgggggaccggggtaaagggaaccccgtaaaggtccggtacggtaccccggttccgggttacggggtacccaaccgggacccctaaagggggtccccgttacccgggttccccccccgggtttacggggttccctaaccccgtttcccggttccccggttttccccccccgggttccccttttaacccccgtttcgggttcccgggttaacccgggtaccggggttcccgggtttaacccgttcgggggtaaccccggggg

SEQ ID NO: 368237 - DNA, 612 bp, Homo sapiens
  misc_feature: GZ8MTXP01CCLJ0.2.34.D01.1.454.CMB.2.raw
  modified_base (265)..(265): a, c, t, g, unknown or other
  modified_base (378)..(378): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacaccaggcaaacgccccaaatcattattangaagtcactaagcggccctcgaggggtccctgactcgctttctctggctccaagtctggcgagaccggcctcccgtgacccgtctcgtcggggcctcgaggcctaggaaacgntggaggtctagtatttattactgccagctacgatatgcgaggcagacaaacaagtgagctagggttcgggacgggacggaccaagccgtcgaccgtccgtgggtaccacggcccgaagggtccctccggcccccgtacgggttccctaaaccgttcccgttcccgttccccttaccccgttcccgttcccgttcggttcccggacggttcccggttcgttcgggtaacccgggg

SEQ ID NO: 368238 - DNA, 554 bp, Homo sapiens
  misc_feature: GZ8MTXP01DQ3VZ.2.34.D01.1.454.CMB.2.raw
  modified_base (265)..(265): a, c, t, g, unknown or other
  modified_base (305)..(305): a, c, t, g, unknown or other
  modified_base (343)..(343): a, c, t, g, unknown or other
  modified_base (365)..(365): a, c, t, g, unknown or other
  modified_base (380)..(380): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacaccaggcaaacgccccaaatcattattangaagtcactaagcgccctgaggggtccctgactcgcttcnctggctccaagtctggcgagaccggcctcctgaccgtncgtcgggctcgaggctgaaagntgaggctgattatcngcagctcatatgcgaggcagacaacgaatggtagcaggttcgggacggaaggggaccaagcgtacgaccggtccgtgggtccgacgcccgaggccctcggcccccgtcggttcctaccgttccgttccgttcccccgttcccgttccctcgtcgttcgcgcgtcgttggccggg

SEQ ID NO: 368239 - DNA, 556 bp, Homo sapiens
  misc_feature: GZ8MTXP01BRAAJ.2.34.D01.1.454.CMB.2.raw
  modified_base (265)..(265): a, c, t, g, unknown or other
  modified_base (368)..(368): a, c, t, g, unknown or other
  modified_base (385)..(385): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgcccccctccgcgtccgggtctcctggacagtcagtcaccatctcctgcactggaatcagcagtgacctgagtccttataactatgtctcctgtaccaacaacaccagcaaacgccccaaatcattattangaagtcactaagcggccctcgaggggtccctgatcgcttctctggctccaagtctggcgacgacggcctccctgaccgtctcgtcggggctcgaggctgaaantgagctgatttattacngcagctcatatgcaggcagacaacaagtgtagctagggttcgggcgggaagggaccaaggcctaggacccgttcgtgggtccacggcccgaaggctccgttccccgtcggttccaccttcttccgttccccaccccttcctctccggtcgacgttccgtcgttggaacggg

SEQ ID NO: 368240 - DNA, 667 bp, Homo sapiens
  misc_feature: GZ8MTXP01A3UDE.2.34.D01.1.454.CMB.2.raw
  modified_base (267)..(267): a, c, t, g, unknown or other
  modified_base (376)..(376): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacaccaggacaaacgccccaaatcattattangaagtcaactaagccggccctgacgggtccctgactcgcttctctggctaccaagtcgtggcgagaccggtcctccgtgaccgtctcgtcggcctcgaggctagaaagntggaggtcttagtaactttagttactggactacgtctactaagttagtcggacgaacgggaccaaaggaacctaaaacgtaagttcgggtacgggtaacgtaacgggggtttcgggggaacggggaaacgggaaccctaaaggtccgtaccggtaacccggtccggtcggggtaccaccggaccccgaacgggtcccgtcccggttccccccgtacggttcctaacccgttccgttaccccgttccccaccccgttctccgtcggtcgacgttccggtcgttcggtccggg

SEQ ID NO: 368241 - DNA, 683 bp, Homo sapiens
  misc_feature: GZ8MTXP01DKYIJ.2.34.D01.1.454.CMB.2.raw
  modified_base (282)..(282): a, c, t, g, unknown or other
  modified_base (323)..(323): a, c, t, g, unknown or other
  modified_base (436)..(436): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgcccccctcgcgtccgggtctcctggacagtcagtcaccatctcctgcactggaatcagcagtcgacctgattccttaataactatcgtctcctaggtaacccaaacaaccaccgaggaccaaaacgcccccaaaatctaattattangaatcactaagccgccctcgacgggtcctgactcgtcttcncgtggctccgaagtctgggacgacgaccggtccctaccgtcgacccgttctccgtcggggcctaccgaggtctaggaaagacgtggacgtctagtattactactgcagtctanatgtgcaaaggcaacgacaaactagtggtagtaccgtaggggttaccggggacgggggaaaccgtaaccgaaacgtccgttaccggacccgttaccgtcggggtacccaacgggccccgaacggtccgttccccggttacccccgttagggttacccctaccgtttcccgttaaccccgtttccccaacccgtttcccgtacgttcggttaaccgggcggttccgttcggttaacgggaacccgggg

SEQ ID NO: 368242 - DNA, 663 bp, Homo sapiens
  misc_feature: GZ8MTXP01D56AL.2.34.D01.1.454.CMB.2.raw
  modified_base (248)..(248): a, c, t, g, unknown or other
  modified_base (266)..(266): a, c, t, g, unknown or other
  modified_base (380)..(380): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgccccctccgcgtccgggtctcctggacagtcagtcaccatctcctgcactggaatcagcagtgacctgagtccttataactatgtctctagtaccaacaacaccagacaaacnccccaaatctattattangaagtcactaagcggcctcgacgggtccctgactcgcttctcgtgcctaccaagtctgggacgacgaccggtccctccgtgaccgtctcgtcgggcctacgaggctagaaaagntggaggtctagtaatttactacgtgactagctacgtaatagtcgacgaaggacaaggaaccaaacgtaaagttgggtacggtaccgtaaacgggggtttccggggaacggggtaaacggggtaacccgttaaaggttccggtaaccccggttcggtacggggtaccgtaaccggacccgtaacggccgtaaccccggtccccgttcggttacccttacgttcccgttcccgttccccgcccttccgtccgtcggttccgacggtcgttcgtcggcggtccggg

SEQ ID NO: 368243 - DNA, 647 bp, Homo sapiens
  misc_feature: GZ8MTXP01AY8O2.2.34.D01.1.454.CMB.2.raw
  modified_base (266)..(266): a, c, t, g, unknown or other
  modified_base (308)..(308): a, c, t, g, unknown or other
  modified_base (385)..(385): a, c, t, g, unknown or other
  modified_base (412)..(412): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgcccccctcgcgtccgggtctcctggacagtcagtcaccatctcctgcactggaatcagcagtgacctgagtccttataactatgtctcctgtaccaacaacaccaggacaaacgccccaaatcattattangaatcactagccgccctcgacgggtccctgactcgtctttcncgtcggcctaccaagtcgtgggcgacggaccggtccctccgtgacccgtctcgtcgggcctcgaggtctaggaaagntcggaggtcttagtaatttagttacgngacacgtctactatagcgacgacggacaacgaacaaacgtagtcggtacggtacgtacgggggttaccggggacggggaaccggaaccgaacggtccgtaccggtacccggtccggtcggtaccgaccgtacccggacggtcccgtccccggttccccgtcggttccgtaccgttcccgttcccggttccccttcccgttccgtcgtcggtcgtcgttccgtcggttcgggccgg

SEQ ID NO: 368244 - DNA, 381 bp, Homo sapiens
  misc_feature: GZ8MTXP01AP7X6.2.34.D01.1.454.CMB.2.raw
  modified_base (352)..(352): a, c, t, g, unknown or other
  modified_base (375)..(381): a, c, t, g, unknown or other
tcagacgctcgacacacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtcccccttcgcagtaacaccaagtacaggaatattaacctgttcccatcgactacgcttcgctcgccttagggcactcaccctgccccgatacgtgacaggaacccttggcttccggngagcggctggcaaggcgcatagnnnnnnn

SEQ ID NO: 368245 - DNA, 604 bp, Homo sapiens
  misc_feature: GZ8MTXP01C2JFD.2.34.D01.1.454.CMB.2.raw
  modified_base (432)..(432): a, c, t, g, unknown or other
  modified_base (452)..(452): a, c, t, g, unknown or other
  modified_base (471)..(471): a, c, t, g, unknown or other
  modified_base (549)..(549): a, c, t, g, unknown or other
tcagacgctcgacacacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggcaacatagccttctcccgtcccccttgcagtaacacaagtacagaatattaacctgttcccatcgactacgccttcggcctcgccttaggggtcactcaccctgccccgatacgtgacaggaccccttggtcttccggcgagcgggcttttcgacccgtcgtttatccgttaacttatgtcagtctaattcgctacttctgactaccctcagcagtncctcacagcaactaccttanactaggcttaacagaaccnctacccctaccaaacacgctaataagccgtacgctcgcccgcacgcttacggttcgcttaacgtcgggttttaacccnccccgtttattccgttcctccggcgaccgacggttacccgtaaccgttccgaacg

SEQ ID NO: 368246 - DNA, 664 bp, Homo sapiens
  misc_feature: GZ8MTXP01CHX6U.2.34.D01.1.454.CMB.2.raw
  modified_base (218)..(218): a, c, t, g, unknown or other
  modified_base (268)..(268): a, c, t, g, unknown or other
  modified_base (385)..(385): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgccccctccgcgtccgggtctcctggacagtcagtcaccatctcctgcactggaatcagcagtgacctgagtccttaataactntgtctcctagtaccaacaacaccagacaaacgccccaaatctattattangaagtcaactaagcggccctcgacgggtccctgactcgtcttctctcggctccaagtctggacgacgaccggtcctccgtcgaccgtctcgtcgggcctcgaggtctaggaaaacgngtggacgggtcttaggtaatttacgttacgtgacctagtcctacaagtagtcgacgaacggacaagaccaaacgtaagtgtacgggtactaggggttccggggacggggtaacgggaaccgaacggcgtaccggaccgttccggtgggtaccgaccggtacccgaagggtcccttcccggcccccgttacggttcccttacccgttcccgttacccgttcccccttacccgttcccgttccgtcggtccggtacggttccggtcgttaacgggccgggg

SEQ ID NO: 368247 - DNA, 607 bp, Homo sapiens
  misc_feature: GZ8MTXP01DA633.2.34.D01.1.454.CMB.2.raw
  modified_base (272)..(272): a, c, t, g, unknown or other
  modified_base (314)..(314): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcacgcccccctcgcgtccgggtctcctggacagtcagtcaccatctcctgcactggaatcagcagtgacctgagttccttaataactatgtctcctggtaaccaacaacaccaggaccaaacgccccaaatctaattattangaagtcaactaagcgccctcgacggggtccctgatcgcttcnctggctccaagtctggcgacgaccggcctcctgaccgtctcgtcgggcctcgaggcctagaaaacgatggaggtctagtatttatactgcagtctacatatgacgaggcaagacaaacgaagtggtacgacctaggggtttaccggggacgggaacgggaccgaaggtcctcggaccgttccggtgggtaccacggaccccgaaggtccctcgttcccccgtcggttcctaaccgttccttacccgttccccttaccccgttctctcggtacgcgttcgtcgttcggaacggg

SEQ ID NO: 368248 - DNA, 701 bp, Homo sapiens
  misc_feature: GZ8MTXP01DLQ7F.2.34.D01.1.454.CMB.2.raw
  modified_base (263)..(263): a, c, t, g, unknown or other
  modified_base (289)..(289): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgccccctccgcgtccggtctcctggacagtcagtcaccatctcctgcactggaatcagcagtgacctgagtccttataactatgtctcctgtaccaacaacaccaggcaaagccccaaatcattattangagtcactagcgcctcgagggtcccngatcgtcttctctcggctccgaagttctggcgagaccggcctccgtcgaccgttctcgtcgggcctaccgaggtcctaggaaaacgtatcggaagggtcctagtactttagttacgtggactacgtctcaattacgtgacgtaagggacacgacaaacgtaagtggtacggaccgttagggggttaccggggcggggaaacggggaacccgaaacgtccgtacggtaaccccggttccggttcggggtacccgaaccgggaccccgtaaacggggtcccgtacccggttcccccccggttcgggttacccttacccgtcccgtttccccggtttcccccgttaccccctttcccttcccggttccggttacccgggtacggttccccggttcggttccgggtaacccggggg

SEQ ID NO: 368249 - DNA, 574 bp, Homo sapiens
  misc_feature: GZ8MTXP01AXBYZ.2.34.D01.1.454.CMB.2.raw
  modified_base (266)..(266): a, c, t, g, unknown or other
  modified_base (294)..(294): a, c, t, g, unknown or other
  modified_base (304)..(304): a, c, t, g, unknown or other
  modified_base (387)..(387): a, c, t, g, unknown or other
  modified_base (399)..(399): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctgtaccaacaacacccagacaaacgccccaaatcattattangaatcacaagcggccctgacgggtcccngatcgcttcnctggctcaagtctggcgagccggcctcctgaccgtctcgtcgggcctcgaggctagaaagatggaggtctagtatttactacngcagctacatancgacaggacagacaaacagtgtagactaggggttcggggacggaaggaccaagccgtacgaccgttccgtcgggtacgacgcccgaaggcctccggccccgtcggttcccaccgttccttcccggttccccgccccttcgtccgtcggtccggacgttccggtgttcgggtcggg

SEQ ID NO: 368250 - DNA, 660 bp, Homo sapiens
  misc_feature: GZ8MTXP01DEYQJ.2.34.D01.1.454.CMB.2.raw
  modified_base (266)..(266): a, c, t, g, unknown or other
  modified_base (431)..(431): a, c, t, g, unknown or other
  modified_base (437)..(437): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacaccaggcaaacgccccaaatcattattanagaagtacactaagcggccctcgacgggtccctgactcgctttcctctggcctaccaagtcgtggacgacggaccggccctcctcgtaccgtcgtcgtcgggcctaccgaggctaggaaaacgagtggacggtcttaggtaatttacttacgtgactagtcctanattagngacgacggacagaccaaagtagtggtacggtactacgggggttccggggaacggggaacggggaaacccaaggtccccgtacggtaccccggttacggttcggggtaaccaccggaaccccgtagggtaacccctcccggttacccccgttcggaccttacccttccgtttcccgttccccttacccgttctccgtcgtacgcgttcgtcgttgggaaccggg

SEQ ID NO: 368251 - DNA, 603 bp, Homo sapiens
  misc_feature: GZ8MTXP01BBV6M.2.34.D01.1.454.CMB.2.raw
  modified_base (264)..(264): a, c, t, g, unknown or other
  modified_base (402)..(402): a, c, t, g, unknown or other
  modified_base (413)..(413): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgccccctcgcgtccgggtctcctggacagtcagtcaccatctcctgcactggaatcagcagtgacctgagtccttataactatgtctcctgtaccaacaacacccagcaaacgccccaaatcattattangaagtcaactaagccggccctcgaggggtccctgactcgcttctctggctccagtcgtgggcgacgaccggtcctcccgtgaccgtctcgcgggcctcgaggctaggaaagtagtggagtctaggtactttattacgngacacgtctanatagtgacgagacacgacaagtagtggtacgacgtacggggtcggggacggacggacgacgtcgtaccggtaccgtcggtcggtaccgaccggacccgacggtccctcccggttccccgtcggttccgtaccgttcccgttcccgttccccttaccgttcctcgtcgtccgtcgttcgtcggttcggcgg

SEQ ID NO: 368252 - DNA, 700 bp, Homo sapiens
  misc_feature: GZ8MTXP01APD44.2.34.D01.1.454.CMB.2.raw
  modified_base (266)..(266): a, c, t, g, unknown or other
  modified_base (311)..(311): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctctagtaccaacaacaccaggacaaacgccccaaatctattattangaagtcaactaagccggccctcgacgggtccctgactcgctttcnctcggctccgaagtctgggcgacgaccggtccctcccgtcgaccgtctccgtcgggcctacgaggtcctaggaaaacgtgtggaggtcttaggtaactttacttacgtgactacgtactactaatacgtcgacgaggaccaagaaccaaacgtaagtggtacggtacgtacgggggttacggggacggggtaacgggaacccgtaaacggtccgtaccggtacccggttaccggttcggggtacccgaaccggaccccgtaaacgggtcccgtccccggttcccccgttccgggttcccttaacccgtttcccgttccccggttcccccttaccccgtttccttccggttccggtaccggtacggttccggttcgttcgggtcccgggg

SEQ ID NO: 368253 - DNA, 647 bp, Homo sapiens
  misc_feature: GZ8MTXP01A5OSN.2.34.D01.1.454.CMB.2.raw
  modified_base (244)..(244): a, c, t, g, unknown or other
  modified_base (260)..(260): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcacgccccctccgcgtccgggtctcctggacagtcagtcaccatctcctgcactggaatcagcagtgacctgagtccttataactatgtctctgtaccaacacaccagacaacncccaatctattattangaagtcaactacgcggccctgacgggtcctgactcgtcttctctcggcctacgagtcgtggcgagaccgtcctcccgcgaccgtctcgtccgggcctccgaggtctagaaaagtgtgacggtcttagtaatttacgttacgtgacacgtctacgtaatacgtcgacgacgggacaacgaccaaagtagtgggtacgacgttagggggttacggggacggggaacggaacccgaagtccgtaaccggtaccggttccggttacggggtaccctaacgggaccccgtaaggggtcccctcccgggttccccccgtcgggttccttaccccgttcgttaccccgttccccgttcccttcgtacgtcgtcggtacggctcggcggtaacgg

SEQ ID NO: 368254 - DNA, 667 bp, Homo sapiens
  misc_feature: GZ8MTXP01DYVLS.2.34.D01.1.454.CMB.2.raw
  modified_base (267)..(267): a, c, t, g, unknown or other
  modified_base (381)..(381): a, c, t, g, unknown or other
  modified_base (403)..(403): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgccccctcgcgtccgggtctcctggacagtcagtcaccatctcctgcactggaatcagcagtgacctgattccttataactatgtctctagtaaccaacaacaccagacaaacgccccaaatctaattattanagaagtcaactaagccggccctgacggggtccctgactcgtcttctcgtcggctaccaagtcgtggcgaacgccggcctccgtgaccgtctcgtcggctcgaggctagaaaagntggagtctagtatttattacgngactagtctatatagtgacgaggacaacgaacaaagtagtggtacgtacgtagggggttacggggaacgggaacgggaaccgaacggtccgtacggtacccggttaccggtcgggtaccgaaccggacccgtaacgggtcccgtcccggttcccccggttacggttacccgttacccgttcccgttaccccgttcccccttacccgtttcccgttccggttccggtaccggtaccggttccggttaacgggttcgggaaccggg

SEQ ID NO: 368255 - DNA, 660 bp, Homo sapiens
  misc_feature: GZ8MTXP01BUTXG.2.34.D01.1.454.CMB.2.raw
  modified_base (219)..(219): a, c, t, g, unknown or other
  modified_base (272)..(272): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgccccctcgcgtccgggtctcctggacagtcagtcaccatctcctgcactggaatcagcagtcgacctgacttccttaataactntcgtctcctagtaaccaacacaccgagacaaaccgcccaaatctaattattanagaatcaacgaacgccgcctacgacgggtcctaggactcgtcttctcgtcgctccgaagtcgtcgggacgtacggacccgtcccgttccacggtacccgttcgtcggtccgggcctacggaggtactaggaaaacgtgtcggacggtcttagtaactttacgtacgtgaccgtactctactattagcgacgacggacacgaacaaagagttggtacgtcgtacggggtcgggaaggggaacgaaccgtagccgtaccggtaccgtccggtcggtacccacggtacccgaacggtccctcccggttaccccgtcggttcctaccttcccgttacccgttccccaccggttccctacggtcgtaccggcgttccggtcgttaacgccggg

SEQ ID NO: 368256 - DNA, 706 bp, Homo sapiens
  misc_feature: GZ8MTXP01AVKZJ.2.34.D01.1.454.CMB.2.raw
  modified_base (217)..(217): a, c, t, g, unknown or other
  modified_base (267)..(267): a, c, t, g, unknown or other
  modified_base (377)..(377): a, c, t, g, unknown or other
  modified_base (439)..(439): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgcccccctcgcgtccgggtctcctggacagtcagtcaccatctcctgcactggaatcagcagtgacctgagtccttataactntgtctcctgtaccaacaacacccaggacaaacgccccaaatcattattangaagtcactaagccgccctgacgggtcctgactcgcttctctggcctacgagtctggcgtacgccggtccctccgtgaccgttctcgtcgggcctcgaggctagaaaagngtggagtctagtatttacgtacgtgacagtctcaatagtgcgaacggcgaacgaaccgaaanagttcggtacggaccgttaacggggtttcgggggaaccggggtaaacggggaacccgaaacgggtcccgttaccggtaaaccccgggttacccggttcggggtaacccgaacccggacccggtaaaccgggtccccgtaaccccggttccccccggttacgggttaccctaaccccgttcgttccccggttaccccccttacccctttccgttccggttaaccgggtacccgtaccggttcccggttcggttaaccgggtccggggg

SEQ ID NO: 368257 - DNA, 685 bp, Homo sapiens
  misc_feature: GZ8MTXP01CCH64.2.34.D01.1.454.CMB.2.raw
  modified_base (266)..(266): a, c, t, g, unknown or other
  modified_base (310)..(310): a, c, t, g, unknown or other
  modified_base (405)..(405): a, c, t, g, unknown or other
  modified_base (435)..(435): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgccccctcgcgtccgggtctcctggacagtcagtcaccatctcctgcactggaatcagcagtgacctgattccttataactatgtctcctagtaccaacaacaccagacaaacgccccaaatctattattangaacgtcaactaagccgccctgacgggtccctgactcgtcttcncgtcggcctaccgaagttccgtagggaccgacggacccggtcccctcccgtgacccgtctcgtccggggccttaccgagggtcctaggaaaagtntgggacggtcttaggtaactttagttacgngactagtcctacataagtcgacgaacggctaacgactaaacgtagtaggtacggacgttacgggggttacggggaacggggtaacgggaaccgaaacggtccgtaccggtacccggttaccggtcgggtaccgacggtaccccgaacgggtcccgttacccggccccgttcggttccctaccgttcccgttcccgttacccccttcccgttccgttacgtcggtacgcgttcggtccgttggtaaccggg

SEQ ID NO: 368258 - DNA, 621 bp, Homo sapiens
  misc_feature: GZ8MTXP01EU3MJ.2.34.D01.1.454.CMB.2.raw
  modified_base (269)..(269): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgccccctccgcgtccgggtctcctggacagtcagtcaccatctcctgcactggaatcagcagtgacctgagttccttataactatgtctcctgtaaccaacaacaccaggacaaacgccccaaatctattattangaagtcacagcgccctgacgggtccctgactcgtcttctcgtcggctaccagtcgtggcgacgaccgtcctccgtcgaccgtctcgtcggcctcgaggctagaaaagtcgtggagcttagtatttagtactgacagtctatagtacgtgacgaaggacctagacctaaagtagtcgtagaccgtaggggtacggggacggggaacggacaagccgtacggtaccgtcgtacggcctacggcccgtaacggcccgttacccgcccccggtacggttccctaaccgtttcccgttccccgttccccttaccgttccctcggtcgtacgggcgttccggtcgttcgggaaccggg

SEQ ID NO: 368259 - DNA, 685 bp, Homo sapiens
  misc_feature: GZ8MTXP01AWOIP.2.34.D01.1.454.CMB.2.raw
  modified_base (268)..(268): a, c, t, g, unknown or other
  modified_base (427)..(427): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgcccccctcgcgtccgggtctcctggacagtcagtcaccatctcctgcactggaatcagcagtgacctgacgttccttaataactatgtctctgtaaccaacaacaccagacaaacgccccaaatcattattanagaatcactaagccgccctcgacgggtccctgactcgctttcgtcgtcgccttaccgaagtcgtgggaccgtacggacccggtccctacccgtcgtacccgtctcggtcgggcctaccgagggctaggaaagactggagtcttagtactttacttacgngacagtccttacgaattgacgacgtaacgggactaacgacaaacgtagttcgggtacgtacgtaacggggttcgggggaaccgggaaacgggaaccctaaacgggccttaccgggtaacccggttccggtacgggtccgaaccggtacccggaacgggtccccgtacccggttcccccgttcggttacctaccgttcccttcccggttccccttacccgtcttacgtccggtcgacggttccgtcggttcggtccggg

SEQ ID NO: 368260 - DNA, 598 bp, Homo sapiens
  misc_feature: GZ8MTXP01BT5NF.2.34.D01.1.454.CMB.2.raw
  modified_base (267)..(267): a, c, t, g, unknown or other
  modified_base (309)..(309): a, c, t, g, unknown or other
  modified_base (398)..(398): a, c, t, g, unknown or other
  modified_base (406)..(406): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgccccctccgcgtccgggtctcctggacagtcagtcaccatctcctgcactggaatcagcagtgacctgagtccttataactatgtctcctgtaccaacaacacccagacaaacgccccaaatcattatttangaagtcacaacgcgccctcgacgggtccctgactcgctttcnctggcctcaagtctggcgacgaccggtcctcccgtgaccgtctcgtcgggcctcgaggctagaaagagtgaggtctgtaatttattacngcagtctnatatgacgaggcaagacaaacagtgtgactaggggttcggggacgggacggaaccaagtccgtcggaccgtcggtcgggtaccacggcccgtaggccctcccggttccccgtacggttccctaccgttccttccccgttccccttaccccttcctcgtccggtcgacggttccgtaacgttcgggaaccggg

SEQ ID NO: 368261 - DNA, 673 bp, Homo sapiens
  misc_feature: GZ8MTXP01AE72A.2.34.D01.1.454.CMB.2.raw
  modified_base (274)..(274): a, c, t, g, unknown or other
  modified_base (319)..(319): a, c, t, g, unknown or other
  modified_base (335)..(335): a, c, t, g, unknown or other
  modified_base (353)..(353): a, c, t, g, unknown or other
  modified_base (360)..(360): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgccccctcgcgtccgggtctcctggacagtcagtcaccatctcctgcactggaatcagcagtcgacctgacgttccttataactatcgtctcctagtaaccaacaacacccgagaccaaacgccccaaatctattattangaagtcaactaagccgtccctcgacgggtccctgactcgtcttcncgtggctcaagttcgnggcgagaccggcctccgngaccgtntcgtcggcctcgaggtctaggaaatacgtggacgtctagtaactttactacgtgactacgtctactacgtaagtcgacgaacgggacgaacggaacctaaacgtaagttacggtcgggtaacgttacgggggttacggggaaccggggaacgggaaccgtaaacggtccgtaccggtaccggttccgggtacggtccgaaccggacccggtaacggcccgtacccggttccccgtacggttacctaccgttccttcccgttccccacccttccgtacgttccggtcggtaccggcgttcggttcggtccgggg

SEQ ID NO: 368262 - DNA, 662 bp, Homo sapiens
  misc_feature: GZ8MTXP01BRWIG.2.34.D01.1.454.CMB.2.raw
  modified_base (268)..(268): a, c, t, g, unknown or other
  modified_base (413)..(413): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgcccccctcgcgtccgggtctcctggacagtcagtcaccatctcctgcactggaatcagcagtgacctgagttccttataactatgtctcctgtaaccaacaacaccaggacaaacgccccaaatcattattangaatcactaagcgccctgagggtccctgactcgctttctctcggctccaagtcgtgggcgacggacggtccctcccgtgacccgtctcgtcgggcctcgaggctaggaaaacgatggacgggtcttaggtaatttaacgtttacncgctaacgcttacaagtagtcggacgaacgggacaacgacaaacgtaagtggtacggacgtacgggggttacggggcggggaaacgggaccgtaaaggtcccgtcggtaaccccggttcccgttaggggtacccgacggaccccgaagggtcccttcccggcccccgttacgggttccctaccgtttcccgttacccgttccccttaccccttccttcgtcgtccgacgttcgtcgttaacggtcgggg

SEQ ID NO: 368263 - DNA, 582 bp, Homo sapiens
  misc_feature: GZ8MTXP01ENBU4.2.34.D01.1.454.CMB.2.raw
  modified_base (264)..(264): a, c, t, g, unknown or other
  modified_base (303)..(303): a, c, t, g, unknown or other
  modified_base (361)..(361): a, c, t, g, unknown or other
  modified_base (380)..(380): a, c, t, g, unknown or other
  modified_base (392)..(392): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcacgcccccctccgcgtccgggtctcctggacagtcagtcaccatctcctgcactggaatcagcagtgacctgagtccttataactatgtctcctgtaccaacaacaccaggcaaagccccaaatcattattangaatcactaagcgccctcgagggtccctgatcgctttcnctggctcaagtctggcgagacggccttcctgaccgtctctgggcctcgagctgaaagntggagctgatttattacgngcagctacatancgcgaggcaagcaaacagtgtacgctaggggttcgggacgggacgggaccaaggccgtcggacccgttcgtcgggtaccgacgcccgaagggcccttcccggacccccgtcgggttaccacccgtttcgttacccgtttcccccacccttcccgtcgtcggtccgtacgttccggttcgttcggtcgggg

SEQ ID NO: 368264 - DNA, 689 bp, Homo sapiens
  misc_feature: GZ8MTXP01E1MSS.2.34.D01.1.454.CMB.2.raw
  modified_base (265)..(265): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctgtaccaacaacaccagacaaacgccccaaatcattattangaatcacaagcggccctcgacgggtccctgactcgcttctctggcctccgaagtcgtgggacgacgacccggcccttcccgtgacccgttctcgtcggggcctccgaggtctaggaaagagtggagggtctaggtatttagttacgtgacagtctactatacgtgacgacggacaagaccaaacgtacgtcggtaggtaccgtacggggtttccggggaaccggggtacggggaacccgaaacggtcccgtaccggttaccccggttacccgggtcgggtacccgaaccgggaccccgtaaacggggtcccttccccggttccccccgttccgggttccctacccgtttcccgttccccgtttcccccgttaccccttcccgtccgttaacggtccggtacggttccgtaacgttcggccgggg

SEQ ID NO: 368265 - DNA, 676 bp, Homo sapiens
  misc_feature: GZ8MTXP01AZDD8.2.34.D01.1.454.CMB.2.raw
  modified_base (266)..(266): a, c, t, g, unknown or other
  modified_base (489)..(489): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgcccccctccgcgtccgggtctcctggacagtcagtcaccatctcctgcactggaatcagcagtgacctgatccttataactatgtctcctgtaaccaacaacaccagacaaacgaccccaatcattattangaagtcaactagcggaccctgggaccgtcgtgactcgttctctcgcgtcctacgtacgtggtacggacgtaccggtcccgtcccgttaccgtaccggttccgtcgtccggtccggtcccgacggtacgtacggtaaaggaaagttacggtaacggtaccgttagttaagtttaatttacgttacgacgtactacgttccattaacgttcgacgacgaacgganactaaaccgagttacgtagggtacgtacgtacgggggtacggggacgggaaccgaacgtaccgtccgtaacggtcccgtgggtacaccggacgaccgaccgtccgtaccccgttcggtccttcgtaccgtccttaccccttccccgttacgtctacgttcgccgtcgttacgtcggaacggtccggg

SEQ ID NO: 368266 - DNA, 651 bp, Homo sapiens
  misc_feature: GZ8MTXP01AN4XZ.2.34.D01.1.454.CMB.2.raw
  modified_base (198)..(198): a, c, t, g, unknown or other
  modified_base (259)..(259): a, c, t, g, unknown or other
  modified_base (262)..(262): a, c, t, g, unknown or other
  modified_base (265)..(265): a, c, t, g, unknown or other
  modified_base (286)..(286): a, c, t, g, unknown or other
  modified_base (408)..(408): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgcccccctcgcgtccgggtctcctggacagtcagtcaccatctcctgcactggaatcagcagtnacctgatctatactatgtctctgtaccaacaacaccagacaaacgccccaatcattattangancanacgcgcctgacgggtcctagntcgctttctacgtcgcctacaagtctcgggccgacggacccgtccctcccgtcgtacccgtctacgtccggggacctccgaggtcctaggaaagtagtggaggtcctagtactttattacgngactagtctactattagcgacgacggactaaggaacaaacgtagttcgggtacgtacgtacgggggtacggggaacgggtaccggaaccgtacgtccgtaccggtcccgttacggtacgggcccgtaaccggtcccgtacggtcccggtccccgttccccggtccgttacctccccgttccgttccccgttccccgttcccttccgttcggtccggtcgtacggttccgtcggttcggccggg

SEQ ID NO: 368267 - DNA, 708 bp, Homo sapiens
  misc_feature: GZ8MTXP01ETJPQ.2.34.D01.1.454.CMB.2.raw
  modified_base (219)..(219): a, c, t, g, unknown or other
  modified_base (221)..(221): a, c, t, g, unknown or other
  modified_base (247)..(247): a, c, t, g, unknown or other
  modified_base (254)..(254): a, c, t, g, unknown or other
  modified_base (263)..(263): a, c, t, g, unknown or other
  modified_base (300)..(300): a, c, t, g, unknown or other
  modified_base (420)..(420): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgccccctcgcgtccggtctcctggacagtcagtcaccatctcctgcacgtggaatcagcagtcgacctgagttaccttataactntntctctagaccaacacaccagacaacncccaatntattattangaatcacgagccgcctgacgggtcctagctcgcttcncgtgccttacgagtcgtcgggacgaccgtaccgtcccttccgtcgacccgttcgtcggtccgggtcctaccgaggctaggaaaagtcgtggtacggtcttaggtaactttactttacggngtaccgagtactacgtagtacgtacggacgaacgtacgaacgtaaaccgtaaagtagtacggtacggtccgttaacggggggtccggggaaaccggggtaaaccggtaaccgtacggttacccggttaccgggtacccggtccgggtacgggtacccgaccggtacccgaccggttcccggttaccccggttccccggttcgttccccgttaccgttccccgttacccgttccccttcccgttcgttcgtcccggtacggtccggttccgttaacggttcgggccggg

SEQ ID NO: 368268 - DNA, 519 bp, Homo sapiens
  misc_feature: GZ8MTXP02GJXOT.2.34.D01.1.454.CMB.2.raw
  modified_base (265)..(265): a, c, t, g, unknown or other
  modified_base (285)..(285): a, c, t, g, unknown or other
  modified_base (294)..(294): a, c, t, g, unknown or other
  modified_base (304)..(304): a, c, t, g, unknown or other
  modified_base (369)..(369): a, c, t, g, unknown or other
  modified_base (424)..(424): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacacccaggcaaacgccccaaatcattattangaagtcactaagcggccctnagggtcccngatcgcttcnctggctccaagtctggcgagaccggcctcccgtgaccgtctcgtcggggcctccgaggctgaagntggagctgattatactgcagctcatatgcaggcagacaacatgtggcagttcggnggaggaccaagcctagaccgtcgtgggtcacgcccgaaggcctcgcccctcggtcactcctccgtccccacctcctctcgtcgagcgtcgcgcgg

SEQ ID NO: 368269 - DNA, 568 bp, Homo sapiens
  misc_feature: GZ8MTXP02HQZDS.2.34.D01.1.454.CMB.2.raw
  modified_base (344)..(344): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacacccaggcaaacgccccaaatcattattatgaagtcactaagcggccctcaggggtccctgatcgcttctctggctccaagtctggcagacggcctccctgacccgtntctgggcctccgagctgaagatgaggtctgatttatactgcagctcatatgcaggcagactaacaatgtaggcaagttcgggacggagggaccaagcgtgaccgtcgtgggtaccacggccccaagggccttaccggccccccgttcgggtaccaccgttccgtaccggtttacccccacccttcccgtcgtcggttccggacgtccggttccgtggtccgggg

SEQ ID NO: 368270 - DNA, 517 bp, Homo sapiens
  misc_feature: GZ8MTXP02F12FH.2.34.D01.1.454.CMB.2.raw
  modified_base (364)..(364): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacacccaggcaaagccccaaatcattattatgaagtcactaagcggccctcaggggtcccctgatcgcttctctggctccaagtctggcgagacggcctccctgaccgtctctgggctccaggctgaagntgaggctgattattactgcagctcatatgcaggcagcaacaatgtggcattcggcggagggaccaagctgaccgtctggggtcagcccaaggcctacgccccctcggtcacctctcgttcccgccctccgtctcgtccgagccgtctcgacgg

SEQ ID NO: 368271 - DNA, 534 bp, Homo sapiens
  misc_feature: GZ8MTXP02J1QLR.2.34.D01.1.454.CMB.2.raw
  modified_base (267)..(267): a, c, t, g, unknown or other
  modified_base (390)..(390): a, c, t, g, unknown or other
  modified_base (451)..(451): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaacgccccaaatcattattangaagtcactaagcggccctcaggggtcccctgactcgctttctctggctccaagtctggcagaccggcctccctgacccgtctcgtcgggcctccgaggctgaagatggagctgattattacngcagctcatatgcaggcagacaacatgtggcagttcggcggagggaccaagctgaccgtcngggtccagcccgaaggcctacgcccccgtacggtccacgtctccgttccccaccctccgtcgtcgtcgacgcgtcgtcgacgg

SEQ ID NO: 368272 - DNA, 559 bp, Homo sapiens
  misc_feature: GZ8MTXP02GBAE1.2.34.D01.1.454.CMB.2.raw
  modified_base (411)..(411): a, c, t, g, unknown or other
  modified_base (524)..(524): a, c, t, g, unknown or other
  modified_base (534)..(534): a, c, t, g, unknown or other
tcagacgctcgacacacgaccggtgctcgatttagatcgtctgtgttgggtttggggtacgatttgatgttacctgattcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcncttctgataccctccagcatgcctcacagcacaccttcacagcttacagaaacgctacccctacccaacaacgcaataacgcgtcgctgccgcagcttcggtgcatcggttanccccgttacnctctcgcgcgacgccgactcgacag

SEQ ID NO: 368273 - DNA, 524 bp, Homo sapiens
  misc_feature: GZ8MTXP02I3M2S.2.34.D01.1.454.CMB.2.raw
  modified_base (370)..(370): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacacccaggcaaagccccaaactcattatttatgaagtcactaagcggccctcaggggtcccctgatcgctttctctggctccaagtctggcgagaccggcctcccctgaccgtctctcggggctccaggctgaagntgaggctgattattactgcagctcatatgcaggcagcaacaatgtaggcagttcggcgggacgggaccaagcctggaccgtcgtgggtcacgcccaaggcctcgccccctcggtccactctcgtccccacctcctctcgtcgagcgtcgtgcgg

SEQ ID NO: 368274 - DNA, 526 bp, Homo sapiens
  misc_feature: GZ8MTXP02JM4T2.2.34.D01.1.454.CMB.2.raw
  modified_base (369)..(369): a, c, t, g, unknown or other
  modified_base (514)..(514): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaatcattattatgaagtcactaagcggccctcaggggtcccctgatcgctttctctggctccaagtctggcagacggcctccctgacccgtctctcggggctccaggctgaagntgaggctgattatactgcagctcatatgcaggcagcaacatgtggcagttcgggcggagggaccaagctaggacccgtcgtgggtacacgcccgaaggcctcgccccctcggtccactcgtcgttccccgcctcctcgtcgtcgngtcgtcgtgcgg

SEQ ID NO: 368275 - DNA, 595 bp, Homo sapiens
  misc_feature: GZ8MTXP02GG394.2.34.D01.1.454.CMB.2.raw
  modified_base (267)..(267): a, c, t, g, unknown or other
  modified_base (287)..(287): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacacccaggcaaacgcccccaaatcattattangaagtcactaagcggccctnaggggtcccctgatcgcttctctggctcaagtctggcgagaccggccctccctgacccgtctcgtcgggcctcgaggcctgaacgatggaggctagtattatactgcagctcatatgcaggcagacaaacaagtgtaggactagttcgggacggaacgggaacccaaggccgtacgtacccggttccgtaggggtccaacgggccccgaaaggtcctaccggtcccccgtcgggtacctaccgttccgtcccgtttcccccggccccttccgttccgttcgtaccgtaccgtcgtcggacggccgggg

SEQ ID NO: 368276 - DNA, 522 bp, Homo sapiens
  misc_feature: GZ8MTXP02GBOEH.2.34.D01.1.454.CMB.2.raw
  modified_base (283)..(283): a, c, t, g, unknown or other
  modified_base (364)..(364): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctctggtaccaacaacacccaggcaaacgccccaaatcattattatgaatcactaagcggccctnagggtccctgatcgcttctctggctccaagtctggcgagaccggcctccctgaccgtctcgtcgggctccgaggctgaagntgagctgattattactgcagctacatatgcaggcagacaacaatgtaggctaagttcgggacggaacgggaccaaagctcgaccgtcgtgggacagcccaaggctcgcccctcggccactcctcgttcctcgccctcgtcgtcgacgtcgtcgtgcgg

SEQ ID NO: 368277 - DNA, 506 bp, Homo sapiens
  misc_feature: GZ8MTXP02FPPWN.2.34.D01.1.454.CMB.2.raw
  modified_base (264)..(264): a, c, t, g, unknown or other
  modified_base (304)..(304): a, c, t, g, unknown or other
  modified_base (379)..(379): a, c, t, g, unknown or other
  modified_base (439)..(439): a, c, t, g, unknown or other
  modified_base (500)..(500): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacacccaggcaaagccccaaatcattattangaagtcactaagcggccctcaggggtccctgatcgcttcnctggctccaagtctggcgagaccggctccctgaccgtctctcgggctccaggctgaagatgagctgattattacngcagctcatatgcaggcagcaaacaatgtggcattcggcgagggaccaagctgaccgtcngggtcagcccaaggctggccccctcggtcactctcgttccccgcctcctgtccagcgtcgngacgcg

SEQ ID NO: 368278 - DNA, 523 bp, Homo sapiens
  misc_feature: GZ8MTXP02GCLD5.2.34.D01.1.454.CMB.2.raw
  modified_base (307)..(307): a, c, t, g, unknown or other
  modified_base (367)..(367): a, c, t, g, unknown or other
  modified_base (506)..(506): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacacccaggcaaagcccccaaatcattattatgaagtcactaagcggccctcgagggtccctgatcgctttcnctggctccaagtctggcagacggcctccctgaccgtctctcgggcctccgaggctgaagntgaggctgattattactgcagctcatatgcaggcagcaacaatgtaggcagttcgggcgggagggaccgaagccgtggacccgtcgtgggtcacgcccgaaggctcgcccctcggtcacgtctacgtcccaccctctcncgtcgacgcgtctgcgg

SEQ ID NO: 368279 - DNA, 550 bp, Homo sapiens
  misc_feature: GZ8MTXP02GFTA8.2.34.D01.1.454.CMB.2.raw
  modified_base (266)..(266): a, c, t, g, unknown or other
  modified_base (286)..(286): a, c, t, g, unknown or other
  modified_base (308)..(308): a, c, t, g, unknown or other
  modified_base (390)..(390): a, c, t, g, unknown or other
  modified_base (418)..(418): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctctggtaccaacaacacccaggcaaagccccaaatcattatttangaagtcactaagcggccctnaggggtcccctgatcgctttcnctggctccaagtctggcgagaccggccctccctgacccgtctcgtcgggctccaggctggaagatggagctagattattacngcagctacatatgacaggcaagccaaanaagtgtggctagttcgggcggagggaaccagccgtagacccgtcgtgggtccacggacccgaaggcctcggccccctcggtaccacgtccgtcgtccccctacctccgtctcggtcgacgtcctcgtgacgg

SEQ ID NO: 368280 - DNA, 525 bp, Homo sapiens
  misc_feature: GZ8MTXP02JSNNO.2.34.D01.1.454.CMB.2.raw
  modified_base (340)..(340): a, c, t, g, unknown or other
  modified_base (368)..(368): a, c, t, g, unknown or other
  modified_base (452)..(452): a, c, t, g, unknown or other
  modified_base (512)..(512): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacacccaggcaaagcccccaaatcattatttatgaagtcactaagcggccctcaggggtcccctgatcgctttctctggctccaagtctggcgagacggcctcccngaccgtctctggggctccaggctgaagntgagctgattattactgcagctcatatgcaggcagcaaacaatgtaggcagttcgggacggagggaccaagctagaccgtccgngggtccagcccaaggcctcgcccctcggtcactcctcgttccccacctccgtctcgtcgnggtcctgacgcgg

SEQ ID NO: 368281 - DNA, 608 bp, Homo sapiens
  misc_feature: GZ8MTXP02IL3IH.2.34.D01.1.454.CMB.2.raw
  modified_base (267)..(267): a, c, t, g, unknown or other
  modified_base (298)..(298): a, c, t, g, unknown or other
  modified_base (304)..(304): a, c, t, g, unknown or other
  modified_base (308)..(308): a, c, t, g, unknown or other
  modified_base (364)..(364): a, c, t, g, unknown or other
  modified_base (384)..(384): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcacgccccctcgcgtccggtctcctggacagtcagtcaccatctcctgcactggaatcagcagtgacctgatccttaataactatgtctcctaggtaaccaacaacacccagacaaacgccccaaatcaattattangaagtcactaagccggccctagacgggtccngatcgnttcnctgctcaagtctggcgagcgcctcctgaccgtctcgtcggctccgaggctagaagntgagctagtaattattacgngacatctatatagtgacgagacaagaacaaagtagtgtacgtacgtacggttacgggacgggaacgggaaccgtaaggtccgtacggaccggttccggtacgggtaccgaaccggacccgaacggtcccgtcccggtacccccgttacggtacctaccgttccgttaccgttcccgtccgtccccgttccgtaccggtaccggacgtccggttacgtacggcgg

SEQ ID NO: 368282 - DNA, 529 bp, Homo sapiens
  misc_feature: GZ8MTXP02GAEW2.2.34.D01.1.454.CMB.2.raw
  modified_base (420)..(420): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacacccaggcaaagccccaaatcattatttatgaagtcactaagcggccctcaggggtccctgatcgcttctctggctccaagtctggcgagacggcctccctgaccgtctctcggggcctccgaggctaggaagatgaggctgattattactgcagctacatatgcaggcagcaaacgatgtggntagttcgggcggagggaccaaagctgaccgtcgtgggcacgcccaaggctcgcccccgtggtccactccgtcgttccccaccctcctctcgtcgacgtcgtctggacgg

SEQ ID NO: 368283 - DNA, 522 bp, Homo sapiens
  misc_feature: GZ8MTXP02G8NIL.2.34.D01.1.454.CMB.2.raw
  modified_base (264)..(264): a, c, t, g, unknown or other
  modified_base (364)..(364): a, c, t, g, unknown or other
  modified_base (418)..(418): a, c, t, g, unknown or other
  modified_base (475)..(475): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacacccaggcaaagccccaaatcattattangaagtcactaagcggccctcaggggtcccctgatcgcttctctggctccaagtctggcgagacggcctccctgaccgtctctcgggctccaggctgaagntgaggctgattatactgcagctcatatgcaggcagcaacatgtggcattcgggngagggaccgaagcgtagaccgtcgtgggtcacgccgaacggctcgccccctcggtcncgtctccgttccccaccctccgttctcggttcagccgtccgtgacgg

SEQ ID NO: 368284 - DNA, 565 bp, Homo sapiens
  misc_feature: GZ8MTXP02IMRV9.2.34.D01.1.454.CMB.2.raw
  modified_base (231)..(231): a, c, t, g, unknown or other
  modified_base (370)..(370): a, c, t, g, unknown or other
tcagacgctcgacacacgaccggtgctcgatttagatcgtctgtgttgggtttggggctttgcctgggctctgctcctcctcaccctcctcactcagggcacagggtcctgggccccagtctgccctgactcagccccctccgcgtccgggtctcctggacagtcagtcaccatctcctgcactggaatcagcagtgacctgagtccttataactatgtctctgtaccaanaacaccagcaaacgccccaaatcattattatgaagtcactaaagccggccctcgacggggtcccctgactcgctttctctgctccaagtctggcgagacggcctccctgaccgtctcgtcgggcctccgaggctgaagntgagctgatttatactgcagtctcatatgacgaggacagacaaacagtgtagctaagtcgggacggagggaccaagccgtacggaccgttcgtgggtacacgacccgaaggcctaccgcccccgtcggtaccacgttccgtccgttcccccgcccttccgttccgtcggtcccgacgtccgttcgcggtaccggg

SEQ ID NO: 368285 - DNA, 516 bp, Homo sapiens
  misc_feature: GZ8MTXP02GGDNN.2.34.D01.1.454.CMB.2.raw
  modified_base (309)..(309): a, c, t, g, unknown or other
  modified_base (483)..(483): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgctttcnctggctccaagtctggcgagacggcctccctgaccgtctctcgggctccgaggctgaagatgaggctgattatactgcagctcatatgcaggcagacaacaatgtaggcagttcggcggagggaccaagctgaccgtcgtgggtcacggccaaggctcgcccctcggtcactcncgttcccaccctctctcgtcgagcgtcgtgcgg

SEQ ID NO: 368286 - DNA, 616 bp, Homo sapiens
  misc_feature: GZ8MTXP02GNG9Q.2.34.D01.1.454.CMB.2.raw
  modified_base (265)..(265): a, c, t, g, unknown or other
  modified_base (373)..(373): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacacccagcaaacgccccaaatcattattangaagtcactaagccggccctcgaggggtcccctgactcgctttctctggctccaagtctggcgagacggcctccctgaccgtctcgtcgggcctccgaggctagaagntggagctgtattatactgctagctcatatgcgaggcaagacaaacagtggtaggacgtaacggtttccggggacggggaacggggaacccgaaaggtccgtacggtaacccggttccggttaggggtaccacgggtacccgaacgggtcctccggcccccgttcgggtaccctaccttccgtaccgtttccccctaccccgttcccgttacgtcggtaccgtacgccgttccgtcggtacggg

SEQ ID NO: 368287 - DNA, 534 bp, Homo sapiens
  misc_feature: GZ8MTXP02JU9K2.2.34.D01.1.454.CMB.2.raw
  modified_base (369)..(369): a, c, t, g, unknown or other
  modified_base (413)..(413): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagccccaaatcattattatgaagtcactaagcggccctcaggggtccctgatcgcttctctggctccaagtctggcgagaccggcctccctgacccgtctctcggggcctccgaggctgaagntgaggctgattatactgacagctacatatgcaggcagaccaaanaagtgtaggcagttcggacggagggaccaagcgtgaccgtcgtagggtcacgcccgaaggcctcgccccgtcggtccacgtctcgttccccacctcctcgtcgtcgagtcgtcgcggacgg

SEQ ID NO: 368288 - DNA, 560 bp, Homo sapiens
  misc_feature: GZ8MTXP02ISARG.2.34.D01.1.454.CMB.2.raw
  modified_base (263)..(263): a, c, t, g, unknown or other
  modified_base (309)..(309): a, c, t, g, unknown or other
  modified_base (347)..(347): a, c, t, g, unknown or other
  modified_base (399)..(399): a, c, t, g, unknown or other
  modified_base (414)..(414): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgccccctcgcgtccgggtctcctggacagtcagtcaccatctcctgcactggaatcagcagtgacctgagtccttataactatgtctcctgtaccaacacaccaggcaaacgccccaaatcattattangaagtcactaagccggccctcgaggggtcccctagactcgctttcnctggctccaagtctggcagacggcctccctgacccgtntcgtcgggcctccaggctgaagatgagctgatttatactgcagctcatacgngacgagacagacaanagtgtgactaggtcgggacggacggacaagcgtacgtccgtcgtcggacacgacccgacggtccgtccgccccgtcgtcctaccgttccgttcccgttccccgtcccttccgtccgttacggtccgtacgtccgttacgtcggcgg

SEQ ID NO: 368289 - DNA, 519 bp, Homo sapiens
  misc_feature: GZ8MTXP02HXV6S.2.34.D01.1.454.CMB.2.raw
  modified_base (260)..(260): a, c, t, g, unknown or other
  modified_base (335)..(335): a, c, t, g, unknown or other
  modified_base (354)..(354): a, c, t, g, unknown or other
  modified_base (369)..(369): a, c, t, g, unknown or other
  modified_base (371)..(374): a, c, t, g, unknown or other
  modified_base (376)..(376): a, c, t, g, unknown or other
  modified_base (385)..(385): a, c, t, g, unknown or other
  modified_base (395)..(395): a, c, t, g, unknown or other
  modified_base (397)..(397): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctctgtaccaacaacaccagcaaagccccaaatcattattangaagtcactaagcgcctcagggtccctgatcgcttctctggctccaagtctggcgagacggcctccctgaccgtntctggctccaggctgaagntgagctgattatacngnnnnanatgcagcanacaacatagngngtagtcggacggacggacgaacgacgacgaccgtcgtcggtacgacgaccgaacgacgtccgtcccgtccgtccgtacctcctccttccctaccctccgtctcgtcgtacgtcgtcgtcgcg

SEQ ID NO: 368290 - DNA, 644 bp, Homo sapiens
  misc_feature: GZ8MTXP02IOEN5.2.34.D01.1.454.CMB.2.raw
  modified_base (211)..(211): a, c, t, g, unknown or other
  modified_base (263)..(263): a, c, t, g, unknown or other
  modified_base (285)..(285): a, c, t, g, unknown or other
  modified_base (388)..(388): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcacgccccctccgcgtccgggtctcctggacagtcagtcaccatctcctgcactggaatcagcagtgacctgagtccttanaactatgtctcctgtaccaacaacacccagcaaagccccaaatcattattangaaagtcactaagccggccctnaggggtccctgatcgcttctctggcctcaagtctggcgagaccggcctccgtgaccgtctcgtcgggctccgaggctgaagatggagtctgtaatttattacngcagtctacatatcgacgaggaccaagacaaacaaagtggtacggactaacggttcgggacggggaacgggaacccgaaacggtcgtaccggtaacccggtccggtcggggttaccaccgggacccgaaaacggtccgacccggtccccccggttcgtaaccggtacccgtttacccttacccggtttaccccctacccccttcccgtcccgttaccggttacccggacggttcccggttacgttacggccggggg

SEQ ID NO: 368291 - DNA, 604 bp, Homo sapiens
  misc_feature: GZ8MTXP02HAQ2Z.2.34.D01.1.454.CMB.2.raw
  modified_base (267)..(267): a, c, t, g, unknown or other
  modified_base (307)..(307): a, c, t, g, unknown or other
  modified_base (371)..(371): a, c, t, g, unknown or other
  modified_base (393)..(393): a, c, t, g, unknown or other
  modified_base (402)..(402): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacacccaggcaaacgcccccaaatcattattangaagtcactaagcggccctgaggggtccctgatcgcttcnctggctccaagtctggcagacggcctcccgtgaccgtctcgtcggggcctccgaggctgaaagntggaggcttagatttattacgngacatctanatagtcgacgaggcaagacaaacgagtggtaggctaggtcgggacgggaacggacgaacgcgtacggaccggtcgtacgggacacgacccgaacggtccgtcccggtcccccgttacggtacctaccgttcccgttcccggttcccccgtcccgttccgtccgttccggtaccgtaccggtccggttacggtacggtacggg

SEQ ID NO: 368292 - DNA, 543 bp, Homo sapiens
  misc_feature: GZ8MTXP02IMLJ7.2.34.D01.1.454.CMB.2.raw
  modified_base (263)..(263): a, c, t, g, unknown or other
  modified_base (302)..(302): a, c, t, g, unknown or other
  modified_base (363)..(363): a, c, t, g, unknown or other
  modified_base (382)..(382): a, c, t, g, unknown or other
  modified_base (507)..(507): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagccccctcgcgtccgggtctcctggacagtcagtcaccatctcctgcactggaatcagcagtgacctgagtccttataactatgtctcctggtaccaacaacacccagcaaagccccaaatcattattangaagtcactaagcgcctcgagggtccctgatcgctttcnctggctccaagtctggcagcggcctccctgaccgtctcgtcgggcctccgaggctagaagntggagctagtattattacngcagctcatagtgcgaggcagacaaacgagtgtgctagtcgggacggaggaccgaagccgtagaccgtcgtcgggtcacgccgaacggcctccggcccccgtcggtccaccgtcctccgttcccncccgtcctcgtcgtcgacgtccgttcgacggtccgg

SEQ ID NO: 368293 - DNA, 521 bp, Homo sapiens
  misc_feature: GZ8MTXP02GXQV7.2.34.D01.1.454.CMB.2.raw
  modified_base (367)..(367): a, c, t, g, unknown or other
  modified_base (491)..(491): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacacccaggcaaagccccaaatcattattatgaagtcactaagcggccctcaggggtccctgatcgcttctctggctccaagtctggcgagaccggcctcccctgacccgtctctcggggctccaggctgaagntgaggctgatttatactgcagctcatatgcaggcagcaacaatgtagctattcgggacggagggacaagctgaccgtctagggtcacgccaaggctcgcccctcggtccactcgtcgttacccnccctcctcgtcgtcgacgtcgtcgtgacgg

SEQ ID NO: 368294 - DNA, 624 bp, Homo sapiens
  misc_feature: GZ8MTXP02HQ8J8.2.34.D01.1.454.CMB.2.raw
  modified_base (261)..(261): a, c, t, g, unknown or other
  modified_base (339)..(339): a, c, t, g, unknown or other
  modified_base (361)..(361): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctctgtaccaacaacaccagcaaagccccaaatcattattangaagtcactaagcgccctcgagggtccctgatcgcttctctggctccaagtctggcgagaccggcctccctgaccgtntcgtcgggctccgagctgaagntggagctgtatttatactgcagtctactatagtgacgaggcaagactaaagaacgtggtacgcgtaaggtttccggggaacggggaacgggaacccgaaaggtccgtacgggaaccccggttccggtaggggtcccgaaccgggaccccgaaacggggtcccttccccggtacccccggttccggtaccctaccgttcccgtcccgtttcccccacccgttcctaccgttcggttccgacggtccgttacgtcggacccgggg

SEQ ID NO: 368295 - DNA, 543 bp, Homo sapiens
  misc_feature: GZ8MTXP02HGSM5.2.34.D01.1.454.CMB.2.raw
  modified_base (367)..(367): a, c, t, g, unknown or other
  modified_base (387)..(387): a, c, t, g, unknown or other
  modified_base (396)..(396): a, c, t, g, unknown or other
  modified_base (400)..(400): a, c, t, g, unknown or other
  modified_base (402)..(402): a, c, t, g, unknown or other
  modified_base (513)..(513): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcagcccccctccgcgtccgggtctcctggacagtcagtcaccatctcctgcactgtaatcagcagtgacctgagtccttataactatgtctcctggtaccaacaacacccagcaaagccccaaatcattattatgaagtcactaagcggccctcgaggggtccctgatcgcttctctgctccaagtctggcgagacggcctcccgtgaccgtctcgtcgggcctccgaggctgaagntggagctagtattattacgngcagtctanatgngngagcagacaacgtagtgtagcgtaggtcgggacggacggaacgagtccgtacggaccgtcgtcggcacgaccgacggcctccgccccgtcgcctaccttccgtccttcccnccgtcctcgtcgcgtcgtccgtcgtcggcg

SEQ ID NO: 368296 - DNA, 629 bp, Homo sapiens
  misc_feature: GZ8MTXP02HH9KH.2.34.D01.1.454.CMB.2.raw
  modified_base (268)..(268): a, c, t, g, unknown or other
  modified_base (376)..(376): a, c, t, g, unknown or other
  modified_base (398)..(398): a, c, t, g, unknown or other
  modified_base (413)..(413): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgcccccctcgcgtccgggtctcctggacagtcagtcaccatctcctgcactggaatcagcagtgacctgagtccttataactatgtctcctgtaccaacaacacccaggaccaaacgccccaaatcattattangaatcactaagccgccctgacgggtccctgactcgctttctctggcctccaagtctggcgagaccggcctcccgtgacccgtctcgtcgggcctccgaggctagaagntggagcttagtatttattacgngacatctactatagngacgacgacaacgacaaagtagtgtacgacgtacggtcggggacggaacggaaccgaacgtcgtaccggtaccggttcggtacgggtaccgaccggacccgtacggtcccgtccccggtacccccgtaccggtaccttacccgttccgttaccccgttaccccctacccgttcccgtaccgttaccggtaccggtacgtccgtacggtacgggcgg

SEQ ID NO: 368297 - DNA, 550 bp, Homo sapiens
  misc_feature: GZ8MTXP02JT7UV.2.34.D01.1.454.CMB.2.raw
  modified_base (266)..(266): a, c, t, g, unknown or other
  modified_base (366)..(366): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaacgccccaaatcattattangaagtcactaagcggccctgacggggtccctgatcgctttctctggctccaagtctggcgagcgcctcctgaccgtctcgcggcctccgaggctagaagntggaggctgtattatactgcagctcatatgcaggcagacaaacgagtgtggctaggttcgggagggacgggaccaagcgtacggaccgtccgtggtcgacgccgaacggccgtccggcccccgtcggtcctaccgttccgtccgttcccctaccctccgtcgtcgtcgacgtcgtcgtcggcgg

SEQ ID NO: 368298 - DNA, 609 bp, Homo sapiens
  misc_feature: GZ8MTXP02HYBG4.2.34.D01.1.454.CMB.2.raw
  modified_base (247)..(247): a, c, t, g, unknown or other
  modified_base (252)..(252): a, c, t, g, unknown or other
  modified_base (381)..(381): a, c, t, g, unknown or other
tcagacgctcgacacacgaccggtgctcgatttagatcgtctgtgttgggtttgggggtctcaggaggcagcgctctcaggacgtcaccaccatggcctgggctctgctcctcctcaccctcctcactcagggcacagggtcctgggcccagtctgccctgactcacgcccccctcgcgtccgggtctccgtggacagtcagtcaccatcctcctgcactggaatcagcagtgacctgattccttanaactntgtctcctggtaccaacaacacccagaccaaacgccccaaatcaatttattatgaagtcaactaagccgacctcgacgggtccctgactcgcttctctcggcctaccaagtctggcgagccgccttccngacccgttctcgtcgggcctcccgaggctagaacgagtggtaggtcttagtaagtttacgttacgttagctaagctactaatacgtgaccgaggaccaaggaactaaacgtaaagtcgtacggactacggttacggggcgggaaacggaaccgaaacggtccgtacggtaccggtaccggttaacggacgaccggacccgaacggtcccgcccgtcccccggttccgg

SEQ ID NO: 368299 - DNA, 579 bp, Homo sapiens
  misc_feature: GZ8MTXP02IFYXM.2.34.D01.1.454.CMB.2.raw
  modified_base (212)..(212): a, c, t, g, unknown or other
  modified_base (268)..(268): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgcccctgactcagcccccctccgcgtccgggtctcctggacagtcagtcaccatctcctgcactggaatcagcagtgacctgatccttanaactatgtctcctggtaccaacaacacccaggacaaagcccccaaatcattattangaagtcactaagcggccctcagggtccctgatcgcttctctggctccaagtctggcgagaccggcctccctgacccgtctcgtcgggcctccgaggctaggaagatggaggtctgtaatttattacgtgccagtctacattaagtgcgaggcagacaaactaagtgtaggactaggttcgggacgggacgggaccaagcgtacggacccgttccgtgggtaccacggcccgaaacggcctccgcccccgtcggtccaccgttcctccgttccccacccgtccttcgtcgtccgacgtccgtcgtacggcgg

SEQ ID NO: 368300 - DNA, 623 bp, Homo sapiens
  misc_feature: GZ8MTXP02JPKPF.2.34.D01.1.454.CMB.2.raw
  modified_base (273)..(273): a, c, t, g, unknown or other
  modified_base (388)..(388): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgcccccctcgcgtccgggtctcctggacagtcagtcaccatctcctgcactggaatcagcagtgacctgacgttccttaataactatcgtctcctagtaaccaacaaccaccaggacaaacgccccaaatcattattangaagtcactaagccgcctacgacggggtccctagactccgtcttctctggcttaccgaagtctgggacgacggaccgtcctccctgtaccgtctcgcgggctccgagctagaagntggacggcttagtactttatactcgctacgcttacaattagcgacgaagccgaagactaaacagttgtacggacgtaacgttcgggggaccggaaacggggaccaaaggccgttacggacccggttacggtcggaccgacgacccgaggtccgtacccgtccccgtcggtaacctccgttccgtccgttacccccaccgttccgtcgtacggtcggacgtcggtcgtacggccgg

SEQ ID NO: 368301 - DNA, 581 bp, Homo sapiens
  misc_feature: GZ8MTXP02IV4G5.2.34.D01.1.454.CMB.2.raw
  modified_base (266)..(266): a, c, t, g, unknown or other
  modified_base (285)..(285): a, c, t, g, unknown or other
  modified_base (306)..(306): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacacccaggcaaacgccccaaatcattattangaagtcactaagcgccctnacggggtccctgatcgcttcnctggctccaagtctggcgagaccggcctcccgtgaccgtctcgtcgggcctccgaggctagaacgatggaggctgtattattactgcagctcatatgcaggcagacaaacagtgaggctaaggttcgggacgggagggaccaaaggccgtacggaacccgttcggtacggggtaccacggaccccgaaggccgtccggccccccgttcggtcctaccttccgttccgttcccccgtcccgttcctcgtcgtccggacgtccgttcgtcggcgggg

SEQ ID NO: 368302 - DNA, 641 bp, Homo sapiens
  misc_feature: GZ8MTXP02JZ8MI.2.34.D01.1.454.CMB.2.raw
  modified_base (375)..(375): a, c, t, g, unknown or other
  modified_base (401)..(401): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaacgccccaaatcattattatgaagtcactaagcggccctcgacggggtccctgactcgctttctctggctccaagtctggcgagaccggcctccctgaccgtctcgtcgggcctccgaggctagaagntggagctagtattattactgcagctnatatgcaggcagacaaacagtgtaggactaggttcgggacgggaacgggaacccgaaacggccgtacggtaaccccggtccggttacggggtaccaccggaccccgaaacgggtccctaccccgggtccccccgttccggggttaccctaccgttccccgttcccggtttaccccccgtaccccttccccgttccgttacggttccggtaacggtcccggttaccgtcggtacccggggg

SEQ ID NO: 368303 - DNA, 562 bp, Homo sapiens
  misc_feature: GZ8MTXP02HNA56.2.34.D01.1.454.CMB.2.raw
  modified_base (440)..(440): a, c, t, g, unknown or other
  modified_base (503)..(503): a, c, t, g, unknown or other
  modified_base (528)..(528): a, c, t, g, unknown or other
tcagacgctcgacacacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgttcccatcgactacgcctttcggcctcgccttagggtcactcaccctgccccgattaacgtgacaggaccttggtctcggcgagcggctttcaccgtctttatcgttacttatgtcagcattcgctacttctgactacctcagtcatgccctcacagcacaccttnacaggtctacagaaccgctacccctacaacacgcatacgcgtcgctcgcctcacgtcttcggngacagttcggttacgccccgtttanacttccgtccgcgctacggccgtactcggaaccg

SEQ ID NO: 368304 - DNA, 619 bp, Homo sapiens
  misc_feature: GZ8MTXP02FGUWO.2.34.D01.1.454.CMB.2.raw
  modified_base (262)..(262): a, c, t, g, unknown or other
  modified_base (303)..(303): a, c, t, g, unknown or other
  modified_base (367)..(367): a, c, t, g, unknown or other
  modified_base (385)..(385): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgccccctccgcgtccgggtctcctggacagtcagtcaccatctcctgcactggaatcagcagtgacctgatccttataactatgtctctgtaaccaacacaccagacaacgccccaaatcattattangaagtcactaagcggccctgaggggtccctgatcgctttcnctggctccaagtctggcgagaccggccttccctgaccgttctcgcgggcctccgaggctgaagntgaggctagattattacngcagctacatatgcaggcaagacaaacaagtggtacggactaaggttccggggacgggaacgggaaccgaaaggtcccgtacgggaaccccgttcggtacggggtaccaaccggtaccccgaaaagggcccgttacccggccccccgttacgggtaccctaaccgttcccgtttcccgtaccccctaacccgttccgttacgtcggtaccggagtccggtacgtcggaccgggg

SEQ ID NO: 368305 - DNA, 590 bp, Homo sapiens
  misc_feature: GZ8MTXP02FXNX2.2.34.D01.1.454.CMB.2.raw
  modified_base (268)..(268): a, c, t, g, unknown or other
  modified_base (371)..(371): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgccccctccgcgtccgggtctcctggacagtcagtcaccatctcctgcactggaatcagcagtgacctgagtccttataactatgtctcctggtaccaacaacacccaggcaaacgccccaaatcattatttangaagtcactaagcggccctcgaggggtcccctgatcgcttctctggctccaagtctggcagccggcctccctgaccgtctcgtcgggcctccgaggctgaagntgaggctgtatttattacgtgacagctctatagtgacgaggcaagacaaacaagtgtaggctaaggttcggacggacgggaccgtaagccgttacggaccgtccgttcggacgacgacccgaacggtccgtccggtcccccgtcggtacctaccttccgttccgttcccccgtcccctccgttcccgtacgttccggacggtccggttcgtacggcggg

SEQ ID NO: 368306 - DNA, 568 bp, Homo sapiens
  misc_feature: GZ8MTXP02G2VDD.2.34.D01.1.454.CMB.2.raw
  modified_base (397)..(397): a, c, t, g, unknown or other
  modified_base (500)..(500): a, c, t, g, unknown or other
  modified_base (518)..(518): a, c, t, g, unknown or other
  modified_base (541)..(541): a, c, t, g, unknown or other
  modified_base (551)..(551): a, c, t, g, unknown or other
tcagacgctcgacacacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggcaacatagccttctccgtccccccttcgcagtaacaccaagtacaggaatattaacctgtttcccatcgactacgccttcggcctcgccttaggggtcactcaccctgccccgattaacgttggacaggaacccttggtcttccggcgagcgggtctttcgacccgtcttatcgttacttangtcagcattcgcacttctgactacctcagcatgccctcacagcacaccttcacagcttaacagtaaaccgcctccccaacccaacaaccgcaactagctcgcncgccgcgacgtcgtcggnactacgttcgttacgcccgttanctcgtccgcncgacgccacgtccgacg

SEQ ID NO: 368307 - DNA, 511 bp, Homo sapiens
  misc_feature: GZ8MTXP02FOFJK.2.34.D01.1.454.CMB.2.raw
  modified_base (338)..(338): a, c, t, g, unknown or other
  modified_base (342)..(342): a, c, t, g, unknown or other
  modified_base (360)..(360): a, c, t, g, unknown or other
  modified_base (430)..(430): a, c, t, g, unknown or other
  modified_base (439)..(439): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacacaccagcaaagccccaaatcattattatgaagtcactaagcggccctcaggggtcccctgatcgcttctctggctccaagtctggcgagacgcctccctgacngtcncctggctcaggctgaagntgaggtctagatttatactgcagctcatatgcgagcagcaaacaagtgtgcagtcggcggagggacagcngaccgtcgnggtcacgccaacggcgtcgccccctcggtctacgtcgtcgttcccgccctcctcgcgtcgcgtcgtcgtcgg

SEQ ID NO: 368308 - DNA, 565 bp, Homo sapiens
  misc_feature: GZ8MTXP02I38N3.2.34.D01.1.454.CMB.2.raw
  modified_base (263)..(263): a, c, t, g, unknown or other
  modified_base (304)..(304): a, c, t, g, unknown or other
  modified_base (370)..(370): a, c, t, g, unknown or other
  modified_base (390)..(390): a, c, t, g, unknown or other
  modified_base (556)..(556): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgcccccctcgcgtccgggtctcctggacagtcagtcaccatctcctgcactggaatcagcagtgacctgagtccttataactatgtctctggtaccaacacaccagcaaacgccccaaatcattattangaagtcaactaagcgcctgacgggtccctgactcgctttcnctggctccaagtctggcagaccggcctccctgtacccgtctcgtcgggcctccgaggctagaacgntgggagctagtatttatacngcagctacatatgcgaggccagacaaacagtggtagctagttcgggacgggacgggacaagctcgaccgtccgtgggtcacggcccgaaggtccgtccgtcccccgttcggcctaccgttccgtcgttccctccggtccccttcccgtcgtccggagtccggttcncggtacggg

SEQ ID NO: 368309 - DNA, 581 bp, Homo sapiens
  misc_feature: GZ8MTXP02ITK1S.2.34.D01.1.454.CMB.2.raw
  modified_base (267)..(267): a, c, t, g, unknown or other
  modified_base (394)..(394): a, c, t, g, unknown or other
  modified_base (544)..(544): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctgtaccaacaacacccagacaaagccccaaactcattatttangaagtcaactaagcggccctcgacggggtcccctgactcgctttctctggctccaagtctggcgagaccggcctccctgaccgtctcgtccggctccaggctagaagatgaggctagatttattacngcagctacatatgacgaggcagacaaacagtgtacgctaggttcgggacggagggaccgaagccgtacggtaccgtcgtacgggtaccacgacccgaaacggtccgcccggtcccccgtcggtaccctacgttcccgtccgtttaccccnccccgttccgtctcgttcgacgtcgtcgtacggcggg

SEQ ID NO: 368310 - DNA, 542 bp, Homo sapiens
  misc_feature: GZ8MTXP02FHK77.2.34.D01.1.454.CMB.2.raw
  modified_base (264)..(264): a, c, t, g, unknown or other
  modified_base (420)..(420): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctctgtaccaacaacacccaggcaaagccccaaatcattatttangaagtcactaagccggccctcgaggggttcccctgactcgcttctctggctccaagtctggcgagaccggcctccctgaccgtctcgcgggctccgaggctgaagatgaggctgtattattactgcagctacatatgcaggcagacaacaatgtgnagttcggcgggaggaccaagctcgaccgtcgtgggtccacgacccgaaggcctccggcccccgtcggtccgaccttcctccgtccccctaccctcccgtcgtcgtcacgtcgtcgcggacgg

SEQ ID NO: 368311 - DNA, 650 bp, Homo sapiens
  misc_feature: GZ8MTXP02J2MK8.2.34.D01.1.454.CMB.2.raw
  modified_base (359)..(359): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcacgcccccctcgcgtccgggtctcctggacagtcagtcaccatctcctgcactggaatcagcagtcgacctgacgttccttaataactatcgttctcctaggtaaccaacaaccacccgaggacaaacgccccaaatctaattattatgaatcactaacgccgcctcgagggtccctggactcgctttctcgtcgctacaagtctggcagccggtcctcctgaccctntcgtcgggcctaccgaggtctaggaaacgtgtcgggacggtaccttgtaaacttttaacttaacgtcgggactacgtaccctactaagtttaacgtcggaccgagggacaaacggacaaaacgtaagtggttcggacgtacggttacggggacggaacgggacccgtaaagtccgtacggtacccgtcgtacgggtaccaccgtaaccgaacggtcccgtcccggccccgtacggtacctaccgtcctacccgtacccctccgtcctacgtcgcgacgtcgtcgcggccgg

SEQ ID NO: 368312 - DNA, 690 bp, Homo sapiens
  misc_feature: GZ8MTXP02GNEAQ.2.34.D01.1.454.CMB.2.raw
  modified_base (261)..(261): a, c, t, g, unknown or other
  modified_base (287)..(287): a, c, t, g, unknown or other
  modified_base (297)..(297): a, c, t, g, unknown or other
  modified_base (326)..(326): a, c, t, g, unknown or other
  modified_base (362)..(362): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcacgccccctccgcgtccgggtctcctggacagtcagtcaccatctcctgcactggaatcagcagtgacctgagtccttataactatgtctctgtaccaacacaccagcaaacgccccaaatcattattangaatcactaagccgcctgagggtccngatcgcttcnctgctcaagtctggcgagaccgcctccgngaccgtctcgtcggggcctccgaggctaggaaacgngtggaaggtcttagtatttaacgttacgtgacagcttacagttaatcggacgacgggcaacggaacctaaacgtaagttcggtacgggaccgttaacggtttcccggggacggggaaacgggtacccgaaacggtcccgtacggggtaaccccggttccggttacggggtaccctaaccgggaccccggtaaacgggtcccgttaccccggtccccccggttaacgggtccctaaacccgtttcccgttaccccggttaacccccgtacccccttccgttcccgttaccggttccggaacggtcccggttacgtacggtacccggggg

SEQ ID NO: 368313 - DNA, 551 bp, Homo sapiens
  misc_feature: GZ8MTXP02JH98F.2.34.D01.1.454.CMB.2.raw
  modified_base (216)..(216): a, c, t, g, unknown or other
  modified_base (231)..(231): a, c, t, g, unknown or other
  modified_base (261)..(261): a, c, t, g, unknown or other
  modified_base (288)..(288): a, c, t, g, unknown or other
  modified_base (300)..(300): a, c, t, g, unknown or other
  modified_base (313)..(313): a, c, t, g, unknown or other
  modified_base (363)..(363): a, c, t, g, unknown or other
  modified_base (464)..(464): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcacgcccccctcgcgtccgggtctcctggacagtcagtcaccatctcctgcactggaatcagcagtgacctgagtccttataactntgtctctgtaccaanacaccagacaacgccccaaatcattattangaatcactaagcgccctgagggtcccngactcgctttcnctgctccaagtcnggcgagccgcctcccgtgacctctcgtcgggcctccgagtctaggaaagntggagtcttagtatttattactgcagtctactatatgcgagcagacaaacagtgtaggcgtaggttcggacgggtacggaccaagcgtacgtaccgtccgngggtaccacgtcccgaaggccgtcccgccccgtacggtccacttccgtccgtaccccgcctcgtcgttcgacgcgtcgtctggccgg

SEQ ID NO: 368314 - DNA, 584 bp, Homo sapiens
  misc_feature: GZ8MTXP02F4V1X.2.34.D01.1.454.CMB.2.raw
  modified_base (269)..(269): a, c, t, g, unknown or other
  modified_base (308)..(308): a, c, t, g, unknown or other
  modified_base (337)..(337): a, c, t, g, unknown or other
  modified_base (394)..(394): a, c, t, g, unknown or other
  modified_base (403)..(403): a, c, t, g, unknown or other
  modified_base (408)..(408): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgcccccctccgcgtccgggtctcctggacagtcagtcaccatctcctgcactggaatcagcagtgacctgagtccttataactatgtctcctggtaccaacaacacccaggacaaacgccccaaatcattattangaatcactaagcgccctgacgggtccctgatcgctttcnctgctcaagtctggcgagacggccctccngaccgtctcgtcgggcctccgaggtctaggaagatggagctggtaactttagttacngacatctanatagngacgagacaacgaacaaacgagtgtagacgtacggtcgggacgggacggaaccgaagccgtacggtaccgtcggtcggccgaccggaccgaacgtccgtcccggtcccccgttcgtactacccgttccgttcccgtccccgtccctccgtcgtacggtcgcgtcgtcgtacggcgg

SEQ ID NO: 368315 - DNA, 544 bp, Homo sapiens
  misc_feature: GZ8MTXP02J1HOU.2.34.D01.1.454.CMB.2.raw
  modified_base (307)..(307): a, c, t, g, unknown or other
  modified_base (366)..(366): a, c, t, g, unknown or other
  modified_base (426)..(426): a, c, t, g, unknown or other
  modified_base (539)..(539): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagccccaaatcattattatgaagtcactaagcggccctcaggggtccctgatcgctttcnctggctccaagtctggcgagacggcctccctgaccgtctctggggctccaggctgaagntgaggctgattatactgcagctcatatgcaggccagacaaacaatgtaggcagttcgggnggagggaccaaagctgacccggtctagggtccagacccccgaaggccgtacgccccccgtacggtccacctccgtcgttcccccgtccctccctctacggtccgagtccgtcncgcgg

SEQ ID NO: 368316 - DNA, 658 bp, Homo sapiens
  misc_feature: GZ8MTXP02GTMQT.2.34.D01.1.454.CMB.2.raw
  modified_base (272)..(272): a, c, t, g, unknown or other
  modified_base (303)..(303): a, c, t, g, unknown or other
  modified_base (405)..(405): a, c, t, g, unknown or other
  modified_base (431)..(431): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgcccccctccgcgtccgggtctcctggacagtcagtcaccatctcctgcactggaatcagcagtcgacctgacgttccttaataactatgtctcctgtaaccaacaacaccaggcaaacgccccaaatctattattangaatcacgtagccggtcctcgacgggtcccngactccgtcttctcgtcggcctccgaagtcgtggacgacgacccggtccctcccgtggtaccccgtcgtcgtccggggtcctaccgagggtctaggaaacgngtgggacgtcttagtattacgttacncgacacgtctactaagtcgtaggaccgagaccgaacgaactaaacgtagtacggtcgggtaacctagggttaccgggggacggaacgggaaccgaacgtaccgtcgaaccggtccggtacgggtaccaccggtcccgaaggtcccggtacccgtccccgtcggtacctccgtccgttacccgttccccaccgttccgtcgttcgacgtcgtccgtcgtacgggccgg

SEQ ID NO: 368317 - DNA, 635 bp, Homo sapiens
  misc_feature: GZ8MTXP02IQ28X.2.34.D01.1.454.CMB.2.raw
  modified_base (414)..(414): a, c, t, g, unknown or other
tcagacgctcgacacacgaccggtgctcgatttagatcgtctgtgttgggtttggggctttgcctgggctctgctcctcctcaccctcctcactcagggcacagggtcctgggccccagtctgcccctgactcagcccccctcgcgtccggtctcctggacagtcagtcaccatctcctgcactggaatcagcagtgacctgagtccttataactatgtctcctggtaccaacaacaccccaggacaaacgcccccaaactctattatttatgaagtcactaaagccggcccctcgacgggtccctgatccgctttctctggcctccaagtctggcgagaccggccctcccctgcccgtctcgtcgggcctcccgaggcctggaaagatggacgtctagtatttacgtttacgngacagtctacatatcgacgacgcgtaagacaaacgagtggtacggtacgtacggttaccgggaccgggaacgggaaccgaacgccgtacggtacccgtaccggtacggtacccgacggacccgaacggtcccgtcccggtcccccgttaccggtccctaccgttcccgttacccgttcccccacccttccgtcgtcggtccgacgtccggtcgtacggcgg

SEQ ID NO: 368318 - DNA, 628 bp, Homo sapiens
  misc_feature: GZ8MTXP02FV9EX.2.34.D01.1.454.CMB.2.raw
  modified_base (265)..(265): a, c, t, g, unknown or other
  modified_base (293)..(293): a, c, t, g, unknown or other
  modified_base (305)..(305): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgccccctccgcgtccgggtctcctggacagtcagtcaccatctcctgcactggaatcagcagtgacctgagtccttataactatgtctctggtaccaacaacaccaggcaaacgccccaaatcattattangaatcactaagcgccctgacggggtccngatccgctttcnctggcctcaagtcgtggcagccggcctccctgacctctcgtcgggcctccgaggcctaggaaacgtagtcggagtctagtactttactacgtgacagtctacatagcgtcgagcagtacaacgtaagtcggtaggtacgtacggttcgggaccggggacggaaccgaacgtaccgtaccggacccggttccggtacgggtaccaaccggacccgtaacggtcccgtcccggacccccggttcggtacccgtaccgttcccgttcccgttacccctaccccgtccttccgttacggccgtaccgtccggtacgtggacccgggg

SEQ ID NO: 368319 - DNA, 562 bp, Homo sapiens
  misc_feature: GZ8MTXP02IX299.2.34.D01.1.454.CMB.2.raw
  modified_base (263)..(263): a, c, t, g, unknown or other
  modified_base (371)..(371): a, c, t, g, unknown or other
  modified_base (388)..(388): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgccccctcgcgtccgggtctcctggacagtcagtcaccatctcctgcactggaatcagcagtgacctgagtccttataactatgtctctgtaccaacaacaccaggcaaacgccccaaatcattattangaagtcactaagcggccctcgacggggtcccctgactccgctttctctggctccaagtctggcgagccggcctcccgtgaccgtctcgtggcctccgaggctgaacgntggagctgattattacngcagctcaatatgcaaggcaagacaaacatggtggactagttcgggacggagggacaacgcgttaggaccggtcgtagggtcaacgccgaaggccgtaccgcccccgtcggtacctaccgtccgttaccgtcccccgtccctccgtcgttcgtccgacgtccgtcgtcgccggg

SEQ ID NO: 368320 - DNA, 610 bp, Homo sapiens
  misc_feature: GZ8MTXP02JZ6WN.2.34.D01.1.454.CMB.2.raw
  modified_base (270)..(270): a, c, t, g, unknown or other
  modified_base (311)..(311): a, c, t, g, unknown or other
  modified_base (324)..(324): a, c, t, g, unknown or other
  modified_base (373)..(373): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagttccttaataactatcgtctcctggtaccaacaacacccaggcaaacgcccccaaatcattattangaatcactaagcggccctgacggggtccctgactcgcttcnctggctcaagtcnggcgagcggcctcccgtgaccgtctcgtgggcctccgaggctgaaacgntcggaggcttagatttactacgtgacagccttacatagtgcgaggactaacggaacaaacgtaagttcggaggtactacggttcgggggacggacggggaaccaaggccgttacggacccgttccgtacgggtccacggacccgaaggccctaccggccccgtcggttactaccgttcttcccggttcccccacccttccgtccgtcgtccggtcggtcccgttacgtcgaccgggg

SEQ ID NO: 368321 - DNA, 685 bp, Homo sapiens
  misc_feature: GZ8MTXP02GYXT5.2.34.D01.1.454.CMB.2.raw
  modified_base (261)..(261): a, c, t, g, unknown or other
  modified_base (269)..(269): a, c, t, g, unknown or other
  modified_base (272)..(272): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgccccctcgcgtccgggtctcctggacagtcagtcaccatctcctgcactggaatcagcagtcgacctgacttccttataactatgtcctcgtgtaaccaacaacaccgagaccaaaccgcccaatntattatangancatagccgcctcgacggtcctgctcgtctctcgtcgcctcgaagtcgtggacgacggtaccggtcccttacccgtacgtacccgtcgtcggtcccggggtccctccgaagggtccttaaggaaagtaggttcggggaacggttcttaggttaacttttaacgttacggtcgaccgtaacgtccttacgttaatcggtacgacgaacggaccaaacgaacccgtaaaagtaagttcggttacggaccggttaaccggggttacggggacggggaacgggaaccgtaacgtccggtaccggtaccggtacggttcgggaaccacggacccgacggtcccgcccgtacccgtcgactaccgttccttacccgtccctcccgtgttaccgtacgttcgacgtcctacggcggtccgg

SEQ ID NO: 368322 - DNA, 641 bp, Homo sapiens
  misc_feature: GZ8MTXP02IAKNX.2.34.D01.1.454.CMB.2.raw
  modified_base (216)..(216): a, c, t, g, unknown or other
  modified_base (264)..(264): a, c, t, g, unknown or other
  modified_base (292)..(292): a, c, t, g, unknown or other
  modified_base (295)..(295): a, c, t, g, unknown or other
  modified_base (298)..(298): a, c, t, g, unknown or other
  modified_base (302)..(302): a, c, t, g, unknown or other
  modified_base (419)..(419): a, c, t, g, unknown or other
  modified_base (577)..(577): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgccccctcgcgtccgggtctcctggacagtcagtcaccatctcctgcactggaatcagcagtgacctgagttcctataactntgtcctctaggtaccaacacaccagcaaacgccccaaatcattattangaatcactaagccggcctgacgggtccngancgnttcnctggctaccagtctggcgagaccggcctcctggacctctcgtacgggctcccgaggtctaggaaacgtgtgggacgtctaggttatttactttcaggccaacgtctcctaagttacnggacgaggcccgaaggaaccttaaagacgtaggttagggaccgttaggtttacccggggacggggaacgggtaaccccgaagtccgtaacggggtaccgttccggtgggtacgaccggacccgaacgggtcctaccccggccccttcgggttaccccnccttacccgtaccctttaccccacccgttccgtcgtacggtaccggacgtcggtcgtacggcgg

SEQ ID NO: 368323 - DNA, 623 bp, Homo sapiens
  misc_feature: GZ8MTXP02F3RDB.2.34.D01.1.454.CMB.2.raw
  modified_base (283)..(283): a, c, t, g, unknown or other
  modified_base (457)..(457): a, c, t, g, unknown or other
  modified_base (622)..(622): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgcccccctcgcgtccgggtctcctggacagtcagtcaccatctcctgcactggaatcagcagtcgacctgacgtccttaataactatgtcctccgtacgtaaccaaacaaccaacccgagaccaaaccgccccaaatctaattatttangaagtcaactaagccgccctcgacgggtccctagtactccgtctttcgcgtcggcctacaggtcgtggacgacgccgtcccgtccctcgacctcgtcgtccgggcctaccgaggctaggaaagtagtgggacgcttagtaaactttacttacgagcaagtcttacaattacggngacgagacaacgaacaagaggtcgtacggacgtacggtacgggaacggacggtaacgtacgtccgtacgtccggtacggacgaccgacgaccgacgtccgtcccgtcccgttcgccttccgtcccgtcccgtccctccgtcgtcgtcgcgtcgtcgtacggcggng

SEQ ID NO: 368324 - DNA, 665 bp, Homo sapiens
  misc_feature: GZ8MTXP02JJ7ON.2.34.D01.1.454.CMB.2.raw
  modified_base (270)..(270): a, c, t, g, unknown or other
  modified_base (295)..(295): a, c, t, g, unknown or other
  modified_base (297)..(297): a, c, t, g, unknown or other
  modified_base (305)..(305): a, c, t, g, unknown or other
  modified_base (371)..(371): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgcccccctccgcgtccgggtctcctggacagtcagtcaccatctcctgcactggaatcagcagtgacctgagtccttataactatgtctcctggtaccaacaacacccaggacaaacgccccaaatcaattattangaagtcactagcgcctcgaggtccngntcgcttcngtgctccaagtctggcgagaccggtcctcccgtgaccgtctcgtccgggtctccgagctagaagtntgaggcttagtatttattacgtgacacgtctataacgtagtcgacgacggcaagtactaaaactaagtcggttacgggacctacggggttaccggggcgggtaaacgggtacccgaaacggtccggtaaccggtacccggtaaccggttcggggacccgaacgggccccgtaaacgggtccccgttacccggtacccccggtcgggttacccaccgtttcccgtaccggttcccccgtaccttccccgttcggtacccgggtcggtaaccgtccggtttccggacgtccggggg

SEQ ID NO: 368325 - DNA, 653 bp, Homo sapiens
  misc_feature: GZ8MTXP02HVCGJ.2.34.D01.1.454.CMB.2.raw
  modified_base (260)..(260): a, c, t, g, unknown or other
  modified_base (356)..(356): a, c, t, g, unknown or other
  modified_base (398)..(398): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgcccccctccgcgtccgggtctcctggacagtcagtcaccatctcctgcactggaatcagcagtgacctgagtccttataactatgtctctgacaacacaccagcaaacgcccaaatcattattangatcatagcgccctgagggtcctgatcgcttctctggctaccaagtctggcgagccggtaccctccctcgtaccgtctcgtccggggcctacccgnggctagaacagtcggaggtctaggtaacttttacgttaacgngtacgtacgtactactaagtacgtcggacgacgggaccaacgaactaaacgtagttcggtacggcgttacggtacggggaccggaacgggaccgaacgttccgaccggtacccggtcgtacgggaccgacggacccgtaacggtcccgtccccggttccccgttaccggttaccctaccgttcccttaccccgttccccctaaccccgttccgttccggttaccgttcggaccgttccggtcggtacgggccggg

SEQ ID NO: 368326 - DNA, 655 bp, Homo sapiens
  misc_feature: GZ8MTXP02IHRA1.2.34.D01.1.454.CMB.2.raw
  modified_base (237)..(237): a, c, t, g, unknown or other
  modified_base (246)..(246): a, c, t, g, unknown or other
  modified_base (263)..(263): a, c, t, g, unknown or other
  modified_base (291)..(291): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagccccctcgcgtccgggtctcctggacagtcagtcaccatctcctgcactggaatcagcagtgacctgagtccttataactatgtctcctgtaccaacacaccnggacaaacnccccaaatcattattangaagtcactaagcgcctcgacgggtccngatccgtcttctcgtcggcctaccgaagtcgtcggcgaacggaccggtcctccccgtgtacccgtctcgtccgggcctccgaggtctagaacgagttcggacggtcttaaggtaactttaacgttacgtagacgtaacgtctacctaaagttacgtacgacgaacgggaccaaggtaacctaaaacgtaagtggtacggtactacggttacgggacggggtaacggacgaaacgtccgtacgtaccggtcggtacgggtacacgacccgaacggtccgtccgtccccgtcggttacccaccgttccgtacccgtttcccacccgttccgtccgtacggtacgcggttccgtcggtacggaccgg

SEQ ID NO: 368327 - DNA, 601 bp, Homo sapiens
  misc_feature: GZ8MTXP02IIVNL.2.34.D01.1.454.CMB.2.raw
  modified_base (210)..(210): a, c, t, g, unknown or other
  modified_base (215)..(215): a, c, t, g, unknown or other
  modified_base (261)..(261): a, c, t, g, unknown or other
  modified_base (289)..(289): a, c, t, g, unknown or other
  modified_base (302)..(302): a, c, t, g, unknown or other
  modified_base (352)..(352): a, c, t, g, unknown or other
  modified_base (549)..(549): a, c, t, g, unknown or other
  modified_base (567)..(567): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagcccccctcgcgtccgggtctcctggacagtcagtcaccatctcctgcactggaatcagcagtgacctgatccttanaactntgtctctagtaacaacacaccagcaaacgccccaaatcattattanagaatcactaagccgcctcgagggtccngactcgtctttcnctggcctaccgaatcgtaggcgacgaccggtccctcccgtagaccccgtntccgtcgggcctaccgaggtctaggaatagtggagtcttagtaatttaacttcgacgcgtagtcatatagtgacgaggaccgaagaacaaacgtaaagtcggtaggacgttacgttcgggggaacggtacgggaacgtaggcgtacgtaccgttcgtacggtacaccgaccgacgtccgtacccgtcccgtcgtacncctttcgacccgttcccnccgttcctcgtacgcgtacgtcgtcgacggtcgg

SEQ ID NO: 368328 - DNA, 564 bp, Homo sapiens
  misc_feature: GZ8MTXP02IU1RK.2.34.D01.1.454.CMB.2.raw
  modified_base (215)..(215): a, c, t, g, unknown or other
  modified_base (299)..(299): a, c, t, g, unknown or other
  modified_base (366)..(366): a, c, t, g, unknown or other
  modified_base (385)..(385): a, c, t, g, unknown or other
  modified_base (387)..(387): a, c, t, g, unknown or other
  modified_base (389)..(390): a, c, t, g, unknown or other
  modified_base (392)..(392): a, c, t, g, unknown or other
  modified_base (395)..(395): a, c, t, g, unknown or other
  modified_base (398)..(398): a, c, t, g, unknown or other
  modified_base (530)..(530): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgccccctccgcgtccgggtctcctggacagtcagtcaccatctcctgcactggaatcagcagtgactgatctataactatntctctgtaccaacaacaccagacaaagccccaaatcattattatagaagtcataagccgcctcgacggggtcctgatcgcttcncgtgctcgaagtcgtggacgagaccggtcctcccgtcgaccgtctcgtgggcctcgagctaggaagntgagctagtattattacgncntnnanagnganagcaagacaatagtgtagacgtaggtacgggacggaaacggacgaacgcgtaccgtaaccggtcggtcggtaccgacgaccgaacggtccctcccggaccccgtcgtacctaccttccttacccgttccccncccttccgtcgtcgtacgcgtcgtacgacggcgg

SEQ ID NO: 368329 - DNA, 636 bp, Homo sapiens
  misc_feature: GZ8MTXP02JUC0E.2.34.D01.1.454.CMB.2.raw
  modified_base (271)..(271): a, c, t, g, unknown or other
  modified_base (297)..(297): a, c, t, g, unknown or other
  modified_base (307)..(307): a, c, t, g, unknown or other
  modified_base (345)..(345): a, c, t, g, unknown or other
  modified_base (374)..(374): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcacgcccccctcgcgtccgggtctcctggacagtcagtcaccatctcctgcactggaatcagcagtgacctgagttccttaataactatcgtctcctaggtaaccaaacacaccaggacaaacgccccaaatcattattangaagtcactagccgcctgacggtccngatcgcttcncgtcggctaccgaagtcgtagggcagaccggcctccgngtaccgtctcgtcgggctcgagctagaancgtggaggttctagttacttagtacgtagacgactacctataattacgcgaacgacgacaaacgtaacctaagtagtacggtacgtacgttacgggtaccgggagggaaaccggacggaacgtaccgtacggtacccggtacggtacggaccgaacccgaccgggtacgtccgtaccccgtcccggttaacgtcccgtacgtccccgttcccgtccctcccgttcgtccggtacggtcgtccggtcgttcggaacgccgggg

SEQ ID NO: 368330 - DNA, 628 bp, Homo sapiens
  misc_feature: GZ8MTXP02F98Q8.2.34.D01.1.454.CMB.2.raw
  modified_base (254)..(254): a, c, t, g, unknown or other
  modified_base (308)..(308): a, c, t, g, unknown or other
  modified_base (343)..(343): a, c, t, g, unknown or other
  modified_base (363)..(363): a, c, t, g, unknown or other
  modified_base (390)..(390): a, c, t, g, unknown or other
  modified_base (451)..(451): a, c, t, g, unknown or other
tcagacgctcgacacacgaccggtgctcgatttagatcgtctgtgttgggtttgggggtctcaggaggcagcgctctcaggacgtcaccaccatggcctgggctctgctcctcctcaccctcctcactcagggcacagggtcctgggcccagtctgccctgactcacgcccccctcgcgtccggtctcctggacagtcagtcaccatcctcctgcactggaatcagcagtcgacctgtacttccttaataactntgtctctagtaaccaacaaccaccaggacaaacgaccccaaatctatttattangaatcactaacgccgcctgacgggtccagactcgnttctcgtcgctacgagtcgnggacgacgccgtcctccgtgtcccgtntcggtcgggtcctacgagtctaagaacgtagtgacgtacttagttaactttacgttaacgngtacgtacgtactacagttacgcgacgtaacgacgaacgaacgtaaacgtagtacgtacggtacgttaacgggtaccgggaacgggtaaaccggaacgtacggtaccggtaccggtaccggttaccggtaaccggtaccgaaccggtacccggtacgtcccgtcccgtacccgtacg

SEQ ID NO: 368331 - DNA, 650 bp, Homo sapiens
  misc_feature: GZ8MTXP02GFBNP.2.34.D01.1.454.CMB.2.raw
  modified_base (263)..(263): a, c, t, g, unknown or other
  modified_base (311)..(311): a, c, t, g, unknown or other
  modified_base (586)..(586): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcacgccccctcgcgtccgggtctcctggacagtcagtcaccatctcctgcactggaatcagcagtgacctgatccttataactatgtctcctgtaccaacaccaccaggacaaacgccccaaatcattattangaagtcaagtaacgccggccctacgacggggtccctgatccgctttcncgtggcctacagtctggcgagaccggtcctcccgtgtaccgtgtcgtccgggcctccgagggtctaggaagactgggaacggtcttaggtaatttactacgtgacctagcttacaagttacgtcggacgaggaccaagaacgaaacgtaagtggtaacggtcgtaaggttccgggggaacggggaaccgggaaccaggtaccgtacgggtaacccgttccggtcgggacgaccggaccccgaacgggtcccgtccggtcccccgtcggttacccnccgttaccgttcccgtccccgtcccctccgtcgttacggcgtacggtcgtacggtacggccggg

SEQ ID NO: 368332 - DNA, 636 bp, Homo sapiens
  misc_feature: GZ8MTXP02FOQKE.2.34.D01.1.454.CMB.2.raw
  modified_base (220)..(220): a, c, t, g, unknown or other
  modified_base (277)..(277): a, c, t, g, unknown or other
  modified_base (309)..(309): a, c, t, g, unknown or other
  modified_base (320)..(320): a, c, t, g, unknown or other
  modified_base (333)..(333): a, c, t, g, unknown or other
  modified_base (350)..(350): a, c, t, g, unknown or other
  modified_base (383)..(383): a, c, t, g, unknown or other
  modified_base (403)..(403): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcacgcccccctccgcgtccgggtctcctggacagtcagtccaccatctcctgcactggaatcagcagtgacctgagttccttataactntgtcctcctaggtaaccaacaaccacccaggccaaacgcccccaaatcatttattangaagtcactaacgcggccctcgaggggtcccngatcgctttcnctggctccagtcnggcacgacggccctccngaccgtctcgtcgggcctccgaggctagaacgntgaggctgtatttacttacngacacgtctacagtagtcgacgaggactaacgaacaaagtagtggtacggtacgtacggttaccggggacggggaacgggaaccgaacggtccgtaccggtacccgttccggtacgggaccaccgacccgaacgggtcctacccggtcccccgtacggtacctaccgttcccgttacccgtaccccctacccgttccgtacgttacgtccgacgtccgtaccgtacggtacgg

SEQ ID NO: 368333 - DNA, 628 bp, Homo sapiens
  misc_feature: GZ8MTXP02IIQRP.2.34.D01.1.454.CMB.2.raw
  modified_base (300)..(300): a, c, t, g, unknown or other
tcagacgctcgacacacgaccggtgctcgatttagatcgtctgtgttgggtttgggggtctcaggaggcagcgctctcaggacgtcaccaccatggcctgggctctgctcctcctcaccctcctcactcagggcacagggtcctgggcccagtctgcccctgactcagccccccctcgcgtccgggtctcctggacagtcagtcaccatctcctgcactggaatcagcagtgacctgatccttataactatgtctctggtaccaacaacaccagacaaacgccccaaatcaattatttangaaacgtcaataagccggaccctcgacggggtccctagactccgcttacctcgttcggaccctccaaagtcgtacgggacgacggaccggggtcccctacccgtacgtaccccgttctcgtacggggccctaccgaggccgtagaagtagtcgaagggtctaggtaatttaacgttacgtcgactacgtactacgagtatacgacgacgacacgaactaactaagtggtacgacgtacggttacgggacgggaacggaaccgtaacgccgtacggtacccgttacggtcggtacacgacccgaacgtccgtacccgtccccgtaccgg

SEQ ID NO: 368334 - DNA, 600 bp, Homo sapiens
  misc_feature: GZ8MTXP02H6MCZ.2.34.D01.1.454.CMB.2.raw
  modified_base (265)..(265): a, c, t, g, unknown or other
  modified_base (285)..(285): a, c, t, g, unknown or other
  modified_base (368)..(368): a, c, t, g, unknown or other
  modified_base (392)..(392): a, c, t, g, unknown or other
tcagacgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctctggtaccaacaacacccagcaaagccccaaactcattattangaatcactaaagcggccctnaggggtccctgatcgcttctctggctcccaagtctggcgagacggcctcccctgacccgtctctcgggctccgaggctgaagntgaggctgattattactgcagctnatatcgatacggcaagctaaaacgaatggtacggactaacgtttcggggacgggaacgggaaccgaaaaggtccctaggaacccgttcccgtaggggtaccacggaccccgtaaaggccgttacgccccccgttacggtcccaacgttcccgtacgttcccccgccccttccgttaccgtcggtaccgagtccgttacgtcgaccggg

SEQ ID NO: 368335 - DNA, 697 bp, Homo sapiens
  misc_feature: GZ8MTXP02FPIXU.2.34.D01.1.454.CMB.2.raw
  modified_base (271)..(271): a, c, t, g, unknown or other
  modified_base (302)..(302): a, c, t, g, unknown or other
  modified_base (396)..(396): a, c, t, g, unknown or other
  modified_base (405)..(405): a, c, t, g, unknown or other
  modified_base (419)..(419): a, c, t, g, unknown or other
tcagacgctcgacacacgaccggtgctcgatttagatcgtctgtgttgggtttggggctttgcctgggctctgctcctcctcaccctcctcactcagggcacagggtcctgggcccagtctgccctgactcacgcccccctcgccgtccggtctcctggacagtcagtcaccatcctctgcactggaatcagcagtgacctgatccttataactatgtcctcctgaaccaacaaccacccaggaccaaacgcccccaaatctattatttangaagtcactaagcggccctcgacgggtcccngatcgctttctctggctacccaagtccgtgggacgacgtcccggtccctcccgtgacccgttcgtcgtccggggtcctccgaggtctaggaaangtggacgtntagtatttactagngtctagtctatatatgacgagaccaagtaaccaaagtaagtcggtacgtacgttacgggttcccggggaacggtaaccgggaacccgaggtacccggtaccggtaccccgggtcgggtaccggaccgaccggaaccggtacccggtccgtaccccggtccccgttacggtacccttacccgtttcccggttccccgtttccccccgttcccgttccccggtaacggttacccggttaccgggtaccggtttccccggtacggtacccgggtaccgggg

SEQ ID NO: 368336 - DNA, 524 bp, Homo sapiens
  misc_feature: GZ8MTXP02JIGXQ.2.34.D01.1.454.CMB.2.raw
  modified_base (265)..(265): a, c, t, g, unknown or other
  modified_base (403)..(403): a, c, t, g, unknown or other
  modified_base (415)..(415): a, c, t, g, unknown or other
  modified_base (453)..(453): a, c, t, g, unknown or other
  modified_base (495)..(495): a, c, t, g, unknown or other
tcagacgctcgacacacgaccggtgctcgatttagatcgtctgtgttgggtttgggggctttgcctgggctctgctcctcctcaccctcttcactcagggcacagggtcctgggcccagtctgccctgactcagcccccctccgcgtccgggtctcctggacagtcagtcaccatctcctgcactggaatcagcagtgacctgagtccttataactatgtctctggtaccaacaacacccagcaaagccccaaactcattattangaagtcactaagcggccctgacggggtcccctgatcgcttctctggctcaagtctggcgacgacggcctcccgtgaccgtctcgtcggggcctccgagctagaagctggaggctgtattattactgcagctacattangcagcagacaanatgtgacagttcggacggacggacaagcgtagccgtcnggtcacgcacgctccgacccgtcgtccactccgtcgtacccnccctcgtctcgtcgagtccgtcgtcgcgg

SEQ ID NO: 368337 - DNA, 652 bp, Homo sapiens
  misc_feature: GZ8MTXP01D6KW8.17.37.D04.1.454.CMB.2.raw
  modified_base (424)..(424): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcggccaccctcggtgtcagtggccccaggcagacgccaggatacctgtggggaaacaatgttggaagtaaactgtgcactggtaccagcagaagccaggccaggcccctgtgctggtcgtctatgatgactaccgaccggccctgagggactcccctgagcgtattctcgtcggccctaccaaactcgtaggggaaccaaccgggcccaacccgtgaacccagtccgggacgaggggtacgaaacggcccgggggaanaggacggcctattagttagtgtacgaggtggtagggtaatagtagtaggtacgtatacgtagttggtaggtacgtcggggacgggaacggtaaccgtaacggtccgtacggtaacccgttcgttacggtaccgaccggacccgtaacggttcccgttcccggttcccccgttcggtaccctaaccgttcccgttacccgttaccccctaaccccgttcccgtaacccg

SEQ ID NO: 368338 - DNA, 559 bp, Homo sapiens
  misc_feature: GZ8MTXP01DE1UX.17.37.D04.1.454.CMB.2.raw
  modified_base (491)..(491): a, c, t, g, unknown or other
  modified_base (541)..(541): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttaggaaagtaaaactgtgcactggtaccagcagaagccaggccaggcccctgtgctggtcgtctatgatgactacccgaccggcctcgagggactccctgagcgtattctctcggcctccaactctaggggaaaccacgggcccacccgtgaacccagtccgggacgagggggtacgaaacgggccggggatcgggacggccgaacgttattagttgtacgaggtgtgggatagtaggtagtgatcgatgtgtagtcggnggagggaccaagctgaccgttcgtggcacgccaggcttcgcccctggtcnctcttcgttccttctccc

SEQ ID NO: 368339 - DNA, 589 bp, Homo sapiens
  misc_feature: GZ8MTXP01DL08F.17.37.D04.1.454.CMB.2.raw
  modified_base (266)..(266): a, c, t, g, unknown or other
  modified_base (367)..(367): a, c, t, g, unknown or other
  modified_base (411)..(411): a, c, t, g, unknown or other
tcagcgtagactagcacgaccggtgctcgatttagtagcatactgttgggtttggggagtctgggcctaaggaagcagcactggtggtgcctcagccatggcctggaccgttctcctcctcggcctcctctctcactgcacaggctctgtgacctcctatgtgctgactcagccaccctcggtgtcagtggcccaggcagacgcaggattacctggtaggggaaacaatgttagaaagtaaaactgtgcactggtaccagcagaanccaggccaggcccctgtgctggtcgtctatgatgatacccgaccggccctgagggactcccgtgacgcgattctcctggctccaaactcgaagggaaaccncggcccaccctgacccagtcggacagggcgaaaggccggggaangacgacgtatattagtgacgaggtggtaggtatagggtagtagtgactgtagtggtaggtacgtcgggacgggaacggaccgaagtcgtcggttacccgttcgttggaccgacgacccgacggttcccgtcccgcccccgttcggtcctaccgttcccgttcccgttccccgtccccg

SEQ ID NO: 368340 - DNA, 531 bp, Homo sapiens
  misc_feature: GZ8MTXP01BQHZU.17.37.D04.1.454.CMB.2.raw
  modified_base (316)..(316): a, c, t, g, unknown or other
  modified_base (427)..(427): a, c, t, g, unknown or other
  modified_base (500)..(500): a, c, t, g, unknown or other
  modified_base (512)..(512): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttaggaagtaaaactgtgcactggtaccagcagaagccaggccaggcccctgtgctggtcgtctatgatgataccgaccggccctnagggactccctgagcgattctctcggcctcaactctagggaaaccacgggcccaccctgacccagtcggcagggtcgaagccgggatggaggccgatattatgtcaggtgngggatagtagggtagtgatcgatgtggtattcgggcggagggaccaagctgaccgttctggcgagcccaggcncgcccctggtcnctcttcgtccccgccctcc

SEQ ID NO: 368341 - DNA, 622 bp, Homo sapiens
  misc_feature: GZ8MTXP01CDEIY.17.37.D04.1.454.CMB.2.raw
  modified_base (336)..(336): a, c, t, g, unknown or other
  modified_base (381)..(381): a, c, t, g, unknown or other
  modified_base (507)..(507): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggccccagggcagacggccaggattaccgtggtaggggaaacaatgttaggaaagtaaaactgtgcactggtaccagcagaagccaggccaggcccctgtgctggtcgtctatgatgactacccggaccggccctcgagggactcccgngacgcgtattcgtcgtcggcctaccgaactcgtacgggaaaaccnccgggcccacccgtgaacccagtcgggacgaggggtaccgaaggccggggatggacggccgtaacgtatttacgttgtcgagggtgtaggataggtaggtagtgactgagtgtaggtagttcgggnggaacgggaccaaggctaacggtacccgttccgttgggttaccacgcccgaacgggttccgttcccgtcccccgtcggttccaccgttccgttccgtcccccttaacccttcccg

SEQ ID NO: 368342 - DNA, 534 bp, Homo sapiens
  misc_feature: GZ8MTXP01DBHUG.17.37.D04.1.454.CMB.2.raw
  modified_base (337)..(337): a, c, t, g, unknown or other
  modified_base (360)..(360): a, c, t, g, unknown or other
  modified_base (526)..(526): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttaggaaagtaaactgtgcactggtaccagcagaagccaggccaggcccctgtgctggtcgtctatgatgataccgaccggcctcgagggactccctgagcgattcnctggcctcaactctgggaaaccncggccaccctgacccagtcggcaggggtcgaagccggggatggaggccgactattattgtcaggtgtgggatagtagggtagtgatcatgtggtattcggcggaggaccagctgaccgttcgtggttcacgccaggcttcgcccctcggtcacgtcttcgttcccncccttccc

SEQ ID NO: 368343 - DNA, 712 bp, Homo sapiens
  misc_feature: GZ8MTXP01DCPS6.17.37.D04.1.454.CMB.2.raw
  modified_base (363)..(363): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattaccgtgtggggaaacaatgttaggaaagtaaactgtgcactggtacagcagagcaggccaggccctgtgctggtctctatgatgatacccgaccggccctgagggactcccgtgagcgattctctcggcctccaactccgtagggaaacccnccgggcccaccctcgacccagtccgggcgaggggtcgaacggcccgggggatgggacggaccgtacgttaagtttacgtttgtcgagggttgggtgggtaagttagggttaggggttaaggttggtaattcgaagttgggttagggttacgtttaccggggacggggtaacggggaacccgtaaacggccgttaacgggtaaccccggtttcccggtttacggggttacccgaaccgggtcccccgttaaaggggttccccttacccgggtccccccccgtttcggggtcccctaacccgtttccccgtttcccggtttaacccccccgttaacccccgttttcccccg

SEQ ID NO: 368344 - DNA, 769 bp, Homo sapiens
  misc_feature: GZ8MTXP01AWOQK.17.37.D04.1.454.CMB.2.raw
  modified_base (306)..(306): a, c, t, g, unknown or other
  modified_base (408)..(408): a, c, t, g, unknown or other
tcagcgtagactagcacgaccggtgctcgatttagtagcatactgttgggtttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccagggcagacggccaggattaccgtggtagggggaaacaagtggttaggaaagtaaaactgtgcacgtggtaccagcagaagccgaggccacggcccctgtcgctggtctntatgatgactaccggaccgcctacgacgggtactcccgtgacgtcgtactttccgtccgtcggtacctaccgtaaaccgttccggtaaacggggaaaccccncccggggacccctaaaccccgtcgaaaccccgtacggtcccggggacggtaacgggggtaccggaaacggggcccgggggaagtacgggaaccgggtacccgtaaacgtttagtttaacgtttcggtacggtaaggggttggtaggggtaagttaaggggttaaggtaggtagtactacgtaagttgggttaggttaacggttcggggacggggtaacggggtaaccagggtccgttacgggaccccggtttccgttacgggtacccgaaccgggttaccccgaacgggttcccgttccccgggccccccgttcgggtacccctacccgttcccgtttccccggtttccccccgtcccccg

SEQ ID NO: 368345 - DNA, 647 bp, Homo sapiens
  misc_feature: GZ8MTXP01DGOTT.17.37.D04.1.454.CMB.2.raw
  modified_base (349)..(349): a, c, t, g, unknown or other
  modified_base (387)..(387): a, c, t, g, unknown or other
  modified_base (498)..(498): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctggtgtcagtcggccccagggcaggacggccaggacttaccgtggtagggggaaacaagtggttaggaaagtaaaactgtgcacgtggtaccagcaaggaagccaggcccaggccccctgtgcgtggtcgtctatgatcgactacccggaccggccctacgagggtactcccgngagcgtattcgtctcggcctacaactcgtaggaaaccncggcccaccgtcgaccgtagtccggacgagggtacgaacgggccgggaatcgggacggaccgtacttagtttagttcggtacgaggtggtaggtagtaggtaggtagtagntagagtgtggttagtcgggacggtacggaccgtaaggtcgtaacgtacccgttcgttacggttccgaaccggacccgaaggcccttcccggtcccccgttccggtaacctcccgttccgttccccgttcccccgttccccgtttccccg

SEQ ID NO: 368346 - DNA, 516 bp, Homo sapiens
  misc_feature: GZ8MTXP01BYZX0.17.37.D04.1.454.CMB.2.raw
  modified_base (363)..(363): a, c, t, g, unknown or other
  modified_base (460)..(460): a, c, t, g, unknown or other
  modified_base (488)..(488): a, c, t, g, unknown or other
  modified_base (498)..(498): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctggtagggggaaacaatgttaggaaagtaaaactgtgcactggtaccagcagaagccaggccaggcccctgtgctggtcgtctatgatgataccgaccggcctcgagggactcccgtgagcgattctctcggctcaactctgggaaacncggccaccctgaccatcggcagggtcgaagccggggatggaggccgactattagttgtcgaggtgtgggatagtaggtagtgatcatgtgtatcggnggaggacagctgcgttctgcagccagcncgcccctgcnctcttcgtcccgctcccg

SEQ ID NO: 368347 - DNA, 615 bp, Homo sapiens
  misc_feature: GZ8MTXP01CPMOO.17.37.D04.1.454.CMB.2.raw
  modified_base (338)..(338): a, c, t, g, unknown or other
  modified_base (394)..(394): a, c, t, g, unknown or other
  modified_base (444)..(444): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggccccagggcagacggccaggacttaccgtggtagggggaaacaagtggttaggaaagtaaactgtgcactggtaccagcagaacgccaggccacggcccctgtgctggtctctatgatgactaccgacccggcctcgagggactcccgngacgcgtacttcgcgtcggcctacacgtcgaggaaaccaccggcccaacctgaccngtccgggcgagggtacgaacggccggggatggacgggccacgtaagtttntcggtagagggtggtaggtagttaggtaggtaaggtgatcgagttggtagggttacgttcggggacgggtaacgggaccaaggtccgaaggtacccgttcgttcggacgacggcccgaggcccttccgccccgtcggtcctacttccgttccgttccccttcccgttcccg

SEQ ID NO: 368348 - DNA, 553 bp, Homo sapiens
  misc_feature: GZ8MTXP01AB1WC.17.37.D04.1.454.CMB.2.raw
  modified_base (333)..(333): a, c, t, g, unknown or other
  modified_base (355)..(355): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtggggaaacatgttaggaagtaaaactgtgcactggtaccagcagaagccaggccaggcccctgtgctggtcgtctatgatgataccgaccggcctcagggatccctgagcgattcnctcggctcaactctgggaaacncggccaccgtgaccagtcggcaggggtcgaacgccggggatggaggccgactattagttgtcagggtgtgggattaggtagtagtcggatcgatgtggtagttcgggcggaggaccaagcgtgaccgttcgttcggcacggcccgaaggccttcggccccctcggtccaccgtccttcggttccccaaccccgttccc

SEQ ID NO: 368349 - DNA, 594 bp, Homo sapiens
  misc_feature: GZ8MTXP01C2LWU.17.37.D04.1.454.CMB.2.raw
  modified_base (286)..(286): a, c, t, g, unknown or other
  modified_base (376)..(376): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccacctcggtgtcagtcggccccagggcagacggccaggattaccgtggtagggggaaacaagtggttaggaaagtaaaactgtgcatggaccagcagagccaggccaggcccctgngctggtcgtctatgatgactacccgacccggccctcgagggactcccgtgacgcgtattctcgtcggcctaccaactcgtagggaaaccnccggcccaccctgacccagtcgggacgaggggtacgaacggccggggagtcggacggccgtacgtagttagtgtcgaggtgtagggtatagtaggtagtgatcgagtgtggtagttcgggcggtaagggacaagcgtcggtaccgttcgttcggcgtaacgcccgaacggcttccgcccccgtcggtcctccgtcttccgttccccgccccgttcccg

SEQ ID NO: 368350 - DNA, 597 bp, Homo sapiens
  misc_feature: GZ8MTXP01BOX8R.17.37.D04.1.454.CMB.2.raw
  modified_base (284)..(284): a, c, t, g, unknown or other
  modified_base (296)..(296): a, c, t, g, unknown or other
  modified_base (372)..(372): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctctatgtgctgactcagccacctcggtgtcagtcggcccagggcagacggcaggattaccgtggtaggggaaacagtggttaggaaagtaaaactgtgcactggtaccagcagaacgccaggccaggccctgngctggtctctangatcgactacccgaccgcctgacggctcccgtgacgcgtattcgtcgtcggcctacaacgtcgtacgggaaaaccnccggcccacctgacccagtcggacgaggggtcgaaacgggcggggatggacgggtacctaattaagtttagtggtacgagggttggtagggtaattaggtagggtaagttgatcgtagtggtggtagtcgggagtaacgggacagcgtaacgtccgttcgtgcgaacgcccgaggccttacccgcccgtcggtaacctcgtccttcccggtccccgcctttcccg

SEQ ID NO: 368351 - DNA, 678 bp, Homo sapiens
  misc_feature: GZ8MTXP01EB1X4.17.37.D04.1.454.CMB.2.raw
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagcccaccctcggtgtcagtcggccccagggcagacggccaggattacctggtaggggaaacaagtgttaggaaagtaaaactgtgcactggtacagcagagcagcaggcccctgtgctggtcgtctatgatgactacccgaccgcctcgaggactcccgtgagtcgattctctcggcctacaactcgtagggaaacccacggcccacccgtgacccagtccgggacgaggggtacgaacggccggggatggacgggaccgtaacgttaagtttacgttggtacgtaagggttgggtgggtaaagttaggttaaggggtaaggtcggtaattacgtaagttggttagggttaacgtttcggggacgggtaacggggaaccaacggcgttaacggtacccgttccggttcgggttaccgaacggtacccgaaacggttccgttcccgggtccccccgttcgggtccctaacccgttccgttacccgggtttccccccgccccgttttccccg

SEQ ID NO: 368352 - DNA, 594 bp, Homo sapiens
  misc_feature: GZ8MTXP01B9MEH.17.37.D04.1.454.CMB.2.raw
  modified_base (570)..(570): a, c, t, g, unknown or other
  modified_base (585)..(585): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattaccgtgtagggggaaacaagtgttaggaaagtaaaactgtgcactggtaccagcagaagccaggccaggcccctgtgctggtcgtctatgatgactaccgaccggcctcgagggactcccgtgacgcgtattctcgtcggcctaccaactcgtacggggaaaaccacccgggcccacccgtgacccagtccggacgaggggtacgaacggccggggatcgggacggccgtaacttagttagtggtacgaggtgtagggataggtagggtagtgtatcgagttggtggtagttcggggcggtacgggacaggctcggaccgttcgttggcgaacgcccgaggccttccgccccgtgtccnctcgttccgtccccnccgttcccg

SEQ ID NO: 368353 - DNA, 567 bp, Homo sapiens
  misc_feature: GZ8MTXP01AD5KL.17.37.D04.1.454.CMB.2.raw
  modified_base (362)..(362): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttaggaagtaaaactgtgcatggtaccagcagaagccaggccaggcccctgtgctggtcgtctatgatgatacccgaccggccctcgaggggactccctgagcgattctctggcctcaactcgtggaaaccncgggcccaccctgacccatcggcagggtcgaagccgggatggaggccgactattattgtcagggtgtagggattaggtagggtagtggatcgagtggtggtattcgggcgggtagggaccaaggcgtgacccgttcgttggttccgagccccgaaggcccgttcgcccccgtggtccactccttcgtttccccaacccgttcccg

SEQ ID NO: 368354 - DNA, 620 bp, Homo sapiens
  misc_feature: GZ8MTXP01A8DLR.17.37.D04.1.454.CMB.2.raw
  modified_base (281)..(281): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagcccaccctcggtgtcagtcggccccagggcagacggccaggattaccgtggtaggggaaacatggttaggaagtaaactgtgcactggtaccagcagagcagcaggccctgngctggtcgtctatgatgactacccggccgccctcgagggactcccgtgagcgtattctcgtcggctaccaacgtcgtgggaaaacccacgggccccaccctacgacccacggtccgggacgaggggtcgaacgggccggggagtcggagggacccgtattaacgtttagttcggtacgaggttgggtagggaattacgggtaggtaggtgaactgtaagtggttaggttacgttacggggcggtaacgggacccaagtcgtaacgtaccgttcgtggttcgacggtcccgaggcccttccggcccctcggcctccttcgttcccgtccccgccttcccg

SEQ ID NO: 368355 - DNA, 624 bp, Homo sapiens
  misc_feature: GZ8MTXP01BH4H3.17.37.D04.1.454.CMB.2.raw
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagcccaccctggtgtcaggtcggccccagggcagacggccaggattacctggtagggggaaacaagtggttaggaaagtaaaactgtgcacgtggtaccagcagaagccaggccaggcccctgtgctggtcgtctatgatgactaccgaccggccctgagggactcccgtgagcgtattctctcggcctacactcgtacgggaaaccaccggcccacctgaccagtcgggcaggggtcgaacggccggggtatacgggacggaccgtattagtttagttcgtagagggtgtagggaattaggtaagggtgtaggtatagtagttggtcggttaggttccggggaggtacgggaccaaggtcgtcggtaccgttccgtaggttccgacggtcccgaacggttccgttccgtccccctcgggtccaccgttccgttccgttcccccgcccgtttccccg

SEQ ID NO: 368356 - DNA, 593 bp, Homo sapiens
  misc_feature: GZ8MTXP01BFKXL.17.37.D04.1.454.CMB.2.raw
  modified_base (346)..(346): a, c, t, g, unknown or other
  modified_base (371)..(371): a, c, t, g, unknown or other
  modified_base (497)..(497): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagcccaccctcggtgtcagtcggccccagggcagacggccaggattacctggtagggggaaacaagtgttaggaaagtaaaactgtgcactggtaccagcagagcaggccaggcccctgtgctggtcgtctatgatgatacccggaccggccctcgagggactcccgtgacgcgattcnctcggcctacaactcgtggaaaccncggcccaccctcgaccagtcgggacgagggggtcgaacgggccggggatgggacggccgaacttagttacgttggtcgaagggtgtagggattaggtaggtacgtgatcgatggtggtagtcgggnggagggaccaggctggaccgttctggcgacggtcccgacggcttccggtaacccccgtcgggtcctccgttcgttccgttccccgcccttaacccg

SEQ ID NO: 368357 - DNA, 749 bp, Homo sapiens
  misc_feature: GZ8MTXP01B4FS4.17.37.D04.1.454.CMB.2.raw
  modified_base (412)..(412): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcacgcccaccctcggtgtcaggtcggccccagggcaggacggccaggattaccgtggtaggggaaacaagtggttaggaaagtaaactgtgcacgtggaccagcaaggaacgccaggccacggcccctggtgcgttggtcgtactatggatggaactaccccggacccggcccctaggacgggtactcccgtggacgtcgtacttcgtcgtcggccttaccgaacgttccggacggggaaaacccncccgggccccaacccgtcgacccgtacggtcccggggacggtaacgggggtaccgggaaccggggaccgggggaagttacggggaaccgggacccggttaacgtttaagtttagtttacggtacgggtagggttgggtacggggtaagttaagggttaggggttaggtagtagttcgtaagttgggttaggttacggttcggggacggggaacgggtaacccgtaaggcgttaacggtacccgtttccggttacggttcgaccggtcccgaacggttcccgttacccggccccgtcggtcctcccgtccgttcccgttcccccgttcccgttccccg

SEQ ID NO: 368358 - DNA, 686 bp, Homo sapiens
  misc_feature: GZ8MTXP01DJ0UJ.17.37.D04.1.454.CMB.2.raw
  modified_base (282)..(282): a, c, t, g, unknown or other
  modified_base (333)..(333): a, c, t, g, unknown or other
tcagcgtagactagcacgaccggtgctcgatttagtagcatactgttgagtctgggcctaaggaagcagcactggtggtgcctcagccatggcctggaccgttctcctcctcggcctcctctctcactgcacaggctctgtgacctcctatgtgctgactcagccacctggtgtcagtcggccccagggcagacggccaggtacttaccgtggtagggggaaacaagtggtaggaaagtaaaactgtgcacgtggacagcagaagccaggccaggcccctgngctggtctctatgatgaactacccggacccggccctacgagggactcccgngagcgtattctcgtccggcctacaacgtcgtacgggaaaccacccgggtcccacccgtggaaccctacgccgggacgacgggggtacgaacgggccggggatcgggacggcccgtaattaacgttattggtacgagggttggtagggtaagttaaggtaggggttaggtacgtaaagttcgagttggtaggttaggttcgggggacggtaacggggaaccaaaggtccggttaaacggtccccggtttcgttcggggaccaaccgggtaccccgaagggttcccgttcccggtaacccccgtcgggttaaccctacgtcccgtttcccggttccccccgttccctttccccgg

SEQ ID NO: 368359 - DNA, 663 bp, Homo sapiens
  misc_feature: GZ8MTXP01A74M3.17.37.D04.1.454.CMB.2.raw
  modified_base (289)..(289): a, c, t, g, unknown or other
  modified_base (325)..(325): a, c, t, g, unknown or other
  modified_base (335)..(335): a, c, t, g, unknown or other
tcagcgtagactagcacgaccggtgctcgatttagtagcatactgttgagtctgggcctaaggaagcagcactggtggtgcctcagccatggcctggaccgttctcctcctcggcctcctctctcactgcacaggctctgtgacctcctatgtgctgactcagccaccctcggtgtcagtcggccccagggcagacggccaggattacctggtagggggaaacaatggttaggaaataaactgtgcactggtaccagcagaagcaggccaggccctgtgcgtggtcgtntatgatcgactacccgaccgcctcgagggactcccngagcgattcnctcgcctcaagtcgagggaaacaccggcccaccgtcgaccacgtcgggcgaggggtacgaacggcgggagtcggacggacccgtagttaagttacgtttggtacgtaagggttggtagggtaagttaggtaaggggttaggtaggtattacgtaagttggttcgggttaacgttccgggggacggggtaacggggaaccaaacgggtccgtaacggtaacccggttcggttcgggttaccgacggaccccgttaacgggttcccgttccggtccccccgttcggtcccgtcccttcgttacccgttccccgttaaccccgtttccccg

SEQ ID NO: 368360 - DNA, 615 bp, Homo sapiens
  misc_feature: GZ8MTXP01A4SRC.17.37.D04.1.454.CMB.2.raw
  modified_base (371)..(371): a, c, t, g, unknown or other
tcagcgtagactagcacgaccggtgctcgatttagtagcatactgttgagtctgggcctaaggaagcagcactggtggtgcctcagccatggcctggaccgttctcctcctcggcctcctctctcactgcacaggctctgtgacctcctatgtgctgactcagcccacctcggtgtcagtcggccccagggcagacggccaggtattaccgtggtaggggaaacaagtggttaggaaagtaaactgtgcacgtggacagcagagccaggccacggcccctgtgcgtggtcgtctatgatgactaccggaccgccctcgagggactcccgtgagcgattcgtcgtcggcctaccaacgtcgtacggaaaccnccggcccacctgacccagtcgggacgaggggtacggacgggcgggagtcggacgccgtacttagttacgttgtcgtaggtgtagggagttagtagggtagtgactgagtgtggttacggttcgggagggtacgggaccgaaggtccgtcgtacccggttcgttcggccgacggcccgaacggttccgttcccgtccccgtcggtcctaccgtccgttccgttcccccgttaacccgtttccccg

SEQ ID NO: 368361 - DNA, 556 bp, Homo sapiens
  misc_feature: GZ8MTXP01BSLZS.17.37.D04.1.454.CMB.2.raw
  modified_base (371)..(371): a, c, t, g, unknown or other
  modified_base (475)..(475): a, c, t, g, unknown or other
  modified_base (537)..(537): a, c, t, g, unknown or other
  modified_base (550)..(550): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtggggaaacatgttaggaagtaaactgtgcactggtaccagcagaagccaggccaggcccctgcgcgtggtcgtctatgatgactacccgaccggccctcgagggactcccgtgacgcgtattcctcgtcggcctaccaactcgtcgggaaaccncggcccaccctgaccatcgggcaggggtcgagccggggatggaggccgactattattgtcgaggtgtgggatagtaggtagtgattcgagtgtggtagtcgggnggacgggaccaaggcgtcggaccgttcgttcggcacggcccaaggccttcgcccctggtccnctcttcgtccccncctccc

SEQ ID NO: 368362 - DNA, 599 bp, Homo sapiens
  misc_feature: GZ8MTXP01EF1NL.17.37.D04.1.454.CMB.2.raw
  modified_base (287)..(287): a, c, t, g, unknown or other
  modified_base (289)..(289): a, c, t, g, unknown or other
  modified_base (300)..(300): a, c, t, g, unknown or other
  modified_base (331)..(331): a, c, t, g, unknown or other
  modified_base (372)..(372): a, c, t, g, unknown or other
  modified_base (516)..(516): a, c, t, g, unknown or other
  modified_base (592)..(592): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagcccacctcggtgtcagtcggccccagggcaggacggccaggattaccgtggtagggggaaacaattggtaggaaagtaaaactgtgcacgtggaccagcagacgcagccaggccctgngntggtcgtctangatgatacccgaccgcctgaggacttcccgngagcgtattctcgtcgcctacaacgtcgtacgggaaacccnccggcccaccctcgacctagtccggacggacggggtacgaacggccggggatcgggacggaccgtaagttaagtttagttggcgtaagggtgtaggggtaataggttaggtagtaggtatcgtaagtggtggttaggttacggngggtacggacagcgtaaggaccgttcgttcgacgacggaccaggccttccgccctgtctaccgtcttccttccccnccttccg

SEQ ID NO: 368363 - DNA, 628 bp, Homo sapiens
  misc_feature: GZ8MTXP01D5AEC.17.37.D04.1.454.CMB.2.raw
  modified_base (259)..(259): a, c, t, g, unknown or other
  modified_base (262)..(262): a, c, t, g, unknown or other
  modified_base (268)..(268): a, c, t, g, unknown or other
  modified_base (279)..(279): a, c, t, g, unknown or other
  modified_base (282)..(282): a, c, t, g, unknown or other
  modified_base (293)..(293): a, c, t, g, unknown or other
  modified_base (559)..(559): a, c, t, g, unknown or other
tcagcgtagactagcacgaccggtgctcgatttagtagcatactgttgggtttgggggccccagccctgggattcccagctgtttctgcttgctgatcaggactgcacacagagaactcaccatggagtttgggctgagtctgggttttccttgttgcttattttaaaaggtgtccagtgtgcggtgcagcgtggtgggaggtccgggggtaggtttagttcgaggccgtgggggtccctgagactctcctgtgcgctntgntcactnagtagctacgngangcacgtcggcncgaagcgtaccgaggggagggcgtggtggtcggtactcgacgttattgattacgtgatcggactaacgttaccccactatcccgtacgcggtaccctcgtcggcgacgggcctactccactctcctacaggacaacaacgaccaaagaacacgtacttgtacactacgactaaagttacggaactaggtaccaggaacggacgcgaggaccgacggtctgtacgtacctaagtcgttcgaccttaaaccgggtccgtttccccggngttaccggttcccgtcccggtaccgttaaccggtcggaccggggaccgaacgggttaacccgtaaccgg

SEQ ID NO: 368364 - DNA, 628 bp, Homo sapiens
  misc_feature: GZ8MTXP01BUMPZ.17.37.D04.1.454.CMB.2.raw
  modified_base (619)..(619): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggccccagggcaggacggccaggtattaccgtggtagggggaaacaagttggttaggaaagtaaactgtgcactggtaccagcagagccaggccaggcccctgtcgcgtggtcgtctatgatgactacccggaccgccctcgagggactcccgtggacgcgtattcctcgtcggcctaccaacgtcgtacgggaaaccaccgggccacccgtgaccacgtccgggacgacggggtacggaaacgggcccggggagtacgggacggacccgtaattaagtttacgttggtacgaggggttgtaggggtaattaggttagggtagtaggatgtagtggtgtagtcgggaggtacgggacagcgtaacggtccgttcgtcggttcgacgcccgttaagccgttccggccccgtcgaactcgtcttccgttccccncccttcccg

SEQ ID NO: 368365 - DNA, 835 bp, Homo sapiens
  misc_feature: GZ8MTXP01CIOXU.17.37.D04.1.454.CMB.2.raw
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctctatgtgctgactcacgcccacccgtcggtgtcaggtcggccccgagggcacggacggccgaggtacttaccgtgggtagggggaaactagtggttaggaaagtaaactgtgcactcggacagacagacgccgaggccacggccctggtcgcgttacggtcgtactagtgatcgacgtacccggaccggcccgcggacggacctcccgtggacgtccgtactttcgtccgtccggtaccctaccgaaacgttcggacgggggaaaaaaccctcccgggaacccctacccgtacgggaacccgtaggtacccggggacggttaacgggggaaccgggaacgggggaccgggggtaactacggggaaccgggtacccggttaattttaacgtttacggttcggtacggggtaagggttcggggttaaagggtaagtttaaaggtaggggtttaagtaccggttacgtagttaacggttggggttaaggggttacggttacggggggaaccgggaacggggtaaccgtaacgggtcccgtaaccggggttccccgttaacgggttcgggacccgaaaccgggacccgggttacccggtttcccggcccccggttaacccccccggtggttaaccccgtccctttaccccgggtttcccgtaacccccccttccggtttaacccccg

SEQ ID NO: 368366 - DNA, 614 bp, Homo sapiens
  misc_feature: GZ8MTXP01A63Z0.17.37.D04.1.454.CMB.2.raw
  modified_base (217)..(217): a, c, t, g, unknown or other
  modified_base (372)..(372): a, c, t, g, unknown or other
  modified_base (590)..(590): a, c, t, g, unknown or other
  modified_base (596)..(596): a, c, t, g, unknown or other
  modified_base (606)..(606): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccgtcggtgtcagtcggccccagggcagacggccaggattaccgnggtaggggaaacagtggttaggaaagtaaactgtgcacgtggtaccagcagaacgcaggccacggccctgcgctggtctcatgatgactacccgccgcctcgaggctcccgtgagcgtattctcgtcggcctacgtaacgtcgtacggaaaaccncccgggtccaacccgtgaacccgtagtaccgggacgaggggtacgaaacggggtccggggattcgggaacgggtccctaagttaagttgttgtacggaagggttcgtagggattaggtagggtagtggtatcgtaggtggtgttacgttacgggcggtaacgggactaggccgtgtaccgttcgtagcgacgtccgagcccttcgcccctcggtaacncgtccncgttaacccnccgttccg

SEQ ID NO: 368367 - DNA, 656 bp, Homo sapiens
  misc_feature: GZ8MTXP01AUCZT.17.37.D04.1.454.CMB.2.raw
  modified_base (625)..(625): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccgtcggtgtcagtcggccccagggcagacggccaggacttaccgtggtagggggaaacaagtggttaggaaagtaaaactgtgcactggtaccagcagaacgccaggccacggcccctgtgcgtggtcgtctatgagtgactacccggaccggcctacggacgggtactcccgtgacgcgtagttctacgtcggcctaccgaactcggtacgggaaacccaccggcccaccgtcgaacctagtccgggacgaggggtacgaacgggccggggatcgggacggaccgtaatttagttagttcgtagagggttgtaggggtaattacgggtaagggtagtgtaagtacgtaagtggtggttacggtcgggacgggacggtaaccgaaggtcgtcggtaccggttcgtcggttacgaccgtcccgaggttccttaccgggtcccctcggtaaccnccgttccgttaccgttccccgcccgttcccg

SEQ ID NO: 368368 - DNA, 762 bp, Homo sapiens
  misc_feature: GZ8MTXP01A2401.17.37.D04.1.454.CMB.2.raw
  modified_base (342)..(342): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagcccacctcggtgtcagtcggccccagggcagacggccaggattacctggtaggggaaacatgttaggaaagtaaactgtgcactggtaccagcagaagccaggccaggcccctgtgcgtggtcgtctagtgatgactaccgaccggccctagaggactccctgagcgtattcnctcggctaccaacgtcgtacgggaaaccaccggtcccaacccgtcggaacccacgttccggggacgtaacgggggtaccggaaacggggtcccggggtagtacgggaacgggtaccccgtaagtttaacgtttagtttacggtacggtaaggggttacggtaggggtaacgttaagggttaaggggtttaacggtaggttaaccttacgtaaggtttccggggttagggtttaacggtttaccgggggacgggtaacggggaaccccgtaaggtcccggttaacggtaccccgggtttccggtttacgggttaccgtaaccgggcccccgttaaagggttccccgttcccgggtaacccccccgttcgggtcccctacccgttcccgttccccggtttcccccgaacccccgtttccccg

SEQ ID NO: 368369 - DNA, 833 bp, Homo sapiens
  misc_feature: GZ8MTXP01B27KL.17.37.D04.1.454.CMB.2.raw
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagcccacccgtcggtgtcagtcggccccagggcagacggccaggacttaccgtggtagggggaaacaagtggttaggaaagtaaactgtgcacgtggtaccagcaagacgccgaggccacggcccctgtcgcgtggtctctagtgatacgactacccggaccccggtccctacggacgggacttccccgtaggacgtcggtactttcgtccgttccgggtacccttacgaaccgttccggtaacggggaaaaaaccccgacccgggtcccctaaaccccgtacgggacccctaaacgggttccggggaaccggtaacgggggtacccgggaacgggtacccgggggagttacgggaacgggtaccccgttaagtttaagtttacgtttcggtacggtaggggttagggttagggtaacgtttaagggttaacggggttaggttaggtaacttacggtaaggtttgggtttagggttaccgggtttaccgggggaccggggtaaacgggtaaccctaaacgggtccggttaacccggtaacccggtttccggttcgggttacccgaacggtaccccggttaaccggttcccgttccccggtccccccggttacggttccctaacccgttcccgtttaccccggtcccccctttaaccccgttccccg

SEQ ID NO: 368370 - DNA, 657 bp, Homo sapiens
  misc_feature: GZ8MTXP01A2GOM.17.37.D04.1.454.CMB.2.raw
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcacgcccaccctcggtgtcaggtcggccccgagggcagacggccaggtattaccgtggtagggggaaacaagttggttaggaaagtaaaactgtgacacgtggtaccagcaaggaacgccaggcccaggcccctgtgctggtcgtctatgatcgacgtacccgacccggccctagacgggtactccccgtggacgcgtattcctcgtccggcctaccgaaactccgtaggggaaacccacccgggcccaacccgtcgaccagtccgggacgacggggtaccgaacgggccggggatcgggacggccgtaatagttagtgtacgagggtgtagggattaggtaggtgtggactgagttcggtaggtacgttcggggacgggtacggaaccgaaggccgtcggtacccgttcgtacggttcgaccgcccgaaggttcccttccggcccccgttgggaacctccgtccgttcccgtccccgttccccgttcccg

SEQ ID NO: 368371 - DNA, 533 bp, Homo sapiens
  misc_feature: GZ8MTXP02JE4EO.17.37.D04.1.454.CMB.2.raw
  modified_base (361)..(361): a, c, t, g, unknown or other
  modified_base (399)..(399): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaaactgtgcactggtaccagcagaagccaggccaggcccctgtgctggtcgtctatgatgataccgaccggccctcgagggactccctgacgcgattctctcggctccaactctgggaaccncggccacctgaccatcggcaggggtcgaagccggggangaggccgactattatgtcgaggtgtgggataggtagtagtgatcagtgtggtagttcgggcggagggaccaagctcgaccgtctcggtcacgccaacggctcgccccgtcggtcactctcgttcccaccttccc

SEQ ID NO: 368372 - DNA, 532 bp, Homo sapiens
  misc_feature: GZ8MTXP02IFOH2.17.37.D04.1.454.CMB.2.raw
  modified_base (335)..(335): a, c, t, g, unknown or other
  modified_base (355)..(355): a, c, t, g, unknown or other
tcagcgtagactagcacgaccggtgctcgatttagtagcatactgttgggtttgggagtctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaactgtgcactggtacagcagaagccaggccaggcccctgtgctggtcgtctatgatgataccgaccggccctcagggatccctgagcgattcnctgctccaactctgggaacncggccacctgaccatcggcagggtcgaagccgggatgaggcgactattatgtcaggtgtgggatagtagtagtgatcatgtggtattcgggcggtagggaccaagcgtggaccgtccgttgggtcacggcccaaggcctcggcccccgtcggtccacctcctcgtttcccctacccc

SEQ ID NO: 368373 - DNA, 545 bp, Homo sapiens
  misc_feature: GZ8MTXP02GXF5U.17.37.D04.1.454.CMB.2.raw
  modified_base (366)..(366): a, c, t, g, unknown or other
tcagcgtagactagcacgaccggtgctcgatttagtagcatactgttgggtttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttaggaagtaaaactgtgcactggtaccagcagaagccaggccaggcccctgtgctggtcgtctatgatgataccgaccggccctcgagggactcccgtgagcgattctcctggctccaactcgtagggaacncggccaccctgaccagtcggcaggggtcgaaggccggggatggaggccgactattattgtcgaggtgtagggataggtagtagtgagtcagtggtggtagttcgggcggaggacaagctgaccgtctggtcacgcccaaggcctcggccccctcggtccacgtcctcgttccccacccc

SEQ ID NO: 368374 - DNA, 635 bp, Homo sapiens
  misc_feature: GZ8MTXP02IOQQ6.17.37.D04.1.454.CMB.2.raw
  modified_base (372)..(372): a, c, t, g, unknown or other
tcagcgtagactagcacgaccggtgctcgatttagtagcatactgttgggtttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctggtaggggaaacaatgttaggaagtaaaactgtgcactggtaccagcagaagccaggccaggcccctgtgctggtcgtctatgatgatacccgaccggccctcgagggactccctgacgcgattctccgtggcctccaaactcgtacgggaacnccgggcccaaccctcgacccagtccggacgacggggtacaaaacgggcccgggggaatcggaacgggcccgtaaacgttagtttaagttcggtacgtagggttggtagggggtaattaagggtaaggttagtacgtaagtcgtaagttggtagggttaacgttcggggacgggtaaggggaccaaaggtcgtacggtaccgttcgtggtcacgcccgaaggcctccgccccgtacggtcaccgtcctccgtttccccaccccg

SEQ ID NO: 368375 - DNA, 540 bp, Homo sapiens
  misc_feature: GZ8MTXP02I7ZZC.17.37.D04.1.454.CMB.2.raw
  modified_base (363)..(363): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaactgtgcactggtaccagcagaagccaggccaggcccctgtgctggtcgtctatgatgataccgaccggccctcgagggactcccctgacgcgattctctcggcctccaactcgtgggaaccncgggcccaccctgaccagtccggcaggggtcgaaagccggggatggaggccgactattattgtcgaggtgtgggatagtagtagtgatcgagtgtggtagtcgggcggaggaccaagctagaccgtcgtcggtcacgccaaggctcgccccgtggtcacgtctcgtcccgccttccc

SEQ ID NO: 368376 - DNA, 529 bp, Homo sapiens
  misc_feature: GZ8MTXP02F0M9H.17.37.D04.1.454.CMB.2.raw
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctggtgggggaaacaatgttggaaagtaaaactgtgcactggtaccagcagaagccaggccaggcccctgtgctggtcgtctatgatgataccgaccggccctcgagggactcccgtgacgcgattctctcggctccaactcgtgggaaccacgggcccaccctgaccagtcggacagggtcgaagccggggatgacggcgactattatgtcaggtgtggatagtagtagtgatcatgtggtagtcggcggaggaccagctcgaccgtctcggtcacgccacgctcgccccgtcgtcactctcgtcccgcctcccg

SEQ ID NO: 368377 - DNA, 531 bp, Homo sapiens
  misc_feature: GZ8MTXP02GCAQ7.17.37.D04.1.454.CMB.2.raw
  modified_base (465)..(465): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaaactgtgcactggtaccagcagaagccaggccaggcccctgtgctggtcgtctatgatgataccgaccggcctcagggatccctgagcgattctctcggcctccaactcgtggggaaccacgggcccaccctgacccagtcggcaggggtcgaaaggccggggatggacggccgactattattgtcgaggtgtgggatagtagtagtgatcatgtggtattcggnggaggacaagctcgaccgtctggtcacgcccagctcgccccgtcggcactctcgttcccgcctccc

SEQ ID NO: 368378 - DNA, 553 bp, Homo sapiens
  misc_feature: GZ8MTXP02G3ZNY.17.37.D04.1.454.CMB.2.raw
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaaagtaaactgtgcactggtaccagcagaagccaggccaggcccctgtgctggtcgtctatgatgataccgaccggccctcgagggatccccgtgacgcgattcgtctcggcctccaactcgtaggggaaccacgggccaccctgacccagtccgggacaggggtcgaaaggccggggatggacggccgaactagttatgtcagggtgtagggataggtagtaggtgatcagtgtaggtagttcgggcggagggaccagcgtcgaccgttcgtggtcagcccaaggctcgccccgtgtcactccgcttcccacccttcc

SEQ ID NO: 368379 - DNA, 606 bp, Homo sapiens
  misc_feature: GZ8MTXP02I50WN.17.37.D04.1.454.CMB.2.raw
  modified_base (386)..(386): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctctatgtgctgactcagccacctcggtgtcagtggccccagggcagacggccaggattaccgtggtagggggaaacaagtgttaggaaagtaaaactgtgcactggtaccagcagaacgccaggccacggcccctgtcgcgtggtcgtctagtgatcgaacgtacccggaccggccctcgacggggtactcccgtgacgcgtattctcgtcggcctaccaactcgtagggaaccnccggcccaccctcgaccacgtccggacgacgggtacgaaacgggccggggatgggacggaccgtaacttagttacgtgtacgaggtgtagggaattaggtagtagtgatcgagtgtggtagtcgggacggaggaccaggcgtacgaccgtcgtcggtacacgtaccgacggtcctccgtccccgtcgtactccgtccgttcccgtccccgccctttcccg

SEQ ID NO: 368380 - DNA, 542 bp, Homo sapiens
  misc_feature: GZ8MTXP02JA07Q.17.37.D04.1.454.CMB.2.raw
  modified_base (296)..(296): a, c, t, g, unknown or other
  modified_base (360)..(360): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagcccaccctcggtgtcagtggccccagggcagacggccaggattacctgtggggaaacaatgttggaaagtaaaactgtgcactggtaccagcagaagccaggccaggcccctgtgctggtcgtctangatgataccgaccgcctcgagggactccctgagcgattctctcggctccaactcgtgggaaacncggccacctgaccatcggcagggtcgaagccgggagtgaggccgatattatgtcaggtgtgggatagtagtagtgatcgatggtggtagttcggcgggaggacgaagctacgtaccgtccgtaggtcacgcccgaacgctaccgccccgtcggcctacctctccgttccccgcccttccccg

SEQ ID NO: 368381 - DNA, 566 bp, Homo sapiens
  misc_feature: GZ8MTXP02JJII0.17.37.D04.1.454.CMB.2.raw
  modified_base (336)..(336): a, c, t, g, unknown or other
  modified_base (359)..(359): a, c, t, g, unknown or other
  modified_base (547)..(547): a, c, t, g, unknown or other
tcagcgtagactagcacgaccggtgctcgatttagtagcatactgttgggtttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaaactgtgcactggtacagcagagcaggccaggcccctgtgctggtcgtctatgatgataccgaccggcctcgagggactccctgagcgattcncctggctccaactctagggaacncgggccaccctgaccagtcgggcaggggtaccgaaaggcccgggggatcgggaggcccgaactagttattgtcgagggttgtgggattaggtagtaggtgatcagtgtggtagttcgggcggagggaccaagcgtacggccgtccgttgggtaccacgaccccgaaggcctcgccccctcgggtaccnctcctccgttcccgtcccc

SEQ ID NO: 368382 - DNA, 519 bp, Homo sapiens
  misc_feature: GZ8MTXP02F4C2K.17.37.D04.1.454.CMB.2.raw
  modified_base (309)..(309): a, c, t, g, unknown or other
  modified_base (353)..(353): a, c, t, g, unknown or other
  modified_base (410)..(410): a, c, t, g, unknown or other
tcagcgtagactagcacgaccggtgctcgatttagtagcatactgttgagtctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaaactgtgcactggtaccagcagaagccaggccaggcccctgtgctggtcgtctatgatgataccgaccggccctnagggactccctgagcgattctctggctccaactctagggaaccncggccacctgaccatcggcagggtcgaagccggggatgaggcgatatattgcagtgnggatagtagtagtgatcatgtggtatcgggcggagggaccagctcgaccgttccgtggtcacgcccgaaggcctcgcccccgtcggtcactctcgtccccacccttccc

SEQ ID NO: 368383 - DNA, 648 bp, Homo sapiens
  misc_feature: GZ8MTXP02IWW5V.17.37.D04.1.454.CMB.2.raw
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtagggggaaacaatgttaggaagtaaaactgtgcactggtaccagcagaagccaggccaggcccctgtgctggtcgtctatgatgactaccggacccggccctcgagggactccctgacgcgtattctctcggcctaccaactcgtgggaacaccgggcccaccctgaccagtccggcgaggggtcgaaacgggccggggatcggacggaccgaacgttagtttagttggtacgaggggttggtaggggtaattaaggtaggtaggttgaattcgaagttggtaggttaaggttcggggcggggaacggggaaccgaaaggccgttacggaccccggttccgttcggtaccgaacggccccgaaacgggtccctaccggccccccgtcggtacctaccgtccgttccggtttccccctaccccgtttccccg

SEQ ID NO: 368384 - DNA, 611 bp, Homo sapiens
  misc_feature: GZ8MTXP02JEICB.17.37.D04.1.454.CMB.2.raw
  modified_base (477)..(477): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcggccaccctcggtgtcagtggccccagggcagacggccaggattacctggtgggggaaacaatgttaggaagtaaaactgtgcactggtaccagcagaagccaggccaggcccctgtgctggtcgtctatgatgactacccgaccggccctcgaggggactccccgtggaacgccgatttcctcgtggcccttccaaactcgtaggggaaccaccggcccacccgtgacccagtcggacaggggtacgaaaggccgggggatggacggccgattattatgtcgaggtgtgggataggtagtagtgtactnagtgtcgtagttcggacgggagggaccaagcgtacggaccgttccgttggaccgacgacccgaacgggcttcccggccccccgttgggtccctaaccgttccgtccgtttcccccacccctttccctttacccg

SEQ ID NO: 368385 - DNA, 552 bp, Homo sapiens
  misc_feature: GZ8MTXP02JE6PN.17.37.D04.1.454.CMB.2.raw
  modified_base (315)..(315): a, c, t, g, unknown or other
  modified_base (361)..(361): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtccagtggccccagggcagacggccaggattacctgtgggggaaacaatgttggaagtaaactgtgcactggtaccagcagaagccaggccaggcccctgtgctggtcgtctatgatgataccgaccggccctnagggactccctgagcgattctctcggcctccgaactcgtggaaccncggcccacctgaccatcggcagggtcgaagccggggatgacggcgactattatgtcgaggtgtgggatagtgtacgtgatcgatggtagtagttcgggcgggaggaccgaagcgtacgacccgtcgtttcggcacgcccgaaacggctccggccccgtcggtcaccgtctcgtttcccccgactttccccg

SEQ ID NO: 368386 - DNA, 509 bp, Homo sapiens
  misc_feature: GZ8MTXP02IB6FW.17.37.D04.1.454.CMB.2.raw
  modified_base (341)..(341): a, c, t, g, unknown or other
tcagcgtagactagcacgaccggtgctcgatttagtagcatactgttgagtctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggatacctgtgggggaaacaatgttggaagtaaaactgtgcactggtaccagcagaagccaggccaggccccctgtgctggtcgtctatgatgataccgaccggccctcagggatccctgagcgatctctggctcaactcnggggaacacggccacctgaccatcgcagggtcgaaagccggggatgaggccgatatatgtcagggtgtgggatagtagtagtgatcatgtgtagtgcggaggacgaagactgacgtctcgtcacgccaacgcgtcgcccctccggtcactctcgtcccgtccctcccc

SEQ ID NO: 368387 - DNA, 579 bp, Homo sapiens
  misc_feature: GZ8MTXP02FZ99J.17.37.D04.1.454.CMB.2.raw
  modified_base (362)..(362): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctggtggggaaacaatgttaggaagtaaactgtgcactggtaccagcagaagccaggccaggcccctgtgctggtcgtctatgatgataccgaccggcctcgagggactccctgacgcgattctctcggctccaactcgtagggaaccncggccacccgtgaccagtcggcaggggtcgaagcgggactggacgcgactatacttgtcgaggtgtggatagtagtagtgatcgagtgtggttagtcggcggaggaccgaagtcgtacggtacccgttccgttcgggtcacggaccgaacggccgttcccggcccccgttccggtaccgtaccctccgtttaccggttcccccacccgtttcccccg

SEQ ID NO: 368388 - DNA, 548 bp, Homo sapiens
  misc_feature: GZ8MTXP02JZG4Z.17.37.D04.1.454.CMB.2.raw
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttaggaaagtaaaactgtgcactggtaccagcagaagccaggccaggcccctgtgctggtcgtctatgatgataccgaccggccctgaggactccctgagcgatctctggcctccaactcgtgggaacacggcccaccctgaccatcggcgagggtcgaaggccggggatggagccgatattattgtcagggtgtagggataggtagtagtgatcgagtgtgggtagtcgggcggagggaccaagctcgacccgtctacggtcacgacccgaggcctcgcccccgttcggccacgtcctcgttccccgacccttcccg

SEQ ID NO: 368389 - DNA, 608 bp, Homo sapiens
  misc_feature: GZ8MTXP02HP8Y2.17.37.D04.1.454.CMB.2.raw
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagcccaccctcggtgtcagtggccccagggcagacggccaggattacctggtgggggaaacaatgttaggaaagtaaactgtgcactggtaccagcagaagccaggccaggcccctgtgctggtcgtctatgatgactaccgaccggcctcgagggactcccgtgacgcgtattctctcggcctccaactcgtaggggaaccaccggcccacccgtgacccagtccgggacgagggggtccgaaagggccgggggatagggacggtaccggaacttagttattggtcgagggttgtgggattaggtagtagtgatcagtgtaggtattcggggacggagggaccaaaggctacggacccgttcgtcggtaccacggacccgaacggtccgtccgccccccgtcggtacctacctccttcccgttacccccttaccctttcc

SEQ ID NO: 368390 - DNA, 548 bp, Homo sapiens
  misc_feature: GZ8MTXP02JS9IT.17.37.D04.1.454.CMB.2.raw
  modified_base (473)..(473): a, c, t, g, unknown or other
  modified_base (542)..(542): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaaactgtgcactggtaccagcagaagccaggccaggcccctgtgctggtcgtctatgatgatacccgaccggcccctcgaggggactcccgtgacgcgattctctcggctccaactctggggaaccacgggccaccctgacccagtcggcagggtcgaaagccggggatggacggccgactattagtgtcgagggtgtagggataggtagtagtgatcgatgtgtagttcgggnggagggaccagctcggaccgttctggtcacgcccgaggctcggccccctcggtcactcgtcgtaccccnccttcc

SEQ ID NO: 368391 - DNA, 638 bp, Homo sapiens
  misc_feature: GZ8MTXP02JOQOA.17.37.D04.1.454.CMB.2.raw
  modified_base (373)..(373): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctggtagggggaaacaatgttaggaagtaaactgtgcactggtaccagcagaagccaggccaggcccctgtcgctggtcgtctatgatgactacccggaccggccctcgagggactcccgtgacgcgtattctctcggcctccaactcgtagggaaaccnccgggcccacccgtgacccagtccgggacgacggggtcgaaacggcccggggatggacggccgtactattagtgtacgaggtgtgggtataggtagtaggtgtatctagtgtggtacgttcggggacgggtacgggaccaaggccgtacggtacccgtccgttcgggtaccaccggtaccccgaacgggtcccgtcccggtccccccgtccgggtaccctacccgttccgtttaccccgtttacccccctaccccgtttcccccg

SEQ ID NO: 368392 - DNA, 639 bp, Homo sapiens
  misc_feature: GZ8MTXP02JJ89L.17.37.D04.1.454.CMB.2.raw
  modified_base (375)..(375): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctggtagggggaaacaagtgttaggaaagtaaaactgtgcactggtaccagcagaagccaggccaggcccctgtgctggtcgtctatgatgatacccgaccggccctagagggactccctgacgcgtattctctccggctaccaactcgtacggggaaaccncccgggccctaccccgtgaaccccagtccgggacgaggggtaccgaaagggcccggggaatcgggaacgggcccgaacttaagtttacgttgtacgtaaggggttgtaggggtaagttaggttaaggtacggtaggtatcgtagttggtagggtagttcggggacgggagggtaaccaggtcgtcggaccgttccgttcgggacgacggcccgaagggcctccggcccccgtggtccacgtcctaccgtccccctaccgttccc

SEQ ID NO: 368393 - DNA, 553 bp, Homo sapiens
  misc_feature: GZ8MTXP02F3D2E.17.37.D04.1.454.CMB.2.raw
  modified_base (297)..(297): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattaccgtggtagggggaaacaatgttaggaaagtaaaactgtgcactggtaccagcagaagccaggccaggcccctgtgctggtcgtntatgatgatacccgaccggccctcgagggactcccgtgagcgattctctcggcctccaactcgtagggaaccacgggcccaccctgacccgagtcggacgaggggtacgaaacggccgggggatggacggccgactagttattgcagggtgtgggatagtagtagtgatcagtgtggtagttcgggcggaggaccaagcgtcgaccgtctggtcacgcccgaggctcgcccctcggtacactcgtctcccacctcc

SEQ ID NO: 368394 - DNA, 620 bp, Homo sapiens
  misc_feature: GZ8MTXP02GE02Z.17.37.D04.1.454.CMB.2.raw
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagtcaccctcggtgtcagtggccccagggcagacggccaggattaccgtggtagggggaaacaatgttggaaagtaaactgtgcactggtaccagcagaagccaggccaggcccctgtcgctggtcgtctatgatgactaccgaccggccctcgagggactcccgtgacgcgtattcgtcgtcggcctaccaacgtcgtacgggaaccaccggccaccctgaccagtccgggacgaggggtcgaaagggccggggaatcgggacggccgtaacttagttacgttgtacgagggttggtagggtaattaggtaggttaggtgattacgagttggttaggttacggttcggggacgggtacgggaaccaaggtcgtacggtacccgttcgttcggtacacgacccgacgccgtccgcccccgtgtacctactccgtccgttccccgcccttaccg

SEQ ID NO: 368395 - DNA, 638 bp, Homo sapiens
  misc_feature: GZ8MTXP02IOYBK.17.37.D04.1.454.CMB.2.raw
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagcccaccctcggtgtcaggtcggccccagggcaggacggccaggattaccgtggtagggggaaacaagtgttaggaaagtaaactgtgcactggtaccagcagaagccaggccaggcccctgtgctggtcgtctatgatgactaccgaccggcctgagggactcccgtgacgcgtattctctcggtcctaccaactcgtaggggaaccaccgggcccaccctgacccagtccgggacgagggggtcgaaacgggccgggggaatcgggacggaccgtaacgttagtttagttgtacgagggttggtagggattaggtagtagtgattcgaagttggtaggttagttcggggacgggtagggaaccaaggtctacggacccgttccgttacgggtaccacggacccgaacggtccttaccggcccccgttcggtacctccgttccgttcgtttccctacccgttacccccg

SEQ ID NO: 368396 - DNA, 709 bp, Homo sapiens
  misc_feature: GZ8MTXP02GV2U6.17.37.D04.1.454.CMB.2.raw
  modified_base (299)..(299): a, c, t, g, unknown or other
tcagcgtagactagcacgaccggtgctcgatttagtagcatactgttgagtctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaaggattaccgtggtagggggaaacaagttgttaggaaagtaaactgtgcacgtggtaccagcagaagccaggccacggcccctgcgctggtctctatgntgactacccggccggcctcgaggactccgtgacgtcgtattctcgtcggcctaccaacgtcgtacgggaaccaccgacccacccgtgacccacgtccgggacgtaacgggggtaccggaaacggggccggggtaagtagggaccgggtacccgtaacgtttagtttaacgttcgtacggtaaggggttggtaggggtaaagttaagggttaacggtagttaggtaagttggtaagttggggttagggttaacggtttcggggaccgggtaacggggaacctaaggtccggtacggtaccccggttcggtttacggaccgtaccggtacccgtaacgggtcccttccccggtcccccgttcggttaccctaccgttcccgttacccggtttcccccgtacccctttccccg

SEQ ID NO: 368397 - DNA, 709 bp, Homo sapiens
  misc_feature: GZ8MTXP02JHMSV.17.37.D04.1.454.CMB.2.raw
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacgccaggattacctgtggggaacatgtggaagtaaactgtgcactggtaccagcagagccaggcaggccctgtgctggtctctatgatgactacccgaccggccctcgacgggactcccgtgacgtccgattcctctacggcctcctaaactctggggaaccaccggcccaccctggacccagtccgggacacgggggtcgaaacgggcccggggatcggacggtcccgtaacgttagtttacttcggtaccgtagggttggtagggtaagtaggttaaggttagtggtatacgaagttcggggttaggttaacgtttccgggggacggtaacgggggaaccctaaaacgggccgttaaccgggtcccggtttacccggtttcgggggtacctaaaccggtacccccgaaaaccggggtcccttacccgggaacccccccgttcgggggttaacccctacccggttcccgtttacccgggtttcccccccgtaccccctttacccccgg

SEQ ID NO: 368398 - DNA, 748 bp, Homo sapiens
  misc_feature: GZ8MTXP02GG3UU.17.37.D04.1.454.CMB.2.raw
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcacgccaccctcggtgtcagtcggccccagggcagacggccaggattaccgtggtagggggaaacaagttggttaggaaaagttaaaactggtgacacgtcggtaccagacaagaacgccgaggcccgacggcccctgtcgcgtggtcgtctatgatgactaccgacccggccctacgacggtactcccgtgacgtcgtattcgtcgtccggtacctaccgaactccggtaacgggaacccacccgggcccacccgtacgaacccacgtccggacgacggggtaccgaaacgggcccggggtagtacgggaacggtacccgtaagtttaacgttacgttggtaccggtagggtaggggtagggtaagttaaggtaaaggttaggtagacttacgtagttagggtaggttacggttacggggaacgggacgggtaaaccgaacggtccgttacggtaacccggtttccgttacgggacccgaaccgggtacccgtaaacgggtcccgttaccccgtcccccggttcggttaccctaacccgttcccgtttaccccggttaccccccgtaccccttttcccccg

SEQ ID NO: 368399 - DNA, 603 bp, Homo sapiens
  misc_feature: GZ8MTXP02J1D7V.17.37.D04.1.454.CMB.2.raw
  modified_base (285)..(285): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggccccagggcagacggccaggattacctggtagggggaaacaatgttaggaagtaaactgtgcactggtaccagcagaagccaggccaggcccctgngctggtcgtctatgatgatacccgaccggccctgacggggactccctgagcgtattctctcggcctccaactcgtagggaaccacgggcccaccctgaccagtcgggacaggggtcgaaaggccggggatcggaggccgatattatgtcgagggtgtagggataggtagtaggtgatcgtaagtgttaggttagttcggggacggacggggaccaaaggcgtacggacccgttccgttcgggtaccacggacccgacggtcccgtccgcccccgtcggtaccaccgttcccgttccgttcccccggccctttaccccg

SEQ ID NO: 368400 - DNA, 537 bp, Homo sapiens
  misc_feature: GZ8MTXP02FXCDM.17.37.D04.1.454.CMB.2.raw
tcagcgtagactagcacgaccggtgctcgatttagtagcatactgttgagtctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttaggaagtaaaactgtgcactggtaccagcagaagccaggccaggcccctgtgctggtcgtctatgatgataccgaccggccctcaggggatcccgtgagcgattctctcggctccaactcgtgggaaccacgggccaccctgaccatcggcagggtcgaagccggggatggacggccgacttattattgtcgagggtgtgggatagtagtagtgatcatgtggtagttcgggcggaggacaagctcgaccgtcttcggtcacgcccgaaggcctcgcccccgtcggtccactctcgtccccgcccttcccg

SEQ ID NO: 368401 - DNA, 673 bp, Homo sapiens
  misc_feature: GZ8MTXP02FHUSK.17.37.D04.1.454.CMB.2.raw
  modified_base (219)..(219): a, c, t, g, unknown or other
  modified_base (250)..(250): a, c, t, g, unknown or other
tcagcgtagactagcacgaccggtgctcgatttagtagcatactgttgggtttggggagtctgggcctaaggaagcagcactggtggtgcctcagccatggcctggaccgttttcctcctcggcctcctctctcactgcacaggctctgtgacctcctatgtgctgactcagccaccctcggtgtcagtcggccccagggcagacggcaggattaccgnggtaggggaaacaagtgttaggaaataaacngtgcacgtcggtacagcaggaacgccgaggcccacgggccccctgtcgcgttggtccgtctatgatcgactaccggaccggcccctagagggactccccgtaggacgcgtattcgtcgtcggcctaccgaattcggtagggaaacccacgggccccacccgtgaacccgtagtaccggacgtaggggacggaaacgggccggggtagcggacggaccgtacgtacttagtcgtacgtagggtggtagggtagtaaggtagtagtgatacgagttggtaggtaggttcgggacgggacgggaaccgtaggtaccgtcggtacccggttccgttcgggaccaaccggaccccgaaacggccgttaccccgcccccgttacgtccgacccgttccgttccccggtcccccgtcccgtttacccccg

SEQ ID NO: 368402 - DNA, 705 bp, Homo sapiens
  misc_feature: GZ8MTXP02IOS9L.17.37.D04.1.454.CMB.2.raw
  modified_base (333)..(333): a, c, t, g, unknown or other
  modified_base (345)..(345): a, c, t, g, unknown or other
tcagcgtagactagcacgaccggtgctcgatttagtagcatactgttgggtttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccagggcagacggccaggattaccgtggtagggggaaaacaagtggttaggaaagtaaaactgtgcactggtaccagcagaagccaggccacgggccccctgtcgcgtggtcgtctagtgatgacgaccgaccggcccncgaggactccgngagcgtactcgtccgtcggctaccgaacgtcgtacggaaccgaccggcccaaccctaccgaccgacgtccggggaccgaacgggggtcggaaacgggaccgggggagtacggacgggaccgacgtagttttaacgttggtacgtaggggttaggtaggggtagtaaaggttggtaaagtggagttacgtagggtagttacggggtacgtagggggtccgggaaaggggtacccgaacgtacggtaccgtacggggttaccctcggggtacccgaaacgggtccccgtaacgggtccccggtccggtacccccgtccggttaccccgtaccgtttccccttaccgttcccccgttaccccc

SEQ ID NO: 368403 - DNA, 626 bp, Homo sapiens
  misc_feature: GZ8MTXP02F61W1.17.37.D04.1.454.CMB.2.raw
  modified_base (329)..(329): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaaagtaaaactgtgcactggtaccagcagaagccaggccaggcccctgtgctggtcgtctatgatgataccgacccggccctgagggactcccgngacgcgattcctcgtcggctccaaactcgtagggaaccacggcccaccctgaacccagtccgggacagggggtcgaaacgcccgggggaatcggacgggacccgtaactagtttacgttaggtcgtaagggtcggttgggaaagttaggtaaggttaagtgaaattcgtaagttggttaggtaacgttcgggacgggagggacccgaaagcgtacggtacccgtcgttcggtaccgacgcccgaacgggcttaccgcccccgttcggcctacgtccgtccgttccccgcccttcccg

SEQ ID NO: 368404 - DNA, 751 bp, Homo sapiens
  misc_feature: GZ8MTXP02JSXT1.17.37.D04.1.454.CMB.2.raw
tcagcgtagactagcacgaccggtgctcgatttagtagcatactgttgagtctgggcctaaggaagcagcactggtggtgcctcagccatggcctggaccgttctcctcctcggcctcctctctcactgcacaggctctgtgacctcctatgtgctgactcagcccaccctcggtgtcagtcggccccagggcaggacggccaggattacctggtagggggaaacaagtgttaggaaagtaaaactgtgcacgtggtaccagcagaagccaggccacggcccctgtcgcgtggtctctatgatgactacccggacccggccctcgacgggactcccgtaggacgccgtattccgtcgtcggacctacccgaacgttccgtacggggaaacccgcccgggccccctaaccccgtacggaacccctagttcccggggacggtaacgggggtaccgggaaaccgggggcccgggggtaaagtaggggaccggggtaacccgtaaactttaacgtttaagtttcggtacgtaggggttagggtaggggtaaagtttaagggttaaggtaggttagtaagtacgtaagttggttagggttaaacggttcgggggacggggtaacggggaacctaaggtccgtaccgggtacccgttcgttacgggtaccgaccggtacccgtaacgggcccttcccggcccccggtttcggtaccctaccgtcccgtttacccgtaccccccgttacccttccccg

SEQ ID NO: 368405 - DNA, 712 bp, Homo sapiens
  misc_feature: GZ8MTXP02GFQWZ.17.37.D04.1.454.CMB.2.raw
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggccccagggcaggacggccaggattaccgtggtagggggaaacaatgttaggaaagtaaactgtgcactggtaccagcagaagccacggccacggcccctggtcgcgtggtcgtctatgatgactaccggaccggcctcgagggactccctggacgtcgtattcctcgtcggcctaccaacgtcgtacgggaaccaccggccccacccgtcgaaccacgtccgggacgacggggtaccggaacgggcccgggggagtcgggaacggtaccggtacgttaagttacgttggtacgtaggggttgtaggggtaagttaggtaaggttaggtggtattacgtagttgggttacggttaacggttcggggacggggtaacggggaaccgacgtcggttaccggtaccggtttccggttacgggtaccgaccggtaccccgtaaacgggtcccgttacccggtcccccggttccggttaacccgtacccgtttcccgttcccggtttaccccctacccccgtttccccg

SEQ ID NO: 368406 - DNA, 719 bp, Homo sapiens
  misc_feature: GZ8MTXP02FHGLV.17.37.D04.1.454.CMB.2.raw
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggccccagggcagacggccaggattaccgtggtagggggaaacaagtgttaggaaagtaaactgtgcacgtggtacagacagagccaggccacggcccctgtcgcgtggtcgtctagtgatgacgtacccggacccgccctacgaaggggactcccgtggacggtcgtactttccgtcgtcccggccttacccgaaacgttccggtacggggaaacccacccgggtccccaacccccgtacgacccgacgtccggacggaagggggtaccggaaacggggccgggggaagtacgggaacggtcccgtaactttagttacgtttggtacggtagggttagggtaggggtaataagggttaaggtaggttagacgttaccgtagttgggttacgggttaggttaccgggggacgggaacgggaaccgaaacgtccgtacggtacccgtttcgttcggaccgacggacccgtacggcccgttacccgcccccgtacggtcctaccgttccttaccgttaccccctcccttacccg

SEQ ID NO: 368407 - DNA, 585 bp, Homo sapiens
  misc_feature: GZ8MTXP02I8V6Z.17.37.D04.1.454.CMB.2.raw
  modified_base (295)..(295): a, c, t, g, unknown or other
  modified_base (435)..(435): a, c, t, g, unknown or other
  modified_base (438)..(438): a, c, t, g, unknown or other
  modified_base (443)..(443): a, c, t, g, unknown or other
  modified_base (447)..(447): a, c, t, g, unknown or other
  modified_base (500)..(500): a, c, t, g, unknown or other
tcagcgtagactagcacgaccggtgctcgatttagtagcatactgttgggtttgggggccccagccctgggattcccagctgtttctgcttgctgatcaggactgcacacagagaactcaccatggagtttgggctgagctgggttttccttgttgctattttaaaaggtgtccagtgtgcggtgcagctggtggaggtccgggggaggtttagttcagccgtggggggtccctgagactctcctgtgcggcctctggattcaccttcagtagctactggatgcacgtgggtccnccaagcctccgaggggaggggctggtggtgggtctcacgttattgatacgtgagtggctattaccccacatccgtaacgccggactcccggtgccgacggggccattccaccatccctaccagacgacaacgcaagaacncgntagtntctnacaaatgaactgtctaggagacgcgtaggacgacggcttagtcgtacttacgnggttcacgtaaacgtccggtttcccccgagaccgtccgtccggtacccggtaacttcggacggggaccaacgggggaccctacgg

SEQ ID NO: 368408 - DNA, 589 bp, Homo sapiens
  misc_feature: GZ8MTXP02HV8VF.17.37.D04.1.454.CMB.2.raw
  modified_base (288)..(288): a, c, t, g, unknown or other
  modified_base (297)..(297): a, c, t, g, unknown or other
  modified_base (331)..(331): a, c, t, g, unknown or other
  modified_base (334)..(334): a, c, t, g, unknown or other
  modified_base (343)..(343): a, c, t, g, unknown or other
  modified_base (540)..(540): a, c, t, g, unknown or other
  modified_base (556)..(556): a, c, t, g, unknown or other
tcagcgtagactagcacgaccggtgctcgatttagtagcatactgttgagtctgggcctaaggaagcagcactggtggtgcctcagccatggcctggaccgttctcctcctcggcctcctctctcactgcacaggctctgtgacctcctatgtgctgactcagcccaccctggtgtcaggtcggccccagggcagacggccaggattaccgtggtagggggaaacaagttggttaggaaagttaaaactgtgcactggtaccagcaagaacgcacggccagcccctgngctggtctntatgatgactaccggacccggctcgaggcttccngancgtacttcncgtcgctaccacgtcgacggaccaccggccacgtacgacctagccggcgagggtacggaacggtccgggagtacggacggacccgtaatttagttagttgtacggaggtagtgggtaattacgggttagtaggttgactagtgttaggtcgtaggtcgggacggtaggacccgagcgtaacgcgttcgtcgcgaacnccggacgccgttaccnccccgttgacctcgtctcccgtccacccttccg

SEQ ID NO: 368409 - DNA, 647 bp, Homo sapiens
  misc_feature: GZ8MTXP02IHG75.17.37.D04.1.454.CMB.2.raw
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccacctcggtgtcaggtcggccccgagggcaggacggccagggtacttaccgtggtagggggaaactaagttaggttaggaaagttaaactggtacgcacgtaggtaccagcgagaagccgaggccacggccctgtgcgtggtctctagtgatagactaccggaccggcctgaggcctccgtagacgcgtacttctcgtcggacctaccaacgttcgaggaaccgccgccaccgtcgacctacgtcgacgacgggtacggaacggaccgggagagacggacgtaacgttattacgttgtacgtagggtaggtagggtaggtaagttagggtagtagtagtagtagtgggtaggttacgtggggacggggaggacgagtcgtacgtccgttacgtacgttacgacgacccgaacggtcctacccggtccccgttcggtacccttacgtccgtttacccggtaccctacccgtttacccc

SEQ ID NO: 368410 - DNA, 748 bp, Homo sapiens
  misc_feature: GZ8MTXP02GRAY7.17.37.D04.1.454.CMB.2.raw
  modified_base (394)..(394): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggcccagggcagacggccaggattaccgtggtagggggaaacatggttaggaaagtaaactgtgcacgtggtaccagcaagaagccaggcacggcccctgtcgcgtgggtctctatgatgaacgtacccgacccggcctacgaacgggtctcccgtggacgtgtacttcgtcttcggacctaccgtaaacttccgacggggaacccnccgggaccccctacccgacgaaccctagtacccggacggacgggggtaccggaaacggggcccgggggttaaagacggggaaccggtacccgttaaagttacgtttacggttacgggtacgggtaagggttacgggtaaggggttaaacggttaggttaaaggtaggtaagtactacggtaggttagggttacggtacgggttacggggaacgggtaacgggtaaccgtacggtccggttaccggtacccggtttacggtacgggaccaccggacccgtacggtcccgtacccggtccccgttacggtacccgttaccgttcccgtaccccggttaccccctacccgtttcccg

SEQ ID NO: 368411 - DNA, 701 bp, Homo sapiens
  misc_feature: GZ8MTXP02ISLYT.17.37.D04.1.454.CMB.2.raw
  modified_base (218)..(218): a, c, t, g, unknown or other
  modified_base (290)..(290): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagcccaccctcggtgtcagtcggccccagggcagacggccaggattaccgnggtagggggaaacaagtggttaggaaagtaaactgtgcacgtggtaccagcagaagccaggccaggccctgngctggtcgtctatgatgactaccgaccggcctagagggactcccgtgacgcgtattccgtcgtcggcctaccgaactcgtacggggaaccaccgggcccaccgtacgaaccacgtcccgggacgtacgggggtaccgaaacgggcccgggggtaagtacgggacgggtacccgtaacgttatttaacggttcggttacgtaggggttacggtaggggtaaagttaaggttaggtaacggtttagtacgttacgtaaggttgggttacgggttaacggtttccggggacggggtaaccggaaccgtaaagtccggtaacggtacccggttcgtacgggtaccacggtacccgaacgtccgtaccgccccgttacggtccctacgttccgtccgttaccccctacccttcccg

SEQ ID NO: 368412 - DNA, 736 bp, Homo sapiens
  misc_feature: GZ8MTXP02FE9P4.17.37.D04.1.454.CMB.2.raw
  modified_base (249)..(249): a, c, t, g, unknown or other
tcagcgtagactagcacgaccggtgctcgatttagtagcatactgttgggttggggctgggcctaaggaagcagcactggtggtgcctcagccatggcctggaccgttctcctcctcggcctcctctctcactgcacaggctctgtgacctcctatgtgctgactcacgccaccctcggtgtcagtggccccagggcagacggcaggattacctggtaggggaaacaatgttaggaaagtaaaactgtncactggtaccagcagaagccaggccaggccccctgtgctggtcgtctagtgatgactaccggacccggcccctacgagggactccccgtaggacgcgtattcctcgtcggcctaccaactcgtaaggggaccaccgggcccacccgtgaaccagtccggacgacggggtaccggaaagggcccgggggaatcgggaacggtacccggtaactttagttaagttcggtacggtagggttagggtaggggtaagttaagggtaacggtttaggacggtagttaccgtaagttcgggttagggttaaaggttccgggggacggggaaacggggaacctaaaacgggtccgtacgggtaccccgtttaccggtttacggggaccgtaaccggaccccggtaaacgggtcccgttacccggtccccccggttcgggttaccctaacccgtttccccgtttaccggtaccccccctaccccggttttcccccg

SEQ ID NO: 368413 - DNA, 626 bp, Homo sapiens
  misc_feature: GZ8MTXP02IRLEC.17.37.D04.1.454.CMB.2.raw
  modified_base (380)..(380): a, c, t, g, unknown or other
  modified_base (433)..(433): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagcccacctcggtgtcagtcggccccagggcagacggccaggacttaccgtggtagggggaaacaagttgttaggaaagttaaaactgtgcacgtggtaccagcagaagccagccaggcccctgtgctggtcgtctatcgatgactacccggaccggcctgacgggactcctgacgcgtattctcgtcggcctaccaacgtcgtacggaaccnccggcccacctcgaaccgacgtccgggacgacgggggtacgaaacccggggtnacggacggcccgtaattagtttagttcggtaccgtagggttacggtagggattaaggtacgttaggtcggtatacgagttgggtagttacgttcgggacgggtaacggactaacgcgtacggtacccgttcgttacggcacgtccgacgcctccgtcccgtggcctacgtctaccgtcccctaccgtctaccg

SEQ ID NO: 368414 - DNA, 718 bp, Homo sapiens
  misc_feature: GZ8MTXP02F7KD4.17.37.D04.1.454.CMB.2.raw
  modified_base (547)..(547): a, c, t, g, unknown or other
tcagcgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagcccaccctcggtgtcaggtcggccccagggcaggacggccaggattacctggtaggggaacaagttggttaggaaagtaaactgtgacacgtaggtaccagacagaagccgaggccccacgggtccccgtgtcgtccgttgggtctactatagagtagacgtacccgacccggccctcggacgggactccccgtagagtcgtattcgtcgtccgcctaccgaactccgtaggaacccaccggcccacccctgacccgagtccgggacgacggggtacgaaacggccgggggaagtcggaccggaccgttaaccgttagttacggttacgtcgggtaagggttcgggaggggttaattaaagggtaggttaacgggttntacgttacgtaggttacgggttaggttacggttacggggaccgggaacgggtaaccgtacggtcgtaccggtaccggttcgttacggtaccgaccggtaccccggacggtccctcccggaaccccgttacgtaccctaccgttcccgttacccgtccccctacccgttccg

SEQ ID NO: 368415 - DNA, 613 bp, Homo sapiens
  misc_feature: GZ8MTXP02IWDZP.17.37.D04.1.454.CMB.2.raw
  modified_base (329)..(329): a, c, t, g, unknown or other
  modified_base (347)..(347): a, c, t, g, unknown or other
  modified_base (361)..(361): a, c, t, g, unknown or other
  modified_base (368)..(368): a, c, t, g, unknown or other
tcagcgtagactagcacgaccggtgctcgatttagtagcatactgttgagtctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctggtagggggaaacaagtgttaggaaagtaaaactgtgcaactggtaccagcagaagccaggccaggcccctgtgctggtccgtctatggatgactacccgacccggccctcgagggtacncccgtgacgcgatcgtcncggctccaactcgnggaaccncggccctacctgaccctagccggacgacggggtccgaaaggccggggagtcgacggaccgtaattacgttacgttgtcgaggtcgtagggataggttaagagttcgaattcgaagttcggtggttagtccggggaggacgggacgaagcgtcggtacccgtcggttcgaccgacgtacccgacggtccgtacccggcccccgtacggtaccgtacttcccgtaccgtccccctacccttaccccg

SEQ ID NO: 368416 - DNA, 553 bp, Homo sapiens
  misc_feature: GZ8MTXP01BEW4B.29.26.C04.1.454.CMB.2.raw
  modified_base (477)..(477): a, c, t, g, unknown or other
tcagatagagtactcacgaccggtgctcgatttagtctagcgactttgggtttggggacccaaaaaccacacccctccttgggagaatcccctagatcacagctcctcaccatggactggacctggagcatccttttcttggtggcagcagcaacaggtgtccactcccaggttcagctggtgcagtctggagctgaggtgaagaggcctggggcctcagtgaaggtctcctgcaaggcttctggttacagctttaccacttatagtatctctgggtgcgacaggcccctggacaagggcttgagtggagtggggaggatcaacacttacgagacggaaacacaaactatgcacaggaggtccagggcaagagtcaccatcgaccagacgacactacaccacgaacacagacctaacatacggaactggaggggcctaggagatctagacgatagtggccgtgtatttctgtgcggnggaacgggtccggcgtcggggctacgagttgcgttacgtggggccaacggggaaccctggcctaaccggttctccg

SEQ ID NO: 368417 - DNA, 676 bp, Homo sapiens
  misc_feature: GZ8MTXP01EVNJT.29.26.C04.1.454.CMB.2.raw
tcagatagagtactcacgaccggtgctcgatttagtctagcgactttgggtttggggacccaaaaaccacacccctccttgggagaatcccctagatcacagctcctcaccatggactggacctggagcatccttttcttggtggcagcagcaacaggtgtccactcccaggttcagctggtgcagtctggagctgaggtgaagaggcctggggcctcagtgaaggtctcctgcaaggcttctggttacagtctttaccactttatagtatctccgtgggtgcgacacggcccctggacgaaggcttgaggtggagtggggagatcaacacttacagacggaaacacaaactatgacacgaggacggtaccgagggacaagagtcaccagtacgaccagacgacaacactacccaacgaacacacgaccctaacgacgtacgggaaacgtgggacggggcctaggaacgtacggtacgttaggaaacgtagttaacggtcgggtaccggtttacctttaagttttccgtagggttcggccgggaacggggaaccgggggtcccgggaccgggttcggggggttacctaaacggtacggttacggaccggttacgggtaacgggggacccgaacggggtaaccccgtgggttacccgtaacccgggttccttccccg

SEQ ID NO: 368418 - DNA, 659 bp, Homo sapiens
  misc_feature: GZ8MTXP01DZJA2.29.26.C04.1.454.CMB.2.raw
tcagatagagtactcacgaccggtgctcgatttagtctagcgactttgggtttggggacccaaaaaccacacccctccttgggagaatcccctagatcacagctcctcaccatggactggacctggagcatccttttcttggtggcagcagcaacaggtgtccactcccaggttcagctggtgcagtctggagctgaggtgaagaggcctggggcctcagtgaaggtctcctgcaaggcttctggttacagtctttaccacttatagtatctctgggtgcgacacggccctggacaagggcttgagtggagtggggagatacaacacttacagacggaaacacaaactatgacacaggtagtccgagggcaagacgtcacatcgaaccagacgactacactaccaacgaacacgtacgacctaacgagtacggaaactgggaacggggccttagggaacgacttaccgtaggtaaccgtagttacgtccgggtccgtttaccttaagtttttccggtggttcgggacggggtaacggggaaccgggggtcccggttcgggtcggggttaccgtaaccggtaggttacggttaccgttaccgggtaacggggacccgtaacgggtacccgtcggttaccctaacccggttcccgtaaccg

SEQ ID NO: 368419 - DNA, 593 bp, Homo sapiens
  misc_feature: GZ8MTXP01AYE2B.29.26.C04.1.454.CMB.2.raw
  modified_base (218)..(218): a, c, t, g, unknown or other
  modified_base (251)..(251): a, c, t, g, unknown or other
  modified_base (281)..(281): a, c, t, g, unknown or other
  modified_base (450)..(450): a, c, t, g, unknown or other
  modified_base (473)..(473): a, c, t, g, unknown or other
  modified_base (483)..(483): a, c, t, g, unknown or other
tcagatagagtactcacgaccggtgctcgatttagtctagcgactttgggtttggggacccaaaaaccacacccctccttgggagaatcccctagatcacagctcctcaccatggactggacctggagcatccttttcttggtggcagcagcaacaggtgtccactcccaggttcagctggtgcagtctggagctgaggtgaagaggcctggggcctnagtgaaggtctcctgcaaggcttcgtggttacngtctttaccacttatagtatctcgtgggtncgacacggccctggacgaggcttgagtggagtggggagatcaacacttacgagacggaaacacaaactatcgactacgaggacgttcgagggctaaagagtcacatcgaccagacgactacacaccaacgaacactacgacctacgagtcggaactggacgggctagancgttcaggacgatagtcggcctnttatttcggngtacggacggagggccgggtcggttcgggtcgggactaacggtggttacggttacggttacggggtcggggaccgtaacgggtcccgtcgggttacctcccggttctccg

SEQ ID NO: 368420 - DNA, 631 bp, Homo sapiens
  misc_feature: GZ8MTXP01BKQEB.29.26.C04.1.454.CMB.2.raw
  modified_base (255)..(255): a, c, t, g, unknown or other
  modified_base (387)..(387): a, c, t, g, unknown or other
  modified_base (559)..(559): a, c, t, g, unknown or other
  modified_base (576)..(576): a, c, t, g, unknown or other
tcagatagagtactcacgaccggtgctcgatttagtctagcgactttgggtttggggacccaaaaaccacacccctccttgggagaatcccctagatcacagctcctcaccatggactggacctggagcattccttttcttggtggcagcagcaacaggtgtccactcccaggttcagctggtgcaggtctggagctgaggtgaagaggccgtggggcctgagtgaaggtctcctgcaaggtcttcgtggttacngtctttacactttatagtatctcgtagggtgcgacacggccccgtaggaacgtaagggcttggaggttaggaggtgggggaaggactacaaactacgttaaccgaaggtaacggaaaacagtaaaaccttanacgacaacgacgtaaagggttcccgaggggacaaagggactccaacgactcgaaccgagacgtacactactaccaacgaaacacacgtactaacagtacgaacgtggacggctagacagtactggaactagagtcggccttatattcgtgtaggcgaagggcggggcccggnggtacgggcttaacggnttacggcgttacgcgggggcttaacgggacctgggttacccaaccgttccgtccg

SEQ ID NO: 368421 - DNA, 547 bp, Homo sapiens
  misc_feature: GZ8MTXP02I0B73.29.26.C04.1.454.CMB.2.raw
  modified_base (279)..(279): a, c, t, g, unknown or other
tcagatagagtactcacgaccggtgctcgatttagtctagcgactttgggtttggggacccaaaaaccacacccctccttgggagaatcccctagatcacagctcctcaccatggactggacctggagcatccttttcttggtggcagcagcaacaggtgtccactcccaggttcagctggtgcagtctggagctgaggtgaagaggcctggggcctcagtgaaggtctcctgcaaggcttctggttacagctttaccacttatagtatctcctgggtncgacaggcccctggacaagggcttgagtggatggggagatcaacacttacagcggaaaacacaaaactatgcacagagttccagggcagagtcaccatacgaccagacgacacatccaacgaacacagcctacataggaactgacggggcctagagatcgtagacgataatcgggccgttcttaatttcgtggtagtccggaggacggggcccggccgtgggggctacgcgtcgactagcgggcacgggaccctggtccacgtctccg

SEQ ID NO: 368422 - DNA, 648 bp, Homo sapiens
  misc_feature: GZ8MTXP02GHBUA.29.26.C04.1.454.CMB.2.raw
  modified_base (281)..(281): a, c, t, g, unknown or other
  modified_base (330)..(330): a, c, t, g, unknown or other
  modified_base (353)..(353): a, c, t, g, unknown or other
tcagatagagtactcacgaccggtgctcgatttagtctagcgactttgggtttggggacccaaaaaccacacccctccttgggagaatcccctagatcacagctcctcaccatggactggacctggagcatccttttcttggtggcagcagcaacaggtgtccactcccaggttcagctggtgcagtctggagctgaggtgaagaggcctggggcctcagtgaaggtctcctgcaaggcttctggttacagtctttaccacttatagtatctccgtgggtncgacacggcccctggacagggcttaggagtggagtggggagatacaacncttacagacggaaacacaaactnagacaccgagtacgtaccgagggcagacgtcaccagtcgaccagacgacacactaccgaacgaacacacgcctacagtacggaaacgtgggacggggtcctaggacgtactacggtacgaacggtagtagtcggggccttacttacgtttacgtcggtacgggcgaacggggtaccggggcccgggtacggtacgggggtacctacggacggtccggtaaccggttacggtaaccgggggacccggtaaccggggtaaaccccgttcggacccgttaacccggtccgttaccccg

SEQ ID NO: 368423 - DNA, 668 bp, Homo sapiens
  misc_feature: GZ8MTXP02JNI5W.29.26.C04.1.454.CMB.2.raw
  modified_base (292)..(292): a, c, t, g, unknown or other
  modified_base (297)..(297): a, c, t, g, unknown or other
  modified_base (488)..(488): a, c, t, g, unknown or other
tcagatagagtactcacgaccggtgctcgatttagtctagcgactttgggtttggggacccaaaaaccacacccctccttgggagaatcccctagatcacagctcctcaccatggactggacctggagcatccttttcttggtggcagcagcaactaggtgtccactcccaggttcagctggtgcagtctggagcgttgaggtgaaggaggccgtggggcctcgagtggaacggtctccgtgcaaggtcttcgtggttacagtcctttaccactttatagtatctcgtggtncgacncggcccctggacagggcttggaggtgagtggggagatcgaacagttaacgagtaccggaaacacgtaaactgtcgacaccgagtacggtacgaggggcaaggactacgaccgatacgaacccagaagaacctacgactacccgaaacgaaccaacacgtacctacagtacggaaatcgggagggcctaagngtactcgagacgtagttacgtacggtcgttacgttagtttgaggttacggacggaacggttacggggccggttaccgggtacgggacgttacggtacggtaacgtacccggttagggtaacccgggggaaccgtaaccggggtaaccccgtcggttacccgtaacccggttcgtaccccg

SEQ ID NO: 368424 - DNA, 524 bp, Homo sapiens
  misc_feature: GZ8MTXP01DX7EG.9.67.G01.1.454.CMB.2.raw
  modified_base (519)..(519): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatctacggtgcgtccagcagggccacgtggtactcccggcaggttcaggtcggtagtgggtctggggacaagagttcgtctcaccatcagcagcctgcagtctgaagtattttgctagtttattactgtacagcaacttataatagttgccgtctctacgtttcggcggtagggaccaagggtggagctacgaaacgaacgtgttgcttgcacaatctgttcttcgnttccc

SEQ ID NO: 368425 - DNA, 535 bp, Homo sapiens
  misc_feature: GZ8MTXP01C4RHX.9.67.G01.1.454.CMB.2.raw
  modified_base (291)..(291): a, c, t, g, unknown or other
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctnatctacggtgcgtccagcagggccactggactcccggcaggttcagtggtagtggtctggggacaagtagttcgtctcaccatcagcagcctgcagtctgaagtatttgctagtttatactgtacagctacttaataattaggttggcccgtcgttcgtacgtttcgggcgggtaacggggaccaagggtggagcgtacgaaacgactagttggcttcgcacctaagtctgttcttcaattccc

SEQ ID NO: 368426 - DNA, 529 bp, Homo sapiens
  misc_feature: GZ8MTXP01CGHIE.9.67.G01.1.454.CMB.2.raw
  modified_base (510)..(510): a, c, t, g, unknown or other
  modified_base (524)..(524): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatctacggtgcgtccagcgaggggccacgtggtactccccggcaggttcaggtcggtagtggggtctggggacaaggtagttcgtctcaccatcagcagcctgcagtctgagtatttgctagtttattactgtacagcactataatagttggccgtctcgtacgtttcggcggtagggaccgaagggtggaggctacgaaacgaactggttgcttgcncaatctgttcttcnttccc

SEQ ID NO: 368427 - DNA, 526 bp, Homo sapiens
  misc_feature: GZ8MTXP01DFRFT.9.67.G01.1.454.CMB.2.raw
  modified_base (298)..(298): a, c, t, g, unknown or other
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaacagccactctcacctgcagggccagtcagagtcttggcaccaacttagcctggtaccagcagagacctggcttggctcccaggtcctcatctacggtncgtccagcagggccatggactcccggcaggttcagtcggtagtgggtctgggacagagttcgtctcaccatcagcagcctgcagtctgaagattttgctagtttattactgttacagcaacttataaatagttgccgtctcacgtttcggcggagggaccaagggtgagctaacgaaacgtaactgttacggcttggctaccaattccgtgttcttcaacgtttcccg

SEQ ID NO: 368428 - DNA, 582 bp, Homo sapiens
  misc_feature: GZ8MTXP01B9DHO.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtccctcatcgtacggtgcgtccagcgagggccacgtggtactccccggctaggttcaggttcggtaggtgggtcgtggggacaaggtagttcgtctcgaccatcagcagcctgcagtctagaagtattttgctagtttattactgtcagactacttaagtaattaggttgcccgtctcgtacgtttcgggacgggtacgggaccgtaaagggtggacgttcgtaacgaaacggaacgttgggttacgggcttggcccacgtaattccgttcgttaccttcgttaagtttcccccg

SEQ ID NO: 368429 - DNA, 534 bp, Homo sapiens
  misc_feature: GZ8MTXP01CU5BI.9.67.G01.1.454.CMB.2.raw
  modified_base (516)..(516): a, c, t, g, unknown or other
  modified_base (527)..(527): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccacgtggtactcccggcaggttcaggtggtagtgggtctggggacaagagttcgtctcgaccatcagcagcctgcagtctgaagtatttgctagtttattactgtcagactacttaataagtaggttcggccgtcttcgtacgtttcgggcggtacgggaccaagggtggagcgtacaaacgaactggttacgcttgcaccntctgttcttcncgttccc

SEQ ID NO: 368430 - DNA, 601 bp, Homo sapiens
  misc_feature: GZ8MTXP01C7271.9.67.G01.1.454.CMB.2.raw
  modified_base (289)..(289): a, c, t, g, unknown or other
  modified_base (299)..(299): a, c, t, g, unknown or other
  modified_base (374)..(374): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtctggcaccaacttgcctggtaccagcagagacctggcttggctcccgaggtcctnatctacggtncgtccagcgagggccagtggtactcccggcaggttcaggttcggtaggtgggtctggggactaggtagttcgtcncaccatcagcagctgcagtctgaagtatttgctagtttattactgtacagactaacttaataaagttaggttcggcccgtcttacgtaaccgtttcggggaccgggtaacggggaacccgaaaggggttcgggaacgttaccgtaaacgaaaacggtaaccgttgggttacgggttcttacggcctaaccgtaacttccgtcgttcctttcgttaaccgtttccccg

SEQ ID NO: 368431 - DNA, 580 bp, Homo sapiens
  misc_feature: GZ8MTXP01DUNF7.9.67.G01.1.454.CMB.2.raw
  modified_base (304)..(304): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggcctcccgagggtcctcatcgtacggtncgtccagcagggccatggtactcccggctaggtcaggtcggtagtgggtctgggacagagttcgtctcaccatcagcacgctgcagtctagtaagtattttgtactagtttattactgtacagtactaattaataagttaggttcggccgtcttcgtacgtttcgggcgggtacgggaccgaagggtaaggagttaccgtaacgaaacggtaaacgttggttacggcgttcggaacctacctaacgttccgtcgttcttccgttaacgtttccccg

SEQ ID NO: 368432 - DNA, 532 bp, Homo sapiens
  misc_feature: GZ8MTXP01AWKHG.9.67.G01.1.454.CMB.2.raw
  modified_base (300)..(300): a, c, t, g, unknown or other
  modified_base (438)..(438): a, c, t, g, unknown or other
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtncgtccagcagggccactggtatccccggcaggttcagtcggtagtggggtctggggacaagagtttcgtctcacatcagcagcctgcagtctgaagtatttgctagtttatacttgtcagcactataatagttgccgntcactttcgggcggtagggacccaagggtggaacggctacgaaacgaacgtgttacgggcttcggcacccaatctcgttcttccgaatttcccg

SEQ ID NO: 368433 - DNA, 521 bp, Homo sapiens
  misc_feature: GZ8MTXP01ANR0J.9.67.G01.1.454.CMB.2.raw
  modified_base (489)..(489): a, c, t, g, unknown or other
  modified_base (514)..(514): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatctacggtgcgtccagcagggccactggtactcccggcaggttcagtcggtagtgggtctggggacaagtgttcgtctcaccatcagcagcctgcagtctagagtatttgctagtttattactgtcagctactatatagttgccgctcacgttcggcgggtaggaccgaagggtggacggctcgaaacgaacgtgnggcttgcactaactctcgttcttcncttcccg

SEQ ID NO: 368434 - DNA, 527 bp, Homo sapiens
  misc_feature: GZ8MTXP01E0V5S.9.67.G01.1.454.CMB.2.raw
tcagtgatacgtctcacgaccggtgctcgatttagagtatacatattgggtttgggggaggaactgctcagttaggacacagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctccccagggtcctcatctacggtgcgtccagcagggcccactggtactccggccaggtcagtggtagtgggtctgggaacagtgttcgtctcacatcagcagcctgcagtctgtaagtattttgctagtttattactgtcaggctactataagtagttcggccgtctcgtacgtttcggcgggagggaccgaagggtggagcttacgaaacgtacgttaggttgctcgctccatcttgtcgttctaacg

SEQ ID NO: 368435 - DNA, 546 bp, Homo sapiens
  misc_feature: GZ8MTXP01DBZYN.9.67.G01.1.454.CMB.2.raw
  modified_base (253)..(253): a, c, t, g, unknown or other
  modified_base (263)..(263): a, c, t, g, unknown or other
  modified_base (318)..(318): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaacagccactctcacctgcagggccagtcggatctggcacattagcctggtaccngcagagaccnggctggctcccagggtcctcatctacggtgcgtccagcgagggccactgggtacncccggcaggttcaggtggtagtgggtctgggacaggtaagttcgtctcaccatcagcagccctgcagtctagaagtattttagctagtttattactgtacagcctaattaataatagttcggacctctcctacgtttcgggacggtacgggtaccgaagggtggaacgcgttacgaaacgagttggtggccttggccaaccatcgtgtcttcctaagttcccttcccg

SEQ ID NO: 368436 - DNA, 594 bp, Homo sapiens
  misc_feature: GZ8MTXP01EM6QF.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgaggtcctcatctacggtgcgtccagcagggccacgtggtactcccggcaggttcagtggtagtgggtctgggacagtagttcgtctcacatcagcagctgcagtctagtaagtattttagtaagtttatacgtgtacagtctaacgttaattaaacgttagttcgggcctcgtcgtaacgttttccggggcgggtaacggggaacctaaaggggtgggaacgtcgttacgaaaacggttaacgtggtacgggcttcggacctaacccgtaagttcccttggttcctttacctaacgtttccccttccccgg

SEQ ID NO: 368437 - DNA, 558 bp, Homo sapiens
  misc_feature: GZ8MTXP01CB25J.9.67.G01.1.454.CMB.2.raw
  modified_base (301)..(301): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccacttagcctggtaccagcagagacctggcttggctcccgagggtcctcatctacggtncgtccagcagggccactggtactcccgtcaggttcaggttcggtagtggggtctggggacaggtagtttcgtctcaccatcagcagcctgcagtctagagtatttgcttagtttattactgtcagtctacttataatagttgccgtctcgtacgtttccgggcggtacgggaccgaagggtcggagttccgtacgaaacgtaacgtggttacggttcttcggcaccctaattccttgttccttcgaacgtttccccg

SEQ ID NO: 368438 - DNA, 584 bp, Homo sapiens
  misc_feature: GZ8MTXP01DEP93.9.67.G01.1.454.CMB.2.raw
  modified_base (293)..(293): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaacagccactctcacctgcgacgggccagtcagagtctggcacctaacttagcctggtaccagcagacgactggcttggcctcccgagggtcctnatcgtacggtgccgtccagcgacgggcctacgttggtactcccggcctaggttcaggttggtaggtgggtcgtgggacaggtacgtttcgtctaccacctatcgagcagcctgctagtctagaagtattttgacttagtttattactgtacagtactaacttattaagttaggttcggcccgtctacgtaccggtttcgggaccgggtagggaccgtaaggggtcggaacgttcgtaacgaaacgtacgtggttacgcttcgcaacctgttctgttccttcgctttccccg

SEQ ID NO: 368439 - DNA, 551 bp, Homo sapiens
  misc_feature: GZ8MTXP01CL606.9.67.G01.1.454.CMB.2.raw
  modified_base (544)..(544): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatctacggtgcgtccagcagggccacgtggtactcccggcaggttcaggtcggtaggtggggtctggggacaaggtagttcgtctcactatcagcagcctgcagtctagtaagtattttgcttagtttattactgtcagctacttaattaattaggttcggcccgtcttcgtacgtttcgggcgggtacgggaccgaagggtggagctacgaaacgtaacgtggttcggcttcgcacctaatctgttcttcncttcccg

SEQ ID NO: 368440 - DNA, 532 bp, Homo sapiens
  misc_feature: GZ8MTXP01DBE8E.9.67.G01.1.454.CMB.2.raw
  modified_base (293)..(293): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggcctcccgagggtcctnatctacggtgcgtccagcgagggccacgtggtactccggcaggttcagtcggtagtgggtctgggacagagttcgtctcaccatcagcagctgcagtcagtagtatttgctagttatctgtcagctatataatgtagccgtctgtacgttcgggcgggacggtaccgaagggtggagttcctaacgaaacgtaaacgtgttacgggcttgccacctaatctcgttcttcaacgttcccg

SEQ ID NO: 368441 - DNA, 589 bp, Homo sapiens
  misc_feature: GZ8MTXP01CPT8G.9.67.G01.1.454.CMB.2.raw
  modified_base (294)..(294): a, c, t, g, unknown or other
  modified_base (305)..(305): a, c, t, g, unknown or other
  modified_base (410)..(410): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggcctcccgagggtccctnatcgtacggtncgtcagcgagggccagtggactcccggcaggttcaggttcggtaggtgggtctggggactaggtacgtttcgtctcactatcagcagcctgcagtctagtaagtnttttgacttagtttactactgtactagtactaacttaattaagtaggttcggccgtcttcgtaacggtttcgggacgggtacgggaaccgaagggtcggtaacgcgtaacgaaacggtaaaccgtggttacggcgttacggaaccacctaattcgtcgttccttaacgaactttccccg

SEQ ID NO: 368442 - DNA, 541 bp, Homo sapiens
  misc_feature: GZ8MTXP01CXJ4T.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaaacagccactctcacctgcagggccagtcagagtcttggcaccaacttagcctggtaccagcagagacctggcttggctcccgagggtccctcatctacggtcgcgtccagcagggccagtggactcccggcaggttcaggtcggtaggtgggtctggggactaagtagttcgtctcaccgatcagcagcctgcagtctagaagtatttgctagtttattactgttcagtactactataatacgttgccgtctctacgtttcggacggtagggaccaagggtggaagttctacgaaacgtacgtagttcgcgttcgaactcaatctgttcttcgaagttccc

SEQ ID NO: 368443 - DNA, 534 bp, Homo sapiens
  misc_feature: GZ8MTXP01AKKV6.9.67.G01.1.454.CMB.2.raw
  modified_base (375)..(375): a, c, t, g, unknown or other
  modified_base (380)..(380): a, c, t, g, unknown or other
  modified_base (444)..(444): a, c, t, g, unknown or other
  modified_base (508)..(508): a, c, t, g, unknown or other
  modified_base (526)..(526): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatctacggtgcgtccagcgagggccacgtggtactcccggcaggttcaggtcggtagtggggtctggggacagtagttcgtcncaccntcagcagcctgcagtctagaagtatttgctagtttatactgtcagctactataatagttgcctntctacgttcggcggaggaccgagggtcggagcgtacgaaacgtacgtggttcggcttggaaccnctaagttctgttacttcncttccccg

SEQ ID NO: 368444 - DNA, 522 bp, Homo sapiens
  misc_feature: GZ8MTXP01BWATE.9.67.G01.1.454.CMB.2.raw
  modified_base (509)..(509): a, c, t, g, unknown or other
  modified_base (519)..(519): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatctacggtgcgtccagcagggccacgtggtactcccggcaggttcaggtggtagtgggtctggggacaaggagttcgtctcaccatcagcagcctgcagtctgaagtattttgctagtttattactgtcagctactattaatagttggccgtctcgtacgtttcggcgggtagggaccgaagggtggagctacgaaacgacgtgttggcttgcacntctgttctcntcc

SEQ ID NO: 368445 - DNA, 611 bp, Homo sapiens
  misc_feature: GZ8MTXP01EM421.9.67.G01.1.454.CMB.2.raw
  modified_base (292)..(292): a, c, t, g, unknown or other
  modified_base (303)..(303): a, c, t, g, unknown or other
  modified_base (326)..(326): a, c, t, g, unknown or other
  modified_base (391)..(391): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggacaaacagccactctcacctgcagggccagtcagagtcttggcaccaacttagcctggtaccagcagagacctggcttggctcccgagggtcctnatcgtacggtncgtcagcagggccacgtggtacncccggctaggttcaggtcggtaggtgggtctggggacaaggtacgttcgttctcaccatcagcancctgcagtctagaagttattttgacttagtttattacgtgttacagtacgtaacttaattaaagttacggttcggtcccgtcttaccgtaaccggttttcgggcggggtaacggggtaaccgaaggggtgggaacgttccgtaaccgaaaacgtaaaccgttggttacgggttcttacggaaccaaccctgttcttcgttcttaaccgttaacgttcccg

SEQ ID NO: 368446 - DNA, 590 bp, Homo sapiens
  misc_feature: GZ8MTXP01C5ZZ7.9.67.G01.1.454.CMB.2.raw
  modified_base (203)..(203): a, c, t, g, unknown or other
  modified_base (407)..(407): a, c, t, g, unknown or other
  modified_base (415)..(415): a, c, t, g, unknown or other
  modified_base (564)..(564): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaaacngccactctcacctgcagggccagtcagagtcttggcaccaacttgcctggtaccagcagagacctggcttggcctcccgagggtccctcatcgtacggtgcgtccagcgagggccacgtggtactcccggcaggttcaggtggtaggtgggtcgtggggactaaggtacgtttcgttctcgaccatcagcacgcctgctagtcnggtaagtnttttgcttagtttattactggtactagtactaacttagttaaagtacggttcgccgtcttacgtaaccggtttcgggacgggtacgggaaccgtaagggtggacgacgtaacgaaacggtactgggttaggttccttacgcctaccgtnttcgtcgttacttcaacgtttccccg

SEQ ID NO: 368447 - DNA, 549 bp, Homo sapiens
  misc_feature: GZ8MTXP01EXIEX.9.67.G01.1.454.CMB.2.raw
  modified_base (204)..(204): a, c, t, g, unknown or other
  modified_base (232)..(232): a, c, t, g, unknown or other
  modified_base (525)..(525): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagngtcttggcacaacttagcctggtaccagcagagacctggcttggctcccgagggtcctcatctacggtgcgtcagcagggccacgtggtactcccggctaggttcaggttcggtagtgggtctggggacaaggtacgttcgttctcaccatcagcagcctgcagtctgaagtatttgctagtttatactgtcagtcattataagttagtcggccgtctctaccgtttcggggcggaggggtaaccgaagggtgggacgttcgtaacgaaacgtacgtagttggcttcgcactntcttgttcttcgttaacttccccg

SEQ ID NO: 368448 - DNA, 580 bp, Homo sapiens
  misc_feature: GZ8MTXP01DKI49.9.67.G01.1.454.CMB.2.raw
  modified_base (404)..(404): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttacgcctggtaccagcagagacctggcttggcctccgagggtcctcatcgtacggtgcgtccagcgagggccacgtggactcccggcctaggttcaggttggtaggtgggtctggggactaaggtagtttcgtctcaccatcagcagcctgctagtntagtaagtattttgacttagtttattactgtacacgtactaacttattaagtaggttcggccgtcgttacgtaccgtttcgggacgggtacgggaccgagggtggacgcgtaacgaaacgtaacgtggttacgggcttcggcctaaccttcgttcgtcgttccttcgttcgttccg

SEQ ID NO: 368449 - DNA, 635 bp, Homo sapiens
  misc_feature: GZ8MTXP01CCF56.9.67.G01.1.454.CMB.2.raw
  modified_base (292)..(292): a, c, t, g, unknown or other
  modified_base (303)..(303): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctnatcgtacggtncgtccagcgagggccagtcggtactcccggctaggttcaggtcggtaggtgggtctggggactaagtacgtttcgtctcaccatcagcagcctgcagtctagtaagtatttgtacttagtttattactgtacagtactaacttaagttaagttaggttcggacccgtcttaccgtaacggttttcggggaccggggaacgggtaaccgtaaaggggtcgggtaacgttacgttaaaccggaaaacggtaaaccgttggggttacgggcgttacgggaaccctaacccgtaattcccgtttcggttcctttaaccgttaaccgttttcccccg

SEQ ID NO: 368450 - DNA, 598 bp, Homo sapiens
  misc_feature: GZ8MTXP01AZ1LY.9.67.G01.1.454.CMB.2.raw
  modified_base (204)..(204): a, c, t, g, unknown or other
  modified_base (301)..(301): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaacttagcctggtaccagcagagacctggcttggctcccgaggtcctcatctacggtncgtcagcagggccacgtggtactcccggctaggttcaggttggtaggtgggtctggggaccaaggtacgtttcgtctcaccatcagcagcctgcagtctagaagtatttgcttagtttacttactgtacagtctaacgttaataagttaggttcggccctcgttccgtaacggttttccggggcgggtaacggggtaccgtaaagggtcgggaacgttcgttaacgaaacggtaaccgtgggttacgggttccttcggcctaccgtaacttcgtcggttcctttcaacgtttccccg

SEQ ID NO: 368451 - DNA, 548 bp, Homo sapiens
  misc_feature: GZ8MTXP01EKM51.9.67.G01.1.454.CMB.2.raw
  modified_base (205)..(205): a, c, t, g, unknown or other
tcagtgatacgtctcacgaccggtgctcgatttagagtatacatattggggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaacttagcctggtaccagcagagacctggcttggcctcccgagggtccctcatcgtacggtgcgtccagcacgggccacgtggtactcccggctaggttcaggtggtagtgggtctgggacagtagtttcgtctcaccatcagcagcctgcagtctagtaagttatttgactagtttattactgtacagctactagtaatagtgccgtctcgtacgtttcggacgggtacggaccgagggtggagttctacgaaacgtacgtggttacggcttcgccactcttctcgttcttcttaacttcccg

SEQ ID NO: 368452 - DNA, 509 bp, Homo sapiens
  misc_feature: GZ8MTXP01EESPX.9.67.G01.1.454.CMB.2.raw
  modified_base (435)..(435): a, c, t, g, unknown or other
  modified_base (492)..(492): a, c, t, g, unknown or other
  modified_base (503)..(503): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtactcccggcaggtcagtggtagtgggtctgggacagagttcgtctcaccatcagcagcctgcagtctgaagtattttgctagtttattactgtcagcactataatagttgccgntcactttcggcggagggaccagggtggagctacgaaacgacgtgttggcttcgcacntctgttcttcngttccc

SEQ ID NO: 368453 - DNA, 610 bp, Homo sapiens
  misc_feature: GZ8MTXP01DHR2M.9.67.G01.1.454.CMB.2.raw
  modified_base (297)..(297): a, c, t, g, unknown or other
  modified_base (405)..(405): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaacagccactctcacctgcagggccagtcagagtctggcacaacttgcctggtaccagcagacgacctggcttggctcccgaggtcctcatctacggtncgtccagcgacgggccacgtggactcccggcaggttcaggtggtaggtgggtctggggacaaggtacgtttcgtcctcaacccatcagcagcctgcagtctgtaagtntttgcttagtttattactgtacagtactacgttaataagtacggttgacccgtcgttaccgtaaccggttttcgggaccggggtaacggggtaaccgtaagggggtaacgggtacgttacgttaaacgaaaaccggtaacgttcgggttacgggttcttacggccaacctaagtccttcggttacctttcgttaacgtttccccg

SEQ ID NO: 368454 - DNA, 624 bp, Homo sapiens
  misc_feature: GZ8MTXP01BLNCI.9.67.G01.1.454.CMB.2.raw
  modified_base (433)..(433): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcacaacttagcctggtaccagcagagacctggcttggctcccgagggtccctcatctacggtgcgtccagcagggccacgtggtactcccggcaggttcaggtggtaggtgggtcgtgggacaagagttcgtctcgaccatcagcagcctgcagtctagaagttagttttgactagtttattacgtaggtaacnctaaacgttattaaacgttaggttcggcccgttctaccgttaccgtttacgggggacgggtaacggggtaacctaaggggtcgggaaacgtccgttaaacaaaacccgggttaagttgggtcgggttccttacggccgtaaaccccttgttccgttcgttacccttactaaccgtttccccgttaaccccg

SEQ ID NO: 368455 - DNA, 593 bp, Homo sapiens
  misc_feature: GZ8MTXP01EDM03.9.67.G01.1.454.CMB.2.raw
  modified_base (205)..(205): a, c, t, g, unknown or other
tcagtgatacgtctcacgaccggtgctcgatttagagtatacatattggggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaacttagcctggtaccagcagagacctggcttggctcccgagggtcctcatcgtacggtgcgtccagcgacgggccacgtggtactcccggcaggttcaggtcggtaggtgggtcgtagggactaaggtacgtttcgtctacaccctatccgaaggctaacgccgtgctagtactaggaagttattttgacttagtttattactgtacagctaacttaagttaattaggttcggccgtctcgtacgtttcggggacgggtaacgggtaccgaaggggtaacggacgactaacgaaacgtacgtgttcggcttcggaacctactaattctcgttcttccgttcttccccg

SEQ ID NO: 368456 - DNA, 610 bp, Homo sapiens
  misc_feature: GZ8MTXP01D1LYR.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacacgccaccctcacctgcagggccagtcagagtcttggcaccaacttagcctggtaccagcagagacctggcttggctcccagggtccctcatctacggtcgcgtccagcagggccacgtcgggtactcccggccaggttcaggtggtacgtggggtcgtggggacaggtaagtttcgttcgctacctatcagcacgcctagctagtctagaagttattttaggcttagtttattactgtacgagtctaattaattaattagttcggccgtcttcgacgttttcggggcgggtaacgggtaaccgtaggggtgggaacgtccgttaacgtaaaaccgttacggtacgtggggttaccttggacccaacgtcttccgttcggtctttacctaacttcccgtttcccccg

SEQ ID NO: 368457 - DNA, 623 bp, Homo sapiens
  misc_feature: GZ8MTXP01BJ0C9.9.67.G01.1.454.CMB.2.raw
  modified_base (232)..(232): a, c, t, g, unknown or other
  modified_base (292)..(292): a, c, t, g, unknown or other
  modified_base (325)..(325): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagngtcttggcacaacttagcctggtaccagcagagacctggcttggctcccgagggtccctnatctacggtgcgtccagcagggccagtggtacnccccggctaggttcagtgggtagtggggtctggggacaggtacgttcgtctcaccagtcgagctacgcctgcagtcgtagagtactttgtactagtttattactgtacagtactacttattaagttacgttcggcccgtcgttccgtaaccggttttccggggaccggggtaacggggtaacccggtaaagggggtcggaacggttaccgtaaaccgaaaccgggtaacgttacgggttcggcgttcggaaccctaaccgtcttccgttcggttacctttccgttaaccgtttccccg

SEQ ID NO: 368458 - DNA, 599 bp, Homo sapiens
  misc_feature: GZ8MTXP01D4ZYJ.9.67.G01.1.454.CMB.2.raw
  modified_base (203)..(203): a, c, t, g, unknown or other
  modified_base (292)..(292): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaaacngccactctcacctgcagggccagtcagagtcttggacaccaattagcctggaccagcagagacctggcttcggcctcccgaggtccctnactcgtacggtgcgtcccagccgacgggcctacgtggtacctccccgggctaaggttcaggtgggtaggtgggtcgtggggactaaggtacgtttccgtctaccaccctatccgaagtccagcctcgactagtcgtagtaagttagttttaggacttaagtttacttacgtgtacgtagacctaagttaattaagttacggttcgccgtcttcgtacgttcgggacgggacgggaccgaagggtggaagacctaacgaaagtacgtagcggcttcgaacactaactcgtcttcctcgttaacttccc

SEQ ID NO: 368459 - DNA, 588 bp, Homo sapiens
  misc_feature: GZ8MTXP01CNDQJ.9.67.G01.1.454.CMB.2.raw
  modified_base (219)..(219): a, c, t, g, unknown or other
  modified_base (269)..(269): a, c, t, g, unknown or other
  modified_base (323)..(323): a, c, t, g, unknown or other
  modified_base (329)..(329): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacccgnagggccagtcagagtctggcaccaattagcctggtaccagcagacgaccnggcttggctcccgagggtcctcatctacggtgccgtcagcaggccagtggtacncccggnaggttcaggtggtacggtggtctggggacaggtaacgttcgttcacaccatccagtcagcctgcagtctagaagtatttgactagtttattactgtacagtactaaggtaattaaagtagttcggccgtcgtacgtcggtttacgggcgggtaaggacccgtaagggtcggaacgtacgttaaccgtaaaacgacgttgggtcggttcttcggacctaacctacttcgttcgtacttcctaactttcccgttaaccccg

SEQ ID NO: 368460 - DNA, 594 bp, Homo sapiens
  misc_feature: GZ8MTXP01CBWBM.9.67.G01.1.454.CMB.2.raw
  modified_base (381)..(381): a, c, t, g, unknown or other
  modified_base (392)..(392): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttcggcctcccgagggtccctcatccgtacgggtgcgtccagcacgggcacgtggtactcccggcaggttcagtcggaggtggtctgggacagtagttcgtctcaccntcagcagcctnctagtctagaagtattttgacttagtttattacttgtactagtcgtaacttaagttaagttacggttcggtacccgtcgttccgttaccggtttccggggaccggggtaacgggtaccgtaaaggggtggtacggttactaacgaaacggtaacgtggttacgcgttacgtcacctaattcgtcttcttcgttaacttcccg

SEQ ID NO: 368461 - DNA, 594 bp, Homo sapiens
  misc_feature: GZ8MTXP01C2MFL.9.67.G01.1.454.CMB.2.raw
  modified_base (368)..(368): a, c, t, g, unknown or other
  modified_base (560)..(560): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaacagccactctcacctgcgagggccagtcagagtctggcaccaacttagcctggtaccagcagacgacctggcttcggcctcccgagggtccctcactcgtacggtgccgtccagcgagggccacgtggactcccggctaggtcaggtcgtaggtggtctgggactagngttcgtctcaccatcagcacgcctgcagtctagtaagtacttttgacttagtttattactgttacagtctaacttataagtcgttcggccgtcgtactacggtttccggggacgggtacggggtaccgtaagggtggaacgttaccgtaaacgaaacggtaacgttgggttacggcttcggaacctaacccngtttcccgtgttcctttcgttaaccgtttccccg

SEQ ID NO: 368462 - DNA, 556 bp, Homo sapiens
  misc_feature: GZ8MTXP01CSVJZ.9.67.G01.1.454.CMB.2.raw
  modified_base (270)..(270): a, c, t, g, unknown or other
  modified_base (325)..(325): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctacagggccagtcagagtcttggcaccaacttagcctggtaccagcagagaccnggcttggctcccagggtcctcatctacggtgcgtccagcagggccacgtggtacncccggcaggttcagtggtagtgggtctgggacagaagttcgtctcaccatcagcagccctgcaagtctagaagtattttgacttagtttattactgtcagtcaacttaattaaattagttacgggcccgtcttccgtacgttttccgggcgggtaggggaccaagggtggaagcttacgaaacgaacgtggtgcgttgccaaccagtctgttcttctaattccgttccccg

SEQ ID NO: 368463 - DNA, 605 bp, Homo sapiens
  misc_feature: GZ8MTXP01ESHGS.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcacaacttagcctggtaccagcagagacctggcttggctcccgagggtccctcatcgtacggtgcgtccagcagggccacgtggtactcccggcaggttcaggtggtaggtgggtctgggggactaagtacgttcgttctcgaccatcagcagcctgcagtctagagtatttgactagtttacttactgttacgagtacgtaacttaattaagtaggtttacggcccgtcttccgtaaccggtttccggggacggggtaacggggaccgtaaggggtcgggtaacgccgttaaaccgaaacggtaaacgtggttcggacgttcggtaacaccgtaacttcgtcgttccttccgttaacgttccccg

SEQ ID NO: 368464 - DNA, 719 bp, Homo sapiens
  misc_feature: GZ8MTXP01BT4PB.9.67.G01.1.454.CMB.2.raw
  modified_base (204)..(204): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggacaccaacttgcctaggtaccagcagagacctggcttggcctcccgagggtccctcatccgtacggtcgccgtccgaagccgacgggggcccctacggtcgggtaaccgtcccccgggacgtaacgggttcgaagggttggggtaggtgggggtcgtaggggacctaagggttacgtttcgttctaccgacccatacgacgtcgacgtcccgtgcgtacgtcgttaggtaagtttagtttttacgactttaaggttttacttaccgtggttactacgtacgtaacttaagttaaagttacggttacggccgtccgttacgttacccggttttcggggaccggggtaacgggtaacccggtaaggggttaacggaacgttaccgtaaacgaaacccggtaaagtcgggttacggccgttacggtaaccctaaacccctggtttcccttacggtttcccttcccgttaaccgttttcccccg

SEQ ID NO: 368465 - DNA, 548 bp, Homo sapiens
  misc_feature: GZ8MTXP01EW72G.9.67.G01.1.454.CMB.2.raw
  modified_base (204)..(204): a, c, t, g, unknown or other
  modified_base (292)..(292): a, c, t, g, unknown or other
  modified_base (302)..(302): a, c, t, g, unknown or other
  modified_base (403)..(403): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaacttagccctggtaccagcagagacctggcttggctcccgaggtcctnatctacggtncgtccagcagggccacgtggtactcccggcagcttcgagtggtagtgggtctggggaacagtgtttcgtctcacctatcagcagcctgcagtctgtaagtnttttgcttagtttattactgtctagggtactacgttaattaagttagttcggccgtctacgtacgtttcggggacggacgggaccgaaagggtggagcttacgaaacgtacttggttggctgccaacagtcttgtcttcgtaacc

SEQ ID NO: 368466 - DNA, 603 bp, Homo sapiens
  misc_feature: GZ8MTXP01CY8PA.9.67.G01.1.454.CMB.2.raw
  modified_base (293)..(293): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaaacagccactctcacctgcagggccagtcagagtcttggcaccaacttagcctggtaccagcagagacctggcttggcctcccgagggtccctnatcgtacggtgccgtccagcgagggccacgtggactcccggcaggttcaggtcggtaggtggggtctggggactaagggtacgttcgttctcgacctagtcagcagcctgcagtctagtaagtagtttcgacttagtttattactgtacagtacgtaacttaagttaagttacggttcggacccgtcgttacgtaccgtttcggggacgggtaacgggaaccgtaaggggtggaacgttcgtaacgaaacgtacgtggttcggcttcggaaccaacccttgtccgttcggttcctttcccgctttccccg

SEQ ID NO: 368467 - DNA, 616 bp, Homo sapiens
  misc_feature: GZ8MTXP01EMYQ4.9.67.G01.1.454.CMB.2.raw
  modified_base (390)..(390): a, c, t, g, unknown or other
  modified_base (403)..(403): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagacgacctggcttggcctcccgagggtcctcatcgtacggtgccgtccaggcgagggccacgtggtactcccggctaggttcaggttcggtaggtggggtctggggacaaggtcgttcgtctcaccntcagcagcctgcngtctagtaagttattttgacttagtttattactgtacagtactaattaataaagttaggttacggcccgtcttaccgtacggtttccggggacgggtaacggggtaaccggaagggtcgggaacgttacgtaaacgttaaaacggtaacgtgggttacggttcttcggaacctaccgtaagttcttacgttccttaaccttaacgtttccccg

SEQ ID NO: 368468 - DNA, 525 bp, Homo sapiens
  misc_feature: GZ8MTXP01BDG67.9.67.G01.1.454.CMB.2.raw
  modified_base (302)..(302): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatctacggtncgtccagcagggccatggtatcccggcaggttcagtggtagtgggtctggggacaagagttcgtctcaccatcagcagcctgcagtctgaagtatttgctagtttattactgtcagcaactataaatagttgcccgtctcgtacgtttcggcgggagggaccaaggggtggagcgtacaaaacgacgtaggttggcttgcaccaatctgttcttcaattcccg

SEQ ID NO: 368469 - DNA, 642 bp, Homo sapiens
  misc_feature: GZ8MTXP01ALMKY.9.67.G01.1.454.CMB.2.raw
  modified_base (295)..(295): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcacctaacttagcctggtaccagcagagacctggcttggcctcccgagggtccctnatccgtacggtgccgtccgagcgacggggccctacgtcgggtacctccccgggacctagggtttccgaggttgggtaggtcggggtcgtagggggacctaaggtacgtttcggttcctacgaccatcagccagccctgcctagtcgtagaagtagttttgcttagtttattactgtacgtagtacggtaacttaagttaattacggttcggtccgtcttccgtaaccgtttcggggacgggtaacgggaccggtaagggtgggacgttcgtaacgaaaccgtaacgtcggttaggttccgttgcctaccctaagttccttaggttccttccgttaacgtttcccccg

SEQ ID NO: 368470 - DNA, 569 bp, Homo sapiens
  misc_feature: GZ8MTXP01BN3FO.9.67.G01.1.454.CMB.2.raw
  modified_base (292)..(292): a, c, t, g, unknown or other
  modified_base (380)..(380): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaaacagccactctcacctgcagggccagtcagagtcttggcaccaacttgcctggtaccagcagagacctggcttggcctcccgagggtccctnatcgtacggtgccgtccaggcacggggccacgtggtactccggctaggttcaggtcggtaggtgggtctggggactaagtagttcgtntcgacatcagcagctgcagtctagtaagtatttgacttagtttattactgtactagtactaattagttaatagttcggccgtcgtctacgtttcgggcggggtacgggtaccgaagggtggaagcgtacgaaacggtacgtggttcggcttcggaacctactaattcgtgttacctcgttaacttcccg

SEQ ID NO: 368471 - DNA, 608 bp, Homo sapiens
  misc_feature: GZ8MTXP01B5569.9.67.G01.1.454.CMB.2.raw
  modified_base (368)..(368): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaaacagccactctcacctacagggccagtcagagtcttggcaccaacttagcctggtaccagcagagacctggcttggctcccagggtcctcatctacggtgccgtcagcagggccacgtggtactccggcaggttcagtggtagtgggtctgggacagtaagttcgtcncacatcagcagcctgcaggtctgaagtatttgacttagtttatactgtacagctaacgtattaagttagttcggccgtcttcgtacgtttccggggcgggtaacggggacccgtaaagggtgggaacgtaccgttaacggaaaaccgttaacgttcgggttacgggaccttcggacccgtaaccccgtatttccgttcgggtttccctttaccgtaaccgttttccccgtttccccccgg

SEQ ID NO: 368472 - DNA, 642 bp, Homo sapiens
  misc_feature: GZ8MTXP01C4PTR.9.67.G01.1.454.CMB.2.raw
  modified_base (322)..(322): a, c, t, g, unknown or other
  modified_base (371)..(371): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaacagccactctcacctacagggccagtcagagtcttggcaccaattagcctggtaccagcagagacctggcttggctcccgagggtcctcatctacggtgcgtcagcaggccacgtggtacnccggcaggttcaggtggtacgtggggtctggggacagtacgttcgttcncacctatcagcagccctgctagtctgtaagttatttagtacttagtttattacgttgtacagtactaacttaattaagttacgttcggtcccgtcgttccgtaccgttttacggggaccgggtaacgggtaacccgaaggggttgggaacgtaccgttaaaccgtaaaaccggaacgttacgggtacggttaccgttcggttaccctaaccccggtaagttccctttacggttccgtttaccgtttaaccgttccccgttttaaccccccg

SEQ ID NO: 368473 - DNA, 735 bp, Homo sapiens
  misc_feature: GZ8MTXP01CUA55.9.67.G01.1.454.CMB.2.raw
  modified_base (296)..(296): a, c, t, g, unknown or other
  modified_base (309)..(309): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaaacagccactctcacctgcagggccagtcagagtcttggacaccaacttacgcctggtaccagcagacgacctggtcttcggcctcccgaggtcctnactcgtacggtcncgtccagcgagggcccaacgttcggacgtcccggccgtaaggttccgaaggtccggttaggtggggtcgtaggggaactaaggtagtttccgttctaccaaccgtatccgaacgccgacgcccgttagacccgtaaggttcgtaaggtaaagttaagtttttggtacctttaaaggttttaattaaccgttggtaccctaagtacccgtaaactttaaagtttaaacgttacggtttcgggaccccgttaccgttacccgttaaccgggttttccggggtaacggggtaaccgggggaaacccgtaaagggggttcggaaacggttaccgtaaacgaaaacgggtaaccgtgggttacgggttcttacgggtcccaaacccgttcgttccgtttacgttaccctttaaccgttaaccgtttccccg

SEQ ID NO: 368474 - DNA, 595 bp, Homo sapiens
  misc_feature: GZ8MTXP01EV9Y1.9.67.G01.1.454.CMB.2.raw
  modified_base (362)..(362): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggaccagcagagacctggcttggctcccgagggtcctcatcgtacggtgcgtcagcagggccacgtggtactcccggccaggttcaggtcggtaggtgggtctgggacngtagttcgtctcacatcagcagcctgcagtctgtaagtattttgctagtttattactgtcagctaacttaattaagttagttcggtccgtccttacgtaccgttttcggggcgggtacggggacccgtaaaggggtcgggtaacggcgttaaccgaaacggaacgttcgggttacgggttccttacggcctacccgtaacttccgtcggtttcctttccgttaactttccccg

SEQ ID NO: 368475 - DNA, 602 bp, Homo sapiens
  misc_feature: GZ8MTXP01EY8I8.9.67.G01.1.454.CMB.2.raw
  modified_base (293)..(293): a, c, t, g, unknown or other
  modified_base (326)..(326): a, c, t, g, unknown or other
  modified_base (371)..(371): a, c, t, g, unknown or other
  modified_base (376)..(376): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtccctnatctacggtgcgtcagcagggccacgtggtacncccggcaggttcaggtggtagtgggtctgggacaagagttcgtcncaccntcagcagcctgcagtctagaagtatttgtctagtttattactgtacacgtacgtaacttaataattaggttcggtaccgtcgttcgtaccgtttcgggaccgggtaagggacccgtaaagggtcgggaacgttaccgtaacgaaaccgtaacgttcgggttacgggttcttacgggaacctaccgtaacttccgttacggttcctttaaccgttaactttcccccg

SEQ ID NO: 368476 - DNA, 601 bp, Homo sapiens
  misc_feature: GZ8MTXP01ADTM5.9.67.G01.1.454.CMB.2.raw
  modified_base (426)..(426): a, c, t, g, unknown or other
  modified_base (591)..(591): a, c, t, g, unknown or other
tcagtgatacgtctcacgaccggtgctcgatttagagtatacatattggggtttgggggaggaactgctcagttaggacccagacggaaccatggaagccccagcgcagcttctcttcctcctgctactctggctcccagataccactggaataatagtgatgacgcagtctccagccacctgtctgtgttccaggagaacagccactctcacctgcagggccagtcagagtctgcaccaattagcctggtaccagcagagacctggcttggcctcccgagggtcctcatccgtacggtcgcgtccgagcgacggggccagtcggtaccgtcccggcctaggttcgagggttcggttaggtggggtcgtgggggactaaggtagtttccgtctaccactatcgagcacgcctgcagtctgtaagtntttgacttagtttacttactgtacagtacgtaacttaagttaaacgttggttacgccgtcttacgttaccggtttcggggacgggtaacgggaccgtaagggtcggaagttaccgtacgaaaacgtacgtgacggcttacgccacgtaacttctcgttcttaacncgtttccccg

SEQ ID NO: 368477 - DNA, 680 bp, Homo sapiens
  misc_feature: GZ8MTXP01A28KW.9.67.G01.1.454.CMB.2.raw
  modified_base (551)..(551): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggacaccaacttagcctaggtaccagcagagacctggcttggcctcccgagggtccctcacttccgtacgggtcgccgtccgaggtccgacgggggcccacggttcgggtaccgttcccccgggaccgtaagggtttccagggttccgggtaggtcggggtcgtagggggaacctaagggtacgtttccgtactccgaacccagtcacgccacgtccctggactacggttactaggtaaacgttagttttgactttaagtttacttacttgttacacggtactaacgttaataaagttacggttcggacccgtntaccgtacggtttccggggacgggacggggaaaccgtagggggaacggtaacgaccgtaaacgaaacgtaacgtggttcggcttacggaaccacgttaacgtcgttcgttaccttcttccgtttccccg

SEQ ID NO: 368478 - DNA, 595 bp, Homo sapiens
  misc_feature: GZ8MTXP01C3BRV.9.67.G01.1.454.CMB.2.raw
  modified_base (384)..(384): a, c, t, g, unknown or other
tcagtgatacgtctcacgaccggtgctcgatttagagtatacatattggggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaacagccactctcacctgcagggccagtcagagtcttggcacaacttgcctggtaccagcagagacctggcttggcctcccgagggtcctcacttcgtacgggtcgcgtcccaggcgagggccacgtggtactccccggctaggttcgaggtcggtaggtgggtctgggacagtacgttcgtcncgaccatcagcacgcctgcagtctagtaagtagttttgacttagtttatacttgtactagtactaacttaataagttcggttcggccgtcttcgttaaccggtttcggggccgggtaacgggtaccgaaaggggtcgggaacgacgttaaaccgaaacggtaacgtggttcggcgttcgaaccactctctcgttacttcgttaacttcccg

SEQ ID NO: 368479 - DNA, 587 bp, Homo sapiens
  misc_feature: GZ8MTXP01CMVCO.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtctggcaccaacttagcctggtaccagcagagacctggcttggctcccgagggtcctcatctacggtgcgtccagcagggccacgtggtactccggcaggttcaggtcggtagtgggtcgtgggactaagagtttcgtctaccactatcagcagcctgcagtctagtaagtattttggacttagtttattactgtcagctaacttattaagtagttcggccgacttcgtaaccgtttcggggacggtaacggggaccgtaagggtcgggaacgttccgtaacgaaaacggtacctgggttcgggcttcggaacctaccgtaacttccgttgttccttccgttaacgtttccccg

SEQ ID NO: 368480 - DNA, 572 bp, Homo sapiens
  misc_feature: GZ8MTXP01BRF3A.9.67.G01.1.454.CMB.2.raw
  modified_base (204)..(204): a, c, t, g, unknown or other
  modified_base (291)..(291): a, c, t, g, unknown or other
  modified_base (543)..(543): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccaccctcacctgcagggccagtcagagtctggcaccaacttagcctggtaccagcagagacctggcttggcctcccgagggtccncatctacggtgcgtcagcgagggccagtcggtactcccggactaggttcaggtgggtacgtggggtcgtggggacaggtaacgtttccgtctcgaccctatccagcagccctgcagtctaggtaatagttttcgcttagtttatactgtacagctagtataatgttcggacctcgtcgtacggtttcggacggtacgggacgtaagggtggaagacgttagaaacgttagtcggtagcgttcggactaactnttcgttcgtacttcgtaacttccctcccg

SEQ ID NO: 368481 - DNA, 627 bp, Homo sapiens
  misc_feature: GZ8MTXP01A1VQR.9.67.G01.1.454.CMB.2.raw
  modified_base (258)..(258): a, c, t, g, unknown or other
tcagtgatacgtctcacgaccggtgctcgatttagagtatacatattggggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtctggcaccacttagcctggaccngcagacgacctggcttcggcctcccgagggtcctcagtcgtacggtgccgtccagcgacggggccacgttcggtacctccccggactaggttcaggtcgggtaggtggggtcgtggggacaaggtacgttcgtctcacctatcagcacgcctgacagtctggaagttatttgcttagtttattaccgtgtacgagtctaacttaattaacgttacggttacgggtccctcgttacgtaaccggtttcggggaccgggtaaggggtacccgaggggtaacgggaacgttaccgtaacgaaaccggtagttcggttacggcgttacggtaaccaccgtaacgttcgtcgttccttcgttaaccgtttcccg

SEQ ID NO: 368482 - DNA, 606 bp, Homo sapiens
  misc_feature: GZ8MTXP01B37G2.9.67.G01.1.454.CMB.2.raw
  modified_base (204)..(204): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaattagcctggtaccagcagagacctggcttcggctcccgagggtcctcatctacggtgcgtccagcgagggccacgtggtactcccggcaggttcaggtcggtaggtggggtctggggacaaggtacgttcgttctcaccatcaggcacgcctgcagtcgtagaagtattttggacttagtttattactgtacagctacttaattaagtaggttcggacccgtcgttaccgtaccggttttcgggaccggggtaacgggaccgtaacggggtggaacgccgtaacgaaacggtaaccggttcgttacgggccttacggcctaccgtaacgttccttcggttctttccgttaactttcccccg

SEQ ID NO: 368483 - DNA, 747 bp, Homo sapiens
  misc_feature: GZ8MTXP01BFVG6.9.67.G01.1.454.CMB.2.raw
  modified_base (202)..(202): a, c, t, g, unknown or other
  modified_base (722)..(722): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccacttgaataatagtgatgacgcagtctccagccacctgtctgtgttccaggagaaacngccactctcacctgcgagggccagtcagagtcttggcaccaactacgcctggtaccagcagacgaccgtggtcttggcctccgagggtccctctatccgtacggtcgcgtccaggcgacgggcctacgtcgggtaccgtccccgggtcgtagggttcgacggggttagggttaggggttcgggggttacgtacgggggaactaacggggttaacgttttccggttaccttaccgaaccctacgtccgaacgggtccctaacggtcccgttaggccgttaaggttacccgttaagggttaaacggttttaagtttttacggttacgtttaagtttttaaacttacgttacggttactaacggtacttaaacgtttaaagttaaacgtttacgggttccgggtcccgttcgttacggttaccggtttaccggggacggggtaaacggggtaccgggtaagggtaacgggaacgttaccgtaaacgttaaacgtacgtggttacggcttacggaactaccgtnttctgttccttaacgttcgttcccg

SEQ ID NO: 368484 - DNA, 625 bp, Homo sapiens
  misc_feature: GZ8MTXP01AXQ0T.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaaacagccactctcacctgcagggccagtcagagtctggcacaacttgcctggtacagcagagactggcttggcctcccgaggtcctcagtcgtacggtgccgtccgagccgacgggccacgtggtaccgtccccggacgtaggttcgaggttcggtaggtcggggtcgtaggggactaagggtacgtttccgtctcgaacctatcgacgcagcctgctagtctagaagttagtttgacgttagtttactacgttgtacgtagtactaacttaagttaagttagttcggccgtccgttacgttaccggtttcggggacgggtacgggaaaccgtaaggggtgacgttccgtaaacgaaacggtaacgtcggttcggcgttacggaaccctaccgtaattcgtcttaccgttccttaacgtttccccg

SEQ ID NO: 368485 - DNA, 604 bp, Homo sapiens
  misc_feature: GZ8MTXP01DXXBM.9.67.G01.1.454.CMB.2.raw
  modified_base (196)..(196): a, c, t, g, unknown or other
  modified_base (201)..(201): a, c, t, g, unknown or other
  modified_base (407)..(407): a, c, t, g, unknown or other
tcagtgatacgtctcacgaccggtgctcgatttagagtatacatattgggtttggggaggaactgctcagttaggacacagacggaaccatggaagccccagcgcagcttctcttcctcctgctactctggctcccagataccactggaataatagtgatgacgcagtctccagccacctgtctgtgttccagganaaacngccactctcacctgcaggccagtcagagtctgcaccacttagcctggtaccagcagagacctggcttggctcccgagggtcctcatcgtacggtgcgtcccagcgagggcccacgtggtactcccggcaggtcagtggtagtggtctagggaacagtggttcttcgtcacctatcgaagtcacgtcctgcaggtctaggtaacgtnttttggcttagtttacttacgttgttaccgtaggggtacctaaagttagttaaacgttaggttcggccgtcgttacgtacgttttacgggacgggtaacgggaacccgtaaagggttcggacgtaccgttacgtaaaacgtaacgttcggttcgggaccttcggactaaccgtatccgttacgttcttcgtaacccg

SEQ ID NO: 368486 - DNA, 615 bp, Homo sapiens
  misc_feature: GZ8MTXP01A3FO3.9.67.G01.1.454.CMB.2.raw
  modified_base (203)..(203): a, c, t, g, unknown or other
  modified_base (231)..(231): a, c, t, g, unknown or other
  modified_base (303)..(303): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaaacngccactctcacctgcagggccagtcagngtctggcacaactgcctggtaccagcagacgactggcttggcctcccgagggtccctgactcgtacgggtcncgtccagcgacgggccacgtggtactcccggctaggttcagggttggtaggtggggtctggggactaaggtcgtttcgtctcacctatcgagcagcctgcagtctagtaagtatttcgacttagtttattacgtgtacagtacgtaactaagttaacgtacggttcggtcccgtacgttccgtacggtttccggggacgggtaacgggaaccgaaggggttcggaacgttaccgtaacgaaacggtaaccgttgggttacgggcttacggaacctactaacgttcgtacgttccttaaccgaactttccccg

SEQ ID NO: 368487 - DNA, 654 bp, Homo sapiens
  misc_feature: GZ8MTXP01C32LH.9.67.G01.1.454.CMB.2.raw
  modified_base (203)..(203): a, c, t, g, unknown or other
  modified_base (211)..(211): a, c, t, g, unknown or other
  modified_base (265)..(265): a, c, t, g, unknown or other
  modified_base (268)..(268): a, c, t, g, unknown or other
  modified_base (334)..(334): a, c, t, g, unknown or other
tcagtgatacgtctcacgaccggtgctcgatttagagtatacatattggggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaacngccactcncacctgcgagggccagtcggagtctggccacaacttagcctggtaccagcaganacnggctggcctcccgagggtccctcatccgtacggtcgccgtccagccgagggcccacgtcgggtacncccgggactaggttcgaggttcggtaggtcgggtcgtggggactaggtaacgtttcgtctacacctatccgagcagcctgctagtctagtaagttacgtttaggtactttagtttacgtaccgtgtactagtacctaattaacgttaagttacggttccggtccgttccgtccgttacgggtttccggggacgggtaacggggtaccgtaaggggttggaacgtaacgttaaccggaaacgttacggtcggtcggttccgttcggaccctaacgtcttccgttcgttaccctttactaaccgttccccggtttaaccccg

SEQ ID NO: 368488 - DNA, 598 bp, Homo sapiens
  misc_feature: GZ8MTXP01CD4D2.9.67.G01.1.454.CMB.2.raw
  modified_base (291)..(291): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaaacagccactctcacctgcagggccagtcagagtcttggcacaacttgcctggtaccagcagacgaccgtggcttcggcctccgaggtcctnatcgtacggtcgcgtcgagcgacgggccacgtggtacgtcccggacgtaggttcgaggttcggtaggtgggtcgtgggactaaggtacgttcgtcacgactatcacgctacgcctgcgtagtcgtagtagttagtttcgacttagtttactactgtacagtactaattacgttaagtcggttcgaccgtcgtacgttacgttcggggacgggtacggacggtaagggtcggacgttcgtaaaccgaaacggtacgtggttacgcttcggaacctacgtcgttcgtcgttcttccgaacgtttccccg

SEQ ID NO: 368489 - DNA, 636 bp, Homo sapiens
  misc_feature: GZ8MTXP01DJYA7.9.67.G01.1.454.CMB.2.raw
  modified_base (199)..(199): a, c, t, g, unknown or other
  modified_base (204)..(204): a, c, t, g, unknown or other
tcagtgatacgtctcacgaccggtgctcgatttagagtatacatattggggtttgggggaggaactgctcagttaggacccagacggaaccatggaagccccagcgcagcttctcttcctcctgctactctggctcccagataccactggaataatagtgatgacgcagtctccagccaccctgtctgtgttccagganaaacngccactcctcacctgcgagggccaggtcggagtcttggcaacctaacttagcctaggtaccagcagacgacctggcttcggcctcccgagggttccctcagttccgtacgggtcgccgtccaggccgacgggggccctaacgtcgggtaacctccccggggacttagggttcgagggttggtacggtggggtctagggggactaggtacgtttccgttctacactatcagcgacgccctgcgtagtcgtaggtaagttagtttagtacttagtttattacgtgtactacgactaacttaagttaagttacggtcggtcgtcttcgtaccggtttacgggcgggtaacggggaccgtaagggtcgggaactacgttacgaaacgaacgtcgtaggcgttgacctcattcgtcgttcttactcttcccgtcccg

SEQ ID NO: 368490 - DNA, 761 bp, Homo sapiens
  misc_feature: GZ8MTXP01BU2NS.9.67.G01.1.454.CMB.2.raw
  modified_base (204)..(204): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcacacttagcctggtaccagcagagacctggcttggcctcccgagggtcctcgtatccgtacgggtcgccgtaccaggaccgacgggggcccctaacgttcgggttaccgtccccgggggtaccgtacggggtttccgaagggttcgggggttagggttcggggggttccgtcggggggtaactaagggtaacggttttccggttacctcccgaacctagtccgaacgtcccgacgtcccgttggaccgtaaggttcctaggttaagtttaagttttttcggtaccttaaggttttttaacgtacttacggttacaacggttctaaacgttttaaagttaacgttacgggtttcggaccccgttcgttaccggttacgggttttcccgggacgggggtaacgggtaacccgggtaaggggtcgggaacgttccgtaaaccgaaacggtaacgtcgggttacggccttacgggcctaaccgtcggttacttcggtttacccttcccgttcccgtttaaccccg

SEQ ID NO: 368491 - DNA, 701 bp, Homo sapiens
  misc_feature: GZ8MTXP01BMM4U.9.67.G01.1.454.CMB.2.raw
  modified_base (214)..(214): a, c, t, g, unknown or other
  modified_base (259)..(259): a, c, t, g, unknown or other
  modified_base (268)..(268): a, c, t, g, unknown or other
  modified_base (403)..(403): a, c, t, g, unknown or other
tcagtgatacgtctcacgaccggtgctcgatttagagtatacatattggggtttgggggaggaactgctcagttaggacccagacggaaccatggaagccccagcgcagcttctcttcctcctgctactctggcctcccagataccactggaataatagtgatgacgcagtctccagccaccctgtctgtgtttccaggagaaacagccactcncacccgcagggccagtcagagtctggcaccaattagcctggaccngcagagcgnggctggcctcccgagggtccctcagttcgtacgggtcgcgtccaggcgacggggccctacgtcggtacgtccccggactagggttcaggttgggtacggtcgggggtcgtaggggactaggtaacgtttcgttcncacccatcagcacggcctgctagtctaggtaaagttagttttacgacgtttaagttttattaacgttcgtacgtaacgtacctaaacgtttaaagttaacggtttaacgggtttaccgggtcccggttccgttcccggttaccggtttacccgggggacggggtaacgggggtaacccgtaaaggggttcgggaacgtaccgttaacggaaaacggttacgtacgggtcggttaccgttcgggacctaaccgtacttccggttcgttcctttacctaaccggtttcccgtttcccccg

SEQ ID NO: 368492 - DNA, 638 bp, Homo sapiens
  misc_feature: GZ8MTXP01BYGIN.9.67.G01.1.454.CMB.2.raw
  modified_base (340)..(340): a, c, t, g, unknown or other
  modified_base (373)..(373): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcaggccagtcagagtctggcaccacttagcctggtaccagcagagacctggcttcggcctcccgagggtccctctactccgtacgggtcgccgtccaggacgacggggcccacgtcggtacnccccggctaggttcaggttggtaggtgggtcgnggggactaaggtacgttccgttctcacctgtccagcagcccttgacctgtcgtagaagttattttggacttagtttaattctgtacaagtcaactttaagtaacgttagtcggtcccgtacttccgtaacggtttccggggacgggtaacgggtaccgaaggggttcgaacggttccgttaaacgaaacggtaaacgttgggacggttccacggtaaccaccccgtaatttcgtcgtttacccttcgttaacccgttttcccccg

SEQ ID NO: 368493 - DNA, 602 bp, Homo sapiens
  misc_feature: GZ8MTXP01A8D14.9.67.G01.1.454.CMB.2.raw
  modified_base (292)..(292): a, c, t, g, unknown or other
  modified_base (303)..(303): a, c, t, g, unknown or other
  modified_base (393)..(393): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcacaacttagcctggtaccagcagagacctggcttggctcccgagggtccctnatcgtacggtncgtcagcgacgggccacgtggtactcccggacctaggttcaggttcggtagtcgggtcgtggggactaaggtagtttcgtactcaacctntacgagcagcccgtgccgagtctagtaaagttacgttttgattagttttatcgtgtactaacgtcgtaacttaattaaacgttgttcggaccctgttaccgtacggtttcgggacgggtacgggaacccgtagggtcgaacgttacgtaacgaaacgtacgtggttcggcttcggaacacgtaatcgtacttcttaaccgttcttcccg

SEQ ID NO: 368494 - DNA, 645 bp, Homo sapiens
  misc_feature: GZ8MTXP01EL3VW.9.67.G01.1.454.CMB.2.raw
  modified_base (317)..(317): a, c, t, g, unknown or other
  modified_base (415)..(415): a, c, t, g, unknown or other
  modified_base (485)..(485): a, c, t, g, unknown or other
tcagtgatacgtctcacgaccggtgctcgatttagagtatacatattgggtttggggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcgagggccagtcagagtctggcactaacttacgccgtggtaccagcagagacgtggcgtaggccgtcccgagggtcctactatctacggtcgccgcgngcgacgggccacgtcggtaccgtcccggacctaggttcgacggttggtagggtggggtacgtaggggacgtaaggtacgttcgtttctaccgacctancgtacgcacgtcccgtgcgtagtacgtagaagttacttttgactttagttttactacgttgctacgactnttaaagttagttacggttccggtaccgtgttccgttacgttccggggaggaaccggggtaacgtaaaggggtcggtacgttacgtaaacccgaaaggtccgttgggacgggttcacggaaccctaatccgtttcgctttcctaacgttaacctttccccg

SEQ ID NO: 368495 - DNA, 750 bp, Homo sapiens
  misc_feature: GZ8MTXP01C2075.9.67.G01.1.454.CMB.2.raw
  modified_base (200)..(200): a, c, t, g, unknown or other
  modified_base (213)..(213): a, c, t, g, unknown or other
  modified_base (327)..(327): a, c, t, g, unknown or other
  modified_base (513)..(513): a, c, t, g, unknown or other
tcagtgatacgtctcacgaccggtgctcgatttagagtatacatattggggtttggggggaggaactgctcagttaggacccagacggaaccatggaagccccagcgcagcttctcttcctcctgctactctggctcccagataccactggaataatagtgatgacgcagtctccagccaccctgtctgtgttccagganaacacgccactcncaccgtgacgacgggccagtacagtgttcgtcggaccaacctaacgttcgacccgttaggaacccagacgaaggacgaccgtggtccgttcggcccttcccggcgggtcccctnacgtccgtaccgggtcgaccgtccgaggccgacggggtccctaaccggttgggtacccggtccccgggacctaagggttccgtaaggggttgggtacggggtcggggtcgtagggggtactaacgggttacgtttccgtactaccgtactaatccgacgtcacgtctgactcgtgtagtaaagttntttacggtactttaagtttactacgtagtacctaggtaccgttaattaacggtttaaagtcgggttaccggccgttacgtccggttacggggttccggggaacgggggtaacggtaaccggtagggggtaaccggtaacttaacggttaaccgaaaaccggttggtacgggttacggttcgttaccggaaccttaacctcgttgttaccggttacttccgttaacctttaaccccgg

SEQ ID NO: 368496 - DNA, 564 bp, Homo sapiens
  misc_feature: GZ8MTXP01DFXMH.9.67.G01.1.454.CMB.2.raw
  modified_base (289)..(289): a, c, t, g, unknown or other
  modified_base (300)..(300): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaaacagccactctcacctgcaggccagtcagagtctggcacaacttagcctggaccagcagagacctggcttggcctcccgaggtccctanatcgtacggtnccgtaccagcgtaggccctacggttggtacctcccggactaaggttcaggtcggtaggtgggtcgtgggaactaggtacgtttcgtacaccgaacatacacgcgacgctgctagtacgtagtaagtagtttagtattagtttattatgtacagacgtaataataatagtcgtcgtcgtcgtacgtcggtcggacggacgaaggtaaggagactaacgaaacgtaacgtgttgcacgaacactaactctcgttcttcttcgtccg

SEQ ID NO: 368497 - DNA, 671 bp, Homo sapiens
  misc_feature: GZ8MTXP01C435V.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaacagccactctcacctgcagggccagtcagagtcttggcacaacttagcctggtaccagcagagacctggcttggctcccgagggtccctgatcgtacggtgcgtaccgagcgacggggcccaacgttcgggtaacctccccgggacctaaggggtttccaaggttcgggtaggtggggtccgtgggggactaaggtagtttccgttctaccgaacctatcgacgcacgcctgcagtctagaagtattttggactaggtttatactgtactagactacgttaataaagtacggtttcgggcccgtccttaccgtaccgttttcggggaccggggtaacgggaacccgtaaagggggttaacgggaacgttaaccgttaaccaaaaacgggtaaaccgttcgggttagggcccttacgggcctaaccccgtaagttccgttacggttccctttaacgttaacgtttcccccg

SEQ ID NO: 368498 - DNA, 519 bp, Homo sapiens
  misc_feature: GZ8MTXP02GIGS6.9.67.G01.1.454.CMB.2.raw
  modified_base (448)..(448): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatctacggtgcgtccagcgagggccacgtgggtactccccggctaggttcaggtcgggtagtggggtctggggacaggagttcgttctcaccatcagcagcctgcagtctgaagtatttgctagtttactactgtcagcatataatagttgccgtntcacgttcggcggtagggaccgaagggtcggagctacgaaacgactgtgctgcacagtctgtctcacttcc

SEQ ID NO: 368499 - DNA, 495 bp, Homo sapiens
  misc_feature: GZ8MTXP02F4RL1.9.67.G01.1.454.CMB.2.raw
  modified_base (432)..(432): a, c, t, g, unknown or other
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggcaggttcagtggtagtgggtctggggacagagttcgtctcaccatcagcagcctgcagtctgaagtatttgctagtttatactgtcagcactatatagttgccgntcactttcggcgagggaccaaggtggagctcaaacgactgtagctgcacatctgtctcattcc

SEQ ID NO: 368500 - DNA, 519 bp, Homo sapiens
  misc_feature: GZ8MTXP02I11EA.9.67.G01.1.454.CMB.2.raw
  modified_base (301)..(301): a, c, t, g, unknown or other
  modified_base (500)..(500): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtncgtccagcagggccacgtggtactcccggcaggttcaggtggtagtgggtctgggacagagttcgtctcaccatcagcagcctgcagtctgaagtatttgctagtttattactgtacagtcacttataatagttgcccgctcacgtttcgggcggtagggaccaaagggtcggagctacaaacgaacgtgacggctgcncatctgtcttcactttccc

SEQ ID NO: 368501 - DNA, 506 bp, Homo sapiens
  misc_feature: GZ8MTXP02HI5UA.9.67.G01.1.454.CMB.2.raw
  modified_base (375)..(375): a, c, t, g, unknown or other
  modified_base (439)..(439): a, c, t, g, unknown or other
  modified_base (482)..(482): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagccctggtaccagcagacgacctggctggctccccgagggtcctcatctacggtgcgtccagcagggccactggtatcccggcaggttcagtcggtagtggtctggggacagagttcgtctcaccntccagcagcctgcagtctgaagtatttgctagtttatactgtcagtcactataatgttagccgntctacttcggcggagggaccaaggtcggagctacaaacgtacngtcgctgcacatctgtctcattcc

SEQ ID NO: 368502 - DNA, 585 bp, Homo sapiens
  misc_feature: GZ8MTXP02GADT0.9.67.G01.1.454.CMB.2.raw
  modified_base (375)..(375): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggctggcctcccgaggtcctcatcgtacggtgcgtccagcgacgggccacgtggtacgtcccggctaggtcaggtggtagtgggtctggggacaggtgttcgtcncgactatcagcagcctgcagtctagaagtagtttgacttaagtttattactgtacagactacttaataagttacggttcggcccgtcttacgtacgtttcggggacgggtaacggggaccgtaagggtcgggacgtaccgtaaacgaaaacggtaacgttggtcggcgtcggaacctacccgtattccttcgtcctttcacgtttccccg

SEQ ID NO: 368503 - DNA, 531 bp, Homo sapiens
  misc_feature: GZ8MTXP02HVTMI.9.67.G01.1.454.CMB.2.raw
  modified_base (383)..(383): a, c, t, g, unknown or other
  modified_base (451)..(451): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctccccgagggtcctcatctacggtgcgtccagcgagggccacgtggtactcccggctaggttcaggtcggtagtggggtctggggacaggtgttcgttctcaccntcagcagcctgcagtctagagtatttgctagtttattactgtcagctactaataataggttacggccncttctacgtttcgggcggagggaccgagggtggagctacgaaacgactgtcggctgcacctatctgtcttctacttcccg

SEQ ID NO: 368504 - DNA, 533 bp, Homo sapiens
  misc_feature: GZ8MTXP02JORPQ.9.67.G01.1.454.CMB.2.raw
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctccagggtcctcatctacggtgcgtccagcagggccacgtggtatcccggccaggttcagtggtagtgggtctggggacaggagttcgtctcgaccatcagcacgcctgcagtctgaagtatttgctagtttattacgtgtcagtctactataattagttacggccgtctctacgtttcgggcggtagggaccgaagggtcggagcgtacgaaacgaacgtcgtacggctgcgacactctcgtcttctacttcccg

SEQ ID NO: 368505 - DNA, 524 bp, Homo sapiens
  misc_feature: GZ8MTXP02JXCJI.9.67.G01.1.454.CMB.2.raw
  modified_base (364)..(364): a, c, t, g, unknown or other
  modified_base (400)..(400): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggcctcccgagggtcctcatctacggtgcgtccagcagggccacgtggtactcccggcaggttcagtggtagtgggtctggggacaggngttcgtctcaccatcagcagcctgcagtctgaagtntttgctagtttattactgtcagcactatatagttgccgtctcgtacgttcggcggacgggacgagggtcggagcgtacgaaacgtacgtcgtacgctcgcacctactctgtcttccacttcccg

SEQ ID NO: 368506 - DNA, 520 bp, Homo sapiens
  misc_feature: GZ8MTXP02FS8JA.9.67.G01.1.454.CMB.2.raw
  modified_base (292)..(292): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtccctnatctacggtgcgtccagcagggccactggtactcccggcaggttcagtggtagtgggtctgggacagagttcgtctcaccatcagcagctgcagtctgaagtatttgctagtttatactgtcagcactatatagttgccgtctctacgtttcggcggtagggaccgaagggtcggacgcgtacgaaacgaacgtgtacggctagcgacctatctgtcttcacttcccg

SEQ ID NO: 368507 - DNA, 505 bp, Homo sapiens
  misc_feature: GZ8MTXP02JVC7I.9.67.G01.1.454.CMB.2.raw
  modified_base (369)..(369): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggcaggttcagtcggtagtgggtctggggacaggagttcgtcncaccatcagcagcctgcagtctgaagtatttgctagtttatactgtcagcactatatagttgccgctcacgtttcggcggtagggaccgaaggtggagctacgaaacgactgtcgctgcacatctgtctcacttcc

SEQ ID NO: 368508 - DNA, 522 bp, Homo sapiens
  misc_feature: GZ8MTXP02G09SY.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccacgtggtatccccggcaggttcagtggtagtgggtctggggacagagttcgtctcaccatcagcagcctgcagtctgaagtatttgctagtttatactgtcagcactataatagttgccgctctactttcgggcggtagggaccaaagggtggagctacgaaaacgaacgtgtacggctggcaccattcctgtccttcactttcccg

SEQ ID NO: 368509 - DNA, 562 bp, Homo sapiens
  misc_feature: GZ8MTXP02HLILQ.9.67.G01.1.454.CMB.2.raw
  modified_base (325)..(325): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcggagtcttggcaccaacttagcctggtacccagcagagacctggcttggcctcccagggtcctcatctacggtgcgtcagcagggccagtggtacncccggcaggttcaggtggtagtgggtctgggacagagttctctcaccatccagcagccctgcagtctagaagtatttagacttagtttattactgtcagtctaactattaagtaggttcggccgtctacctacgtttcgggacgggtacgggaaccgtaagggtcggacgacgtacgaaacgtaacgtaggtcggacgtcgacgaactacgtcgtcgttcttacactttcctccccg

SEQ ID NO: 368510 - DNA, 515 bp, Homo sapiens
  misc_feature: GZ8MTXP02GFY14.9.67.G01.1.454.CMB.2.raw
  modified_base (291)..(291): a, c, t, g, unknown or other
  modified_base (301)..(301): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctnatctacggtnccgtccagcagggccagtggtactcccggcaggttcaggtggtagtgggtctggggacagagttcgtctcaccatcagcagcctgcagtctagaagtatttgctagtttatactgtacagcactaatatagtgacctctcacgtttcggcggagggaccaaggtggagactacgaaaacgactgtacggctgcaccatcctgtcttcacttccg

SEQ ID NO: 368511 - DNA, 537 bp, Homo sapiens
  misc_feature: GZ8MTXP02G3KWJ.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggcctcccgagggtccctcatctacggtgcgtccagcgagggccacgtggtactcccggcaggttcagtggtagtgggtctgggacaggtagttcgtctcacatcagcagcctgcagtctagaagtatttgactagtttattactgtacagtacactataattggtacggccgtcgtactacgtttcggacggtaacggaccgaagggtgaggctaacgaaacgaacgtgtacgctgcacgtactctgtcttctacttcccg

SEQ ID NO: 368512 - DNA, 525 bp, Homo sapiens
  misc_feature: GZ8MTXP02JMM5L.9.67.G01.1.454.CMB.2.raw
  modified_base (402)..(402): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggcctcccgagggtcctcatctacggtgcgtccagcagggccacgtggtactcccggcaggttcaggtcggtagtgggtctggggacaggagttcgtctcaccatcagcagcctgcagtctgaagtntttgctagtttatactgtacagctactataatggtacgccgtctacgtacgtttcgggcggagggaccgaagggtcggagactacgaaacgacgtgtacgctgcacactctgtctcacttccc

SEQ ID NO: 368513 - DNA, 626 bp, Homo sapiens
  misc_feature: GZ8MTXP02F1AUU.9.67.G01.1.454.CMB.2.raw
  modified_base (302)..(302): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtctggcaccaacttagcctggtaccagcagacgacctggcttggcctcccgagggtcctcatcacggtnccgtcagcagggccacgtggtactcccggcaggttcaggtcggtagtggggtctggggacaggtacgtttcgttctcaaccgatccgaagcacgcctgcagtctagaagtatttgacttagtttattactgtacagtctaacttataaagttaggttcggtcccgtacgttaccgtaaccggtttcggggccggggtaaacggggtaaccgaaaggggttacggaacggaccgttaaccgaaaaaccggtaacgttgggtacgggtacctacggaacccgtaacccgttattaccgttagttccctttaccgtactttcccccg

SEQ ID NO: 368514 - DNA, 496 bp, Homo sapiens
  misc_feature: GZ8MTXP02FXYID.9.67.G01.1.454.CMB.2.raw
  modified_base (289)..(289): a, c, t, g, unknown or other
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtctggcaccaacttagcctggtaccagcagagacctggcttggctcccagggtcctnatctacggtgcgtccagcagggccactggtatcccggcaggttcagtggtagtgggtctggggacagagttcgtctcaccatcagcagcctgcagtctgaagtatttgctagtttatactgtcagcactataatagttgccgctcactttcggcggtagggaccaaggtgagctacaaacgactgtcgctgcacatctgtctcatcc

SEQ ID NO: 368515 - DNA, 509 bp, Homo sapiens
  misc_feature: GZ8MTXP02F8CRK.9.67.G01.1.454.CMB.2.raw
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccatggtactcccggcaggttcagtggtagtgggtctggggacagagttcgtctcaccatcagcagcctgcagtctgaagtatttgctagtttatactgtcagcactataatagttgccgtctctacgtttcggcggtagggaccaagggtcggagctacgaaacgactgtacggctgcacatctgtctcacttccc

SEQ ID NO: 368516 - DNA, 528 bp, Homo sapiens
  misc_feature: GZ8MTXP02IQ36K.9.67.G01.1.454.CMB.2.raw
  modified_base (292)..(292): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggacaaacagccactctcacctgcagggccagtcagagtcttggcaccaacttagcctggtaccagcagagacctggcttggctcccgagggtcctnatctacggtgcgtccagcagggccacgtggtactcccggctaggtcagtggtagtgggtctggggacaggtgttcgtctcaccatcagcagcctgcagtctagaagtatttgactagtttatacgtgtcagtctacttataattagtgccgtctctacgttcggacggtaggacgtaaggtcggacgcgtacaaacgtactgtacggctcgcgactactctgtcttctacttcccg

SEQ ID NO: 368517 - DNA, 518 bp, Homo sapiens
  misc_feature: GZ8MTXP02JLRY6.9.67.G01.1.454.CMB.2.raw
  modified_base (442)..(442): a, c, t, g, unknown or other
  modified_base (508)..(508): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggcctccagggtcctcatctacggtgcgtccagcagggccacgtggtactcccggcaggttcaggtcggtagtgggtctggggacaggagttcgttctcaccatccagcagcctgcagtctgaagtatttgctagtttatactgtcagcactatatagttgaccgtntcgtactttcgggacggtagggaccaaggtcggagcgtacaaacgactgtcggctagcacatcgtntctcattccc

SEQ ID NO: 368518 - DNA, 567 bp, Homo sapiens
  misc_feature: GZ8MTXP02HVGU7.9.67.G01.1.454.CMB.2.raw
  modified_base (375)..(375): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaattagcctggtaccagcagagacctggcttggctccccgagggtcctcatctacggtgcgtcagcagggccacgtggtactcccggctaggttcaggtggtagtggggtctggggacaggtagttccgttntcaccatcagcagcctgcagtctagaagtatttgcttagtttattactgtacagtctaacttaataagttagttcggaccgcttacgtacgtttcgggacggtacggggaaccgaagggtcggagtcgtaaccgaaacgtaacgtggtacggtctcggaacaccgtattctagttccttacgtactttcccg

SEQ ID NO: 368519 - DNA, 587 bp, Homo sapiens
  misc_feature: GZ8MTXP02JA8EX.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggcctcccgagggtcctcatctacggtgcgtccagcgagggccacgtggtactccccggctaggtcaggtcggtagtgggtctggggacaggtagttcgtctcaccatcagcagcctgcagtctagagtatttgcttagtttattactgtacagtctaacgttaattaacgttaggttcggaccgtcgttacgtacgtttcgggacgggtaacgggaccgtaagggttacgggacgtacgtaccgaaaacgtaacgtcggtacgggcttacggaaccgtaccctattcgtacgttccttactactttccccg

SEQ ID NO: 368520 - DNA, 546 bp, Homo sapiens
  misc_feature: GZ8MTXP02HN715.9.67.G01.1.454.CMB.2.raw
  modified_base (513)..(513): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccatggatcccggccaggttcagtggtagtgggtctggggacaggagttcgttctcaccatcagcagcctgcagtctgaagtattttgcttagtttattactgttcagtacattataatagttgcccgtacttcgaacgtttcgggacgggacggggaccgaaaagggtggaggtctaacgaaaacggaaactgtggtcnggaacaccaattctgttccttctaatttccccg

SEQ ID NO: 368521 - DNA, 593 bp, Homo sapiens
  misc_feature: GZ8MTXP02JVU8R.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtctggcaccaacttagcctggtaccagcagagacctggcttggctcccgagggtcctcatctacggtgccgtccagcgacgggccacgtcggtactccccggactaggttcaggtcggtagtggggtctggggacaggtacgttcgtctcgaccatcagcagcctgcagtctagaagtatttgacttagtttattacgtgtacagtactaacttattaagtaggtttcgaccgtccgttcgtaacggtttcgggacggtaaggggtaccgtaagggtacggacgtaccgtaacgaaaaccggacgttaggtcggtcgtacgaaccgacctacttccgtagttccttacgtactttccccg

SEQ ID NO: 368522 - DNA, 590 bp, Homo sapiens
  misc_feature: GZ8MTXP02IAQAP.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagacgacctggcttggcctcccgagggtcctcatctacggtgcgtccagcacgggccacgtggtactccccggctaggttcaggtggtaggtggggtctggggacaggtagtttccgtctcaccgtatcagcagccctgcagtctagaagttattttgcttagtttattacgtgtacagtacctaattaataattaggttcgggccgtcttacgtacgtttcggggacggaggggtaacccgtaagggtggacgtcctaaacgaaaacgtaacgtcggtaggctaggaaccgtaaccagttcttacgttcctttaacgactttccccg

SEQ ID NO: 368523 - DNA, 537 bp, Homo sapiens
  misc_feature: GZ8MTXP02GECM6.9.67.G01.1.454.CMB.2.raw
  modified_base (422)..(422): a, c, t, g, unknown or other
  modified_base (432)..(432): a, c, t, g, unknown or other
  modified_base (456)..(456): a, c, t, g, unknown or other
  modified_base (531)..(531): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctccccgagggtcctcatcacggtgcgtccagcaggggccacgtggtactcccggccaggttcaggtcggtagtggggtctggggacaggtacgttcgtctcaccatccagcagcctgcagtctgaagtattttgcttaagtttnttactgtacngtctactataagtagttagccgtntctacgttcggcgggaggaccgaagggtcggagtctacgaaacgacgtggtacgctgcctacgctctgtccttcncttccc

SEQ ID NO: 368524 - DNA, 515 bp, Homo sapiens
  misc_feature: GZ8MTXP02J2S0N.9.67.G01.1.454.CMB.2.raw
  modified_base (301)..(301): a, c, t, g, unknown or other
  modified_base (359)..(359): a, c, t, g, unknown or other
  modified_base (441)..(441): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtctggcaccaacttagcctggtaccagcagagacctggcttggctcccgagggtcctcatctacggtncgtcagcagggccagtggtactcccggccaggttcagtggtagtggggtctggggacngtagttcgtctcaccatcagcagcctgcagtctagaagtgttttgactagtttattactgttacagcatataatagttgccnctcacgtttcggcggtaggaccgaggtggagcacgaaacacgtgcggctcgcaacctactctcgtctctactcg

SEQ ID NO: 368525 - DNA, 562 bp, Homo sapiens
  misc_feature: GZ8MTXP02ISP6A.9.67.G01.1.454.CMB.2.raw
  modified_base (467)..(467): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggcctcccgagggtcctcatctacggtgcgtccagcgacgggccacgtggtactccccgggctaggttccaggttcggtagtggggtctggggacaggtagttcggttctcaccatcaagcagcctgcagtctagaagtattttgcttagtttaattactgttcagtctaacttataagttaggttcggccnctctacgtttcgggacggtaggggaccaaggggtcggacgtacgtacgaaaacgtacgtggtcgctacgcacgtatctgtcctttcacgtttccc

SEQ ID NO: 368526 - DNA, 534 bp, Homo sapiens
  misc_feature: GZ8MTXP02H001Y.9.67.G01.1.454.CMB.2.raw
  modified_base (204)..(204): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccattgcctggaccagcagagacctggcttggctcccgagggtcctcatcgtacggtgcgtcccaggcagggccagtcggtactcccggctaggttcaggtcggtagtggggtctggggactaggtacgtttcgttctcacctatccagcacgcctgcagtcagagtatttgactagtttattactgtcagtactatataagtagttcggcgactctacgttcgggacggaggaccgaaggtggagcgtacaaacgtactcggagctacgcaccgatctcgtctcacttcccg

SEQ ID NO: 368527 - DNA, 516 bp, Homo sapiens
  misc_feature: GZ8MTXP02IPE50.9.67.G01.1.454.CMB.2.raw
  modified_base (301)..(301): a, c, t, g, unknown or other
  modified_base (436)..(436): a, c, t, g, unknown or other
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcacaacttagcctggtaccagcagagacctggcttggctccccagggtccctcatctacggtncgtccagcagggccactggtactccccggcaggttcaggtggtagtgggtctggggacaggagttcgtctcaccatcagcagcctgcagtctgaagatttgctagtttatactgtcagcactataatgttgccgntcgactttcggcggtagggaccaaagggtcggaggctcgaaaacgaactgtggcctgcaccatcctgtccttcacttccg

SEQ ID NO: 368528 - DNA, 511 bp, Homo sapiens
  misc_feature: GZ8MTXP02GI7IN.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtcagcagggccacggtatcccggcaggtcagtggtagtgggtctgggacagagttcgtctcacatcagcagcctgcagtctagaagtatttgctagtttatactgtcagcactataatagttggaccgctcacgtttcggcggagggaccaaggtggagctacaaaacgaactgtaggctgacaaccatctagtctctactcttcccg

SEQ ID NO: 368529 - DNA, 566 bp, Homo sapiens
  misc_feature: GZ8MTXP02I6X1D.9.67.G01.1.454.CMB.2.raw
  modified_base (377)..(377): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaacagccactctcacctgcagggccagtcagagtcttggcaccaacttagcctggtaccagcagagacctggcttggctccccgagggtcctcgatcgtacggtgcgtccaggcagggccacgtggactcccggcaggttcaggtcggtagtggggtctggggacaggagttcgttcncaccatccagcagcctgctagtctgaagtattttgcttagtttattactgtacctagctaacgttataattaggttgcccgtcgttctacgtttcgggcgacggggaccaaggggtcgacggacctacgaaaacgtacgtggtacgtcgtacgccgtacctacgttccgtagtcctttacactttcccg

SEQ ID NO: 368530 - DNA, 557 bp, Homo sapiens
  misc_feature: GZ8MTXP02HKXDA.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatctacggtgcgtccagcgagggccagtggactcccggcaggttcaggtggtagtgggtctggggacaggtgttcgttctcaccatcagcagcctgcagtctagtaagtatttgctagtttatacgtgtacagtactacttaataagttaggttcggccgtctctacgtttcgggacgggtacgggacgaagggtcggacgctaacgaaacggtacgtggtacggtctcggcctaccgtactcgtcgttccttactactttcccg

SEQ ID NO: 368531 - DNA, 530 bp, Homo sapiens
  misc_feature: GZ8MTXP02JLQYA.9.67.G01.1.454.CMB.2.raw
  modified_base (399)..(399): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccacgtggtactcccggcaggttcaggtcggtagtgggtctggggacagagttcgtctcaccatcagcagcctgcagtctgaagtntttgctagtttatactgtcagcactataatagttgaccgtctctacgtttcggcggtagggaccaagggttcgagtctacgaaacgtaacgtgtacggctcggcaccactctacgtcttactactttcccg

SEQ ID NO: 368532 - DNA, 541 bp, Homo sapiens
  misc_feature: GZ8MTXP02JLZNI.9.67.G01.1.454.CMB.2.raw
  modified_base (375)..(375): a, c, t, g, unknown or other
  modified_base (447)..(447): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagccctggtacccagcagagacctggcttggctccccgagggtcctcatctacggtgcgtccagcagggccacgtggtactccccggcaggttcagtgggtagtgggtctgggacagagttcgttcncgaccatcagcagcctgcagtctgaagtatttgctagtttatactgtacagtcactataagtagttgccgtntccgtacgtttcggacggtagggtaccaaagggtggagctacgaaacggtaacgtggtcggactgaacgtaccatccgtgttcttacatttccc

SEQ ID NO: 368533 - DNA, 632 bp, Homo sapiens
  misc_feature: GZ8MTXP02HT4G5.9.67.G01.1.454.CMB.2.raw
  modified_base (399)..(399): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatctacggtgcgtccagcagggccacgtggtactcccggctaggtcaggtcggtagtggggtctggggacaggtagttcgttctcacctatcagcagcctgcagtcngtaagtatttgcttagtttatactgtacagtctaacttaataagttaggttacggcccgtcttacgtaaccgtttcggggaccgggtaacggggtaacccgtaaaggggttacggaacggtaccgttaaaccggaaaaccggttaaaaccgttcgggtacggggtaccttacgggaacccgtaacccgtaactttaccgttcggtttaccctttaccgttaacgtttcccccg

SEQ ID NO: 368534 - DNA, 509 bp, Homo sapiens
  misc_feature: GZ8MTXP02FHNNK.9.67.G01.1.454.CMB.2.raw
  modified_base (291)..(291): a, c, t, g, unknown or other
  modified_base (394)..(394): a, c, t, g, unknown or other
  modified_base (432)..(432): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctnatctacggtgcgtccagcagggccactggtactcccggcaggttcagtggtagtgggtctgggacagagttcgtctcacatcagcagcctgcagtctgaagtntttgctagtttatactgtcagcactataatagtgccgntctacgttcggcgaggaccaaggtcgagctacgaaaacgacgtgtacggctggcaccgatcctgtccttcacttccc

SEQ ID NO: 368535 - DNA, 631 bp, Homo sapiens
  misc_feature: GZ8MTXP02GLMP2.9.67.G01.1.454.CMB.2.raw
  modified_base (302)..(302): a, c, t, g, unknown or other
  modified_base (380)..(380): a, c, t, g, unknown or other
  modified_base (402)..(402): a, c, t, g, unknown or other
  modified_base (408)..(408): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggcctcccgaggtcctcatctacggtncgtccagcgagggccacgtggtactccccggactaggttcaggtcgggtagtgggtctggggacaggtagttcgttcncaccatcagcagcctgcagtcngaagtntttgctagtttatactgtacagtactaacttataaagttcggttacggcccgtcttaccggttaaccgtttccgggggacgggtaacgggggtaaacccgtaagggggttacgggaacgtaccgtaaaccgtaaaaaccggtaaccgttgggttacgggccgttacggaaccctaaacccggttacgttaccgttacgtttacctttaccgtacgtttccccg

SEQ ID NO: 368536 - DNA, 604 bp, Homo sapiens
  misc_feature: GZ8MTXP02GSBZ8.9.67.G01.1.454.CMB.2.raw
  modified_base (375)..(375): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtacccagcagagacctggcttggcttccgagggtcctcatctacggtgcgtccagcagggccacgtggtactccccggcaggtcagtggtagtgggtctggggacaggtagttccgttcncaccatccagcagcctgcagtctagagtatttgactagtttattactgttcagctactaattaagttagttcggacccgtcgttctaacgttttcggggccgggtaacgggggtaaacccgaaaggggttcgggacgtaccgttaaccgaaaaccggtaaacgttgggtacgggtacttcggccctaaaccgtacttccgttcggttacctttccgtaactttcccccg

SEQ ID NO: 368537 - DNA, 603 bp, Homo sapiens
  misc_feature: GZ8MTXP02HU0AM.9.67.G01.1.454.CMB.2.raw
  modified_base (232)..(232): a, c, t, g, unknown or other
  modified_base (292)..(292): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagngtcttggcaccaacttagcctggtaccagcagagacctggcttggcctcccgaggtcctnatctacggtgccgtcagcagggccagtggtactcccggctaggtcaggttcggtagtgggtctaggggacaggtagttcgttctcaccatcagtcagcctgctagtctagtaaacgttagttttcgacttagtttattacctgtacagtactaacttaataaagttacgggttcggacccgtcttaccgtaccggtttcgggacgggaaacggggtaccgaaaaggggttcggaacgtacgtaaccgaaaacggtaactgggtcgtacgtacggaaccaccgtattaccgtgttccttactactttccccg

SEQ ID NO: 368538 - DNA, 561 bp, Homo sapiens
  misc_feature: GZ8MTXP02JTANN.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggcctcccgagggtcctcatctacgggtgccgtccagcgagggccacgtggtactcccggcaggtcaggtggtagtgggtctggggacaggtgttcgttctcaccatcagcagcctgcagtctagtaagtatttgacttagtttattacgtgtacagtactaacgttaataagttaggttcgccgtctccgtacgtttcgggacgggtacgggaccgaagggtcggagactacgaaacgacgtggtacggcgtacgccaccgtactctgtccttactactttcccg

SEQ ID NO: 368539 - DNA, 531 bp, Homo sapiens
  misc_feature: GZ8MTXP02I7T3W.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctccccagggtcctcatctacggtgcgtccagcagggccacgtggtactccccggcaggttcaggtggtagtggggtctggggacaggagtttcgtctcaccatcagcagcctgcagtctgaagtatttgctagtttatactgtcagctacgttataatagtttggccgctcgtacgtttcgggacggtaagggaccgaagggttcggagctacgaaacgtactgtcggctgcacatctgtcttcacgtttccc

SEQ ID NO: 368540 - DNA, 545 bp, Homo sapiens
  misc_feature: GZ8MTXP02GIZ4H.9.67.G01.1.454.CMB.2.raw
  modified_base (303)..(303): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggacaaacagccactctcacctgcagggccagtcagagtcttggcaccaacttagcctggtaccagcagagacctggcttggctccccgagggtcctcatctacggtncgtcagcagggccacgtggtactcccggcaggtcagtcggtagtgggtctggggacaggtagttcgttctcaccgatcgagcacgcctgcagtctagaagtatttgctagtttattactgtacagactacttataataggttcgaccgtctacgtacgtttcggcggtagggacctaagggtggacgtctacgaaacgtacgtggtacgctgccgactacttcgtcgtcttacactttcccg

SEQ ID NO: 368541 - DNA, 546 bp, Homo sapiens
  misc_feature: GZ8MTXP02GU8AK.9.67.G01.1.454.CMB.2.raw
  modified_base (204)..(204): a, c, t, g, unknown or other
  modified_base (373)..(373): a, c, t, g, unknown or other
  modified_base (400)..(400): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtctggcaccaacttagcctggtaccagcagagacctggcttggcctccccgagggtcctcatctacggtgcgtccagcagggccacgtggtactcccggcaggtcaggtcggtagtgggtctgggacaggtagttcgtcncacatcagcagcctgcagtctgaagtntttgctagtttatactgtcagtcactatatagtgccgtactctacgtttcggcggtacgggaccgaagggtggacgctaacaaacggtacgtaggtcggtctacggaacctaccgacttccgttcggttccttcctactttccccg

SEQ ID NO: 368542 - DNA, 511 bp, Homo sapiens
  misc_feature: GZ8MTXP02FE97I.9.67.G01.1.454.CMB.2.raw
  modified_base (368)..(368): a, c, t, g, unknown or other
tcagtgatacgtctcacgaccggtgctcgatttagagtatacatattgggttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccaccctcacctgcagggccagtcagagtcttggcaccaacttagcctggtaccagcagagacctggcttggctcccagggtccctcatctacggtgcgtccagcagggccactggatcccggccaggtcaggtggtagtggggtctggggacagagttcgttcncaccatcagcagccctgcagtctgaagattttgcagtttattactgtcagcactataatagttggccgctcactttcggcggagggaccaaggtggagctcaaacgaactgtggctgcaaccatctgtcttcactcttccccg

SEQ ID NO: 368543 - DNA, 578 bp, Homo sapiens
  misc_feature: GZ8MTXP02I2BDE.9.67.G01.1.454.CMB.2.raw
  modified_base (402)..(402): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacccgcagggccagtcagagtcttggcaccaattagcctggtaccagcagagacctggcttggctcccgagggtcctcatctacggtgcgtccagcagggccacgtggtactcccggcaggttcaggtggtagtgggtctggggactagtacgttcgtctcaccatcagcagcctgcagtctagaagtntttgctagtttattactgtcagtctaacttaattaataggttcggcccgtctcgtcgtttcgggacgggtacgggtaccaaaggggttcggacgacgttaacgaaaacggtaactcggtcggacgttcggacctaaccgtattccgttagttccttactactttcccgtttccccg

SEQ ID NO: 368544 - DNA, 555 bp, Homo sapiens
  misc_feature: GZ8MTXP02JL9PP.9.67.G01.1.454.CMB.2.raw
  modified_base (430)..(430): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggctggctcccgagggtcctcatctacggtgcgtccagcaggggccacgtggtactccccggcaggttcaggtggtagtggggtctggggacaggtagttcgtctcgaccatcagcagcctgcagtctagaagtattttgacttaagtttattactgtanagtactaactaataattaggttacgccgtactcgtacgtttcgggcgggtaagggaccgaagggtcggacgactaacgaaaacgacgtggtacggctgaacaccgattctgtccttcacttcccg

SEQ ID NO: 368545 - DNA, 565 bp, Homo sapiens
  misc_feature: GZ8MTXP02HKWYQ.9.67.G01.1.454.CMB.2.raw
  modified_base (402)..(402): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttgcctggtaccagcagagacctggcttggctcccagggtcctcatctacggtgcgtcagcagggccactggtactcccggctaggtcaggtcggtagtgggtctggggacaggtagttccgttctcaccatcgagcagcctgcagtcgagaagtntttgctagtttatactgtacagtacacttataagtagttcggcctctctacgtttcgggacgggtacgggaccgtaagggtcggacgtacgtacgaaaacggtaactcgggtcgtctacggaaccctactacgttctcggtttccttacctacgtttcccccg

SEQ ID NO: 368546 - DNA, 542 bp, Homo sapiens
  misc_feature: GZ8MTXP02H7385.9.67.G01.1.454.CMB.2.raw
  modified_base (529)..(529): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccacttagcctggtaccagcagagacctggcttggctcccgaggtcctcatctacggtgccgtccagcagggccacgtggtactcccggcaggtcaggtggtagtgggtctggggacaggtgttcgtctcgaccatcagcagcctgcagtctagaagttatttgactagtttattactgtacagtcaattataacgttagtcgaccgtctcgtacgtttcgggacggtacgggaccgaagggtggagactacgaaacgtaacgtgacggtctggaactaccgatcgtntcttctacttccc

SEQ ID NO: 368547 - DNA, 615 bp, Homo sapiens
  misc_feature: GZ8MTXP02F9MKR.9.67.G01.1.454.CMB.2.raw
  modified_base (332)..(332): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggcctcccgagggtcctcatcgtacggtgccgtccaggcgaggggccacgtggtacnccccggcaggttcaggttcggtagtgggtctggggacaggtacgtttcgtctcaccatcagcagcctgcagtctagaagtattttcgacttagtttattacgtgtacacgtctacttaataagttaggttcggccctcgtacgtacgtttcgggggaccgggtaagggacccgtaaagggtcgggaacgaccgttaacgaaaaacgggtaaccttgggtaccgggcttacggaaccgtaaaccccgttacgttccgttcgttacctttaccgtacctttcccg

SEQ ID NO: 368548 - DNA, 581 bp, Homo sapiens
  misc_feature: GZ8MTXP02G6BS8.9.67.G01.1.454.CMB.2.raw
  modified_base (359)..(359): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtctggcacaacttagcctggtaccagcagacgacctggcttggcctcccgagggtcctcatctacggtgcgtccagcacggggccacgtggtactccccggccaggttcaggtcggtagtgggtcnggggacaggtcgttcgtctcaccatcagcagcctgctagtctagtaagtatttgacttagtttattacgtagtacagtactactataagttacggtcggtccgtcgtacgtacgtttcgggacggggtacgggaaccgtaagggtcggacgacgtaacgaaaacggtaacgtcggtacggcgtcggaaccgacctacgttctacgtcctttcgactttcccg

SEQ ID NO: 368549 - DNA, 602 bp, Homo sapiens
  misc_feature: GZ8MTXP02IFQHF.9.67.G01.1.454.CMB.2.raw
  modified_base (204)..(204): a, c, t, g, unknown or other
  modified_base (304)..(304): a, c, t, g, unknown or other
  modified_base (327)..(327): a, c, t, g, unknown or other
  modified_base (356)..(356): a, c, t, g, unknown or other
  modified_base (405)..(405): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaacttacgcctggtaccagcagagacctggcttggcctcccgagggtcctcatctacggtncgtccagcagggccagtggtacncccggcaggttcaggtcggtagtgggtcnggggacaggacgtttcgtctcacctatcagcagcctgctagctagaatntttgctagtttatactgtacagtcctaattaagttaacttagggttcggacccgtacttacgttaaccggtttcggggaccggaaggggtacccgtaaaaggggttcggacgtaccgtaaccgaaaaaccggtaacttcgggtaggtcctaggcccgaaaccttacgttccgtacgtttaccttactaccgttcccg

SEQ ID NO: 368550 - DNA, 530 bp, Homo sapiens
  misc_feature: GZ8MTXP02HYDDZ.9.67.G01.1.454.CMB.2.raw
  modified_base (377)..(377): a, c, t, g, unknown or other
  modified_base (467)..(467): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatctacggtgcgtccagcagggccacgtggtactccccggctaggtcaggtcggtagtgggtctggggacaggtacgttcgttcnctaccatcagcagccctgccagtctgaagtattttgctagtttattactgtcagctacttataatagttgccgtctcgtacgtttcgggnggagggacaagggtgagactacaaacgtacgtgtacggcttgcaactctctgtctctactccg

SEQ ID NO: 368551 - DNA, 560 bp, Homo sapiens
  misc_feature: GZ8MTXP02HTB30.9.67.G01.1.454.CMB.2.raw
  modified_base (302)..(302): a, c, t, g, unknown or other
  modified_base (374)..(374): a, c, t, g, unknown or other
  modified_base (380)..(380): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatctacggtncgtccagcagggccagtggtactcccggctaggtcaggtcggtagtgggtctggggacaggtagttcgttcncaccgntcagcagcctgcagtctgaagtatttgacttagtttatactgtactagctaacttaataagttaggttcgccgtctacgtacgtttcgggacgggtacgggaccgaagggtcggacgctaacgaaaacgtaacgtggtacgctggaacctaccgtattctgttccttactactttccccg

SEQ ID NO: 368552 - DNA, 606 bp, Homo sapiens
  misc_feature: GZ8MTXP02H5PB3.9.67.G01.1.454.CMB.2.raw
  modified_base (588)..(588): a, c, t, g, unknown or other
tcagtgatacgtctcacgaccggtgctcgatttagagtatacatattgggtttggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaactacgccgtggtaccagcagacgacctggcttggcctcccgagggtcctcatcgtacggtgcgtccgagcgacgggccagtggtactcccggctaggttcaggtcggtaggtcggggtcgtggggactaggtacgtttcgttccgttacacctattccgaacgcacgcccgtgctagtctagaagttacgttttgacttaagttttacttacttgtacgtagtacctaacgtttaataagttaggttacgggcctacgtccttacggtttcggggcggtaagggaccgaagggtggaacgtccgaacgaaacggtactggtacgctacggcctacacgttcgtntccttacgtctttacccg

SEQ ID NO: 368553 - DNA, 593 bp, Homo sapiens
  misc_feature: GZ8MTXP02JXNXH.9.67.G01.1.454.CMB.2.raw
  modified_base (203)..(203): a, c, t, g, unknown or other
  modified_base (377)..(377): a, c, t, g, unknown or other
  modified_base (405)..(405): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaaacngccactctcacctgcagggccagtcagagtcttggcaccaacttagcctggtaccagcagagacctggcttggcctcccgagggtcctcatctacggtgcgtccagcgagggccagtggtactcccggcagggttcaggtcggtagtggggtctggggacaggtagttcgttcncacatcagcagcctgccagtctagagtntttgctagtttactactgtacagctaacttagtaaagttcggttcggaccgtcttcgtaacggtttccgggacgggtacgggaaccgtaaaggggttcggaagtccgtaacgaaaaccgtacgttacggtcggaaccgttcggaacctaccgtacgtccgttacgttcctttaactcgtttacccccg

SEQ ID NO: 368554 - DNA, 629 bp, Homo sapiens
  misc_feature: GZ8MTXP02I10NB.9.67.G01.1.454.CMB.2.raw
  modified_base (363)..(363): a, c, t, g, unknown or other
  modified_base (457)..(457): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatctacggtgcgtcagcagggccactggtactcccggcaggttcaggtcggtagtgggtctggggacaggngttcgtctcaccatcagcacgcctgcagtctagtaagtattttgcttagtttacttacgtgtctagctaacttattaagtacggttaggcccgngttacctaccggttttcgggaccggggttaacggggaacccgtaaaaggggttcggggaacgtaccgttaacggaaaaaccggtaacgttacggggtacgggtaccgttacggccctaaacccggaactttaccgttacggtttccctttaccgtaacccgtttttcccccg

SEQ ID NO: 368555 - DNA, 601 bp, Homo sapiens
  misc_feature: GZ8MTXP02GB37H.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccgagggtcctcatctacggtgcgtccagcgagggccacgtggtactcccggccaggttcaggtcggtagtgggtctgggacaggtagttcgtctcaccatcagcagcctgcagtctgaagtatttgcttagtttattactgttcagtcaacttaataacgttaggttcggacccgtcttacgtaccgtttcggggccggtaaggggacccgaaaggggttggacggtacgttaaaccgaaaacggtaaccgttgggtaacggtccgttaggaaccgtaacccgtaattcccgttagtttccctttactaccgtttccccg

SEQ ID NO: 368556 - DNA, 585 bp, Homo sapiens
  misc_feature: GZ8MTXP02JH5EZ.9.67.G01.1.454.CMB.2.raw
  modified_base (264)..(264): a, c, t, g, unknown or other
  modified_base (302)..(302): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaacagccactctcacctgcagggccagtcagagtcttggcaccaacttagcctggtaccagcagngacctggcttggcctcccgagggtcctcatctacggtncgtcagcagggccacgtggtactcccggcaggttcagtggtagtgggtctggggacaggtacgtttcggttctcgaccgatccaggtcaggccctgctagtctgaagtatttgacttagtttatactgtacagtctaactataagtaggttacgccgtctacgtacgtttcgggccgggtaacgggaccgaaaggggtcggacgtcgtaacgaaacggtaaaccgtggtacggtctacggaacctaccgtaacgttctcggttacctttccacgtttcccccg

SEQ ID NO: 368557 - DNA, 564 bp, Homo sapiens
  misc_feature: GZ8MTXP02IUJFX.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtacccagcagagacctggcttggctcccgagggtcctcgatctacggtgcgtccagcagggccacgtggtactcccggcaggtcaggtcggtagtgggtctggggacaggtgttcgttctcacctatcagcagcctgcagtctagtaagtattttgacttagtttacttactgtacagtctaacttaataagtaggttgacccgtcttctacgtttcgggcggtaacgggaccgaagggtcggacgtcgtaacgaaacgtaacgtggtacggcgtacgccaaccgtatctgttccttactactttcccg

SEQ ID NO: 368558 - DNA, 551 bp, Homo sapiens
  misc_feature: GZ8MTXP02GNBQN.9.67.G01.1.454.CMB.2.raw
  modified_base (404)..(404): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctacagggccagtcagagtcttggcaccaacttagcctggtaccagcagagacctggcttggctcccgagggtcctcatctacggtgcgtccagcagggccacgtgggtactcccggcaggttcaggtggtacgtgggtctggggactaggagttcgtctcacatcagcagccctgcagtctagaagtntttgcttagtttattacgtgtcagctacttataatggttcggaccgtctcgtacgtttcgggacggacgggaccgaagggtggacgtacgtacgaaacgtaacgtggtcgactcgacaacctagtctcgtcttcacttccttccccg

SEQ ID NO: 368559 - DNA, 507 bp, Homo sapiens
  misc_feature: GZ8MTXP02FV9VV.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaattagcctggtaccagcagagacctggcttggctcccagggtcctcatctacggtgcgtccagcagggccacgtggtactcccggccaggttcaggtggtagtgggtctggggacagagttcgtctcaccatcagcagcctgcagtctgaagtatttgctagtttattactgtcagcactataatagttgccgctcacgtttcggcggagggacgaaggtggagctacgaaacgaactgtgctgcacactctgtctcacttcc

SEQ ID NO: 368560 - DNA, 559 bp, Homo sapiens
  misc_feature: GZ8MTXP02GN8Z7.9.67.G01.1.454.CMB.2.raw
  modified_base (204)..(204): a, c, t, g, unknown or other
  modified_base (407)..(407): a, c, t, g, unknown or other
  modified_base (460)..(460): a, c, t, g, unknown or other
  modified_base (552)..(552): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaattagccctggtaccagcagagacctggcttggcctacccgagggtcctcatcctacggtgcgtccagcacggggccacgtggtactcccggcaggttcaggttggtagtgggtctggggactaggtacgtttcgtctcaaccgatcgagcagcctgcagtcngaatatttgctagtttatactgtacagactattataaagtggtttcgcccgtntaccgtacgtttcggggacggtagggaccgaaaggggttggaacgtcgtacgaaaacgtacgtggtacggctaggcaccgatctgtcttacncttcccg

SEQ ID NO: 368561 - DNA, 668 bp, Homo sapiens
  misc_feature: GZ8MTXP02GN4O3.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccggataccactggaataatagtgatgacgcagtctccagccaccctgtctgtgtttccaggagaaacagccactctcacctgcagggccagtcagagtctggcacatagcctggtaccagcagagactggctggcctcccgagggtcctcatcgtacggtgccgtccaggcgacgggccacgtgggtacgtccccgggctaggtcaggtcggtaggtggggtcgtaggggactaggtacgtttcgttccgtccaaccgtataccgacgcacggtcctcgactacggttctaaggtaaagttagtttttacgacctttaaggttttactttacgtacgttacgtaacgtacctaaacttaagttaaagttaacgggtttcgggacccgttaccgttcgttaaccggttttcgggggaaccgggtacggggtaacccgtaaggggtacggacgtaccgtaaacgaaacggtacgttaggtacggtactcgaccaactacgttcgtacgttcctactacctttcccgttaccccg

SEQ ID NO: 368562 - DNA, 632 bp, Homo sapiens
  misc_feature: GZ8MTXP02IWTYQ.9.67.G01.1.454.CMB.2.raw
  modified_base (204)..(204): a, c, t, g, unknown or other
  modified_base (232)..(232): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagngtcttggcaccaacttagcctggtaccagcagagacctggcttggcctcccgagggtcctcatctacggtgcgtccagcgaggggccagtggtactccccggctaggttcaggtcggtagtgggtctggggactaggtagttcgtctcaccatcagcagtcctgcagtctagtaagtagttttgacttagtttattacgtgtactagtactaacttattaagttaggttcggacccgtcttaccgtacggtttcggggacgggtaacggggtaacccgtaagggggttacggacggtaccgttaaaccggaaaaccggtaacgttcgggtacgggtaccgttacgggaaccctaaccgtaacgttccgttacggtttcctttaccgttactttcccccgg

SEQ ID NO: 368563 - DNA, 625 bp, Homo sapiens
  misc_feature: GZ8MTXP02GZEA4.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtctggcaccaacttgcctggaccagcagagcctggcttggcctcccgagggtccctcatccgtacggtcgcgtccagcaggggccacgtggtactccccggctaggtcaggtgggtaggtgggtctggggactaggtacgtttccgttctaccgacctagtccgaagtccagccctgcgtagtcgtagaagttagttttcgacttagtttattacgtgtacagtactacttaataagttaggttcgacccgtcgttaccgtacgtttcggggacgggtaacggggtaaccgtaaaggggttcgggaacggtaccgtaaaccgaaacggtaaacgttcggtacggtcctacggaaccgtactacgttccgtgttcccttacctactttccccg

SEQ ID NO: 368564 - DNA, 630 bp, Homo sapiens
  misc_feature: GZ8MTXP02FV15X.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcgagggccagtcagagtctggcacctaacttagcctaggtaccagcagagacctggcgttcggcctccccgagggtccctcgatcgtacggtgccgtcagcgagggcccagtggtacgtcccggcctaggttcgagtggtagtgggcgtggacaggtgttcgtctcaccatcagcacgccgtgctagtctaggtaagttatttgtacttagtttattacgtgtactagactaacttaattaagttacggttcgggtcccgtccttacggttaccgtttcggggaaccggggtaacggggaacccggtaaagggtacggtacggaccgttaaacggaaaaccgttacgttacgggtcggtacgtaggaacccgtacgtactttcgtcgtttaaccttccgtaactttcccccg

SEQ ID NO: 368565 - DNA, 508 bp, Homo sapiens
  misc_feature: GZ8MTXP02HQFVU.9.67.G01.1.454.CMB.2.raw
  modified_base (366)..(366): a, c, t, g, unknown or other
  modified_base (383)..(383): a, c, t, g, unknown or other
  modified_base (387)..(387): a, c, t, g, unknown or other
  modified_base (398)..(398): a, c, t, g, unknown or other
  modified_base (465)..(465): a, c, t, g, unknown or other
  modified_base (485)..(486): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctacctctggctcccagataccactggaataatagtgatgacgcagtctccagccaccctgtctgtgtttccagggagaaacagccactctccacccgcagggccagtcagagtctggcacattagcctggtaccagcagagacctggctggcctcccgaggtcctcatcgtacgtgcgtcagcaggccatggtactccggctaggttcaggtggtagtgggtctgggacagtgttcttcgtnaccatcagcagcctgcngtcngagtattttgnttatttatactgtacatctatataatcgttgcgctcgtcgttagggcggaggacgaaggtggaacgngtacaaacggtattggcgcnncaacactctctctctcttctcc

SEQ ID NO: 368566 - DNA, 533 bp, Homo sapiens
  misc_feature: GZ8MTXP02GCMT6.9.67.G01.1.454.CMB.2.raw
  modified_base (426)..(426): a, c, t, g, unknown or other
  modified_base (452)..(452): a, c, t, g, unknown or other
  modified_base (514)..(514): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtctggcaccaacttagcctggtaccagcagagacctggcttggcctcccgagggtcctcatcgtacggtgcgtccagcacgggccagtggtactcccggcaggttcagtggtagtgggtctgggacaggtagttcgtctacaccgatcagcagcctgcagtcagaagtatttgacttagtttatactgtacanactaattataataggttcggaccctntcgtacgttcggacggtagggaccaagggtcgacgactaccgaaagacgtgacggctgaacnctatctgtctcacttcccg

SEQ ID NO: 368567 - DNA, 562 bp, Homo sapiens
  misc_feature: GZ8MTXP02GMYF3.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggaccagcagagacctggcttggcctcccgagggtccctcatcgtacggtgccgtccagcgagggccacgtggtactccccggcaggttcaggtggtagtgggtctggggacaggtagttcgttcacaccgtatcagcacgcctgcagtctagaagtgtttgcttagtttatactgtcagtctaattataattaggttcgccgtcgtacgtacgtttcgggacgggacgggtaccgaagggtcggacgactacgaaaacgtacgtacggcgcgtacgccacgtacttcgttgtccttacgtacttcccg

SEQ ID NO: 368568 - DNA, 603 bp, Homo sapiens
  misc_feature: GZ8MTXP02GN9IO.9.67.G01.1.454.CMB.2.raw
  modified_base (203)..(203): a, c, t, g, unknown or other
  modified_base (385)..(385): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaaacngccactctcacctgcagggccagtcagagtcttggcaccaacttagcctggtaccagcagagcctggcttggcctcccgaggtcctcatcgtacggtgccgtccagcgagggccacgtggtactccccggctaggttcaggtcgggtaggtggggtctggggactaggtacgtttccgttcnccaccgtatccaaggcacggcctgcgtagtctaggtaagttatttgacttagttttacttactgtactagctaacttagtaagttaggttcgaccgtacttcgtacggtttcgggaccgggacggtaccgtaagggtggacgtacttaacggaaaccgtacgtcggtacgtccgtaggcctaaccgtattccgtcggttccttaccgtactttccccg

SEQ ID NO: 368569 - DNA, 563 bp, Homo sapiens
  misc_feature: GZ8MTXP02F7V2K.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacccgcagggccagtcagagtcttggcaccaattagcctggtaccagcagagacctggcttggcctcccgagggtcctcatcgtacggtgcgtccagcagggccacgtggtactcccggctaggttcaggtggtacgtgggtctggggacaggtagttcgtctcaccatccagcagcctgcagtctagaagtatttgcttagtttattactgtcagcaatataagtagttacgccgtctcgtcgtttcgggcggagggaccgaaaggtgggaacgtacgtacgaaaacggtaacgtggtacggacgtcggacaaccgtactccgttcgtccttactactttccttccccg

SEQ ID NO: 368570 - DNA, 568 bp, Homo sapiens
  misc_feature: GZ8MTXP02H9JXI.9.67.G01.1.454.CMB.2.raw
  modified_base (303)..(303): a, c, t, g, unknown or other
  modified_base (327)..(327): a, c, t, g, unknown or other
  modified_base (375)..(375): a, c, t, g, unknown or other
  modified_base (422)..(422): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggaccagcagagacctggcttggcctccgagggtcctcgatctacgggtncgtccagcgagggccagtggtacncccggctaggttcaggtcggtagtggtctggggacaggaggttccttntacacctatcacgcacgccctggactacgtctaggaagtattttggnttaagttattactgacgagtcaattataaaattacggttcgccgcttacgtaccgtttgggaccggagggtaccgaaagggtggacgtcacaaaacggtactagtcggctaggcctaacgactctacgttccttcactttccccgg

SEQ ID NO: 368571 - DNA, 640 bp, Homo sapiens
  misc_feature: GZ8MTXP02IMW7K.9.67.G01.1.454.CMB.2.raw
  modified_base (203)..(203): a, c, t, g, unknown or other
  modified_base (294)..(294): a, c, t, g, unknown or other
  modified_base (331)..(331): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaaacngccactctcacctgcgagggccagtcagagtcttggcaccaacttagcctaggtaccagcagacgaccgtggcttggcctcccgaggtccncatctaggtgccgtcagcgagggccctacgtggtacncccggactggttacacggttggtaggttcgggtcgtaggggacctaggttacgtttccggttctaccgaccctagtccgagccgtacgtcctgccgtagtacgtagttaaagttgttttagtactttaagtttacgtttacgtaggtactagtacttaacttaagttaacgttaggttacggccgtcttacgtacgtttcgggacgggtacggaacgtaagggtaggacgtacgtaacgtaaaacgacggtacggtacggcgtacgtaacgtaccctacgttacgttacgttcttactacctttccccg

SEQ ID NO: 368572 - DNA, 625 bp, Homo sapiens
  misc_feature: GZ8MTXP02HN9XL.9.67.G01.1.454.CMB.2.raw
  modified_base (204)..(204): a, c, t, g, unknown or other
tcagtgatacgtctcacgaccggtgctcgatttagagtatacatattggggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaaacngccactctcacctgcagggccagtcagagtctggcaccaacttagcctggaccagcagagacctggcttggcctccgagggtcctcatcgtacggtgcgtccagcgagggccagtggactcccggctaggttcaggtcggtagtgggtctggggacaggtagttccgtctcaccatcaggcacgcctgcagtcgtagtaagttatttgactttaagtttatacgttacgttacgagtacctaaatttaagttaaagttagggttcggcccgtcttaccggtaccggtttcgggggaccgggtaacggggtaacccgtaaggggttacggaacgtaccgtaaacgaaaaccggtacgtcgggtacgtccgtacggaaccgaaaccttacgtcccgttgttaccctttacgtacctttccccg

SEQ ID NO: 368573 - DNA, 628 bp, Homo sapiens
  misc_feature: GZ8MTXP02JIG4A.9.67.G01.1.454.CMB.2.raw
  modified_base (204)..(204): a, c, t, g, unknown or other
  modified_base (260)..(260): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtcttggcaccaacttagcctggtaccngcagagacctggcttggcctcccgagggtccctcagtctacggtgcgtccagccgagggccacgtggtactccccggctaggttcaggtcgggtagtggggtctggggactaggtacgtttccgttctccgaacctatccgaggccacgccctgacctagtctagtaagttattttagtaaagttttatacttagtactaagtacctaaattaacttaagttacggttcgggtacccgtcgttaccgtaaccggtttcggggacgggtacgggtaaccgtaaaggggtcggaacgtacgtacgaaaacggtacgtggtacgacgtcgaccaactacgttctcgtccttacgtaccttccgttaccccg

SEQ ID NO: 368574 - DNA, 591 bp, Homo sapiens
  misc_feature: GZ8MTXP02HBCTM.9.67.G01.1.454.CMB.2.raw
  modified_base (204)..(204): a, c, t, g, unknown or other
  modified_base (288)..(288): a, c, t, g, unknown or other
  modified_base (299)..(299): a, c, t, g, unknown or other
  modified_base (358)..(358): a, c, t, g, unknown or other
  modified_base (434)..(434): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcagggccagtcagagtctggcacaacttgcctggtaccagcagagacctggcttggctcccgaggtcctnatctacgggtncgtccagcgacgggccacgtggtacgtccccggcgtaggtcaggtgggtagtggggtcnggggacaggtacgttcgtctcgactatccagccagcctgcctagtctagaagtatttgacttaagtttatacgttntacagtacctaattagtagttaggttcggcccgttcttacgttacggttcgggacgggtaacgggtaacgtagggtacggacgtacgtaaaccgtaaacggtacgtcgtacggctacgaaccgtacgtacgttcgtcgtttcttacctaccttcccg

SEQ ID NO: 368575 - DNA, 545 bp, Homo sapiens
  misc_feature: GZ8MTXP02HLZIF.9.67.G01.1.454.CMB.2.raw
  modified_base (263)..(263): a, c, t, g, unknown or other
  modified_base (327)..(327): a, c, t, g, unknown or other
  modified_base (403)..(403): a, c, t, g, unknown or other
  modified_base (519)..(519): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaaacagccaccctcacctgcagggccagtcagagtcttggcacaacttagcctggtaccagcagngacctggcttggcctcccgagggtcctcatcgtacggtgccgtccagcgaggccacgtggtacncccggcaggttcaggtcggagtgggtcgtgggactagagtttcgtctcgacatcagtcacgctgcagtctagagtntttgctagtttatactgtcagctataatagtagtcgcgtctctacgttcggcgggacgggacgtaaaggtcgggacgcgtaaacgaaacggtaacgtgtcgacgtcgacaaccgtntacgtcgtcttccgtacttccgtccg

SEQ ID NO: 368576 - DNA, 554 bp, Homo sapiens
  misc_feature: GZ8MTXP02HDE29.9.67.G01.1.454.CMB.2.raw
  modified_base (361)..(361): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttgcctggtaccagcagacgacctggcttggcctcccgagggtcctcatctacggtgcgtccagcagggccacgtggtactcccggccaggtcaggtggtagtggtctggggacngagttcgttctcaccatcagcagcctgcagtctgaagtatttgactagtttattacgtgtacagcaacttaataattagggttcgccgtctcgtacgtttcgggacggagggaccgtaaagggtggaacgacttacgaaaacggtactggtacggctcggaacctaacacttcgtgtccttctactttccccg

SEQ ID NO: 368577 - DNA, 610 bp, Homo sapiens
  misc_feature: GZ8MTXP02H9WT0.9.67.G01.1.454.CMB.2.raw
tcagtgatacgtctcacgaccggtgctcgatttagagtatacatattgggtttgggggaggaactgctcagttaggacccagacggaaccatggaagccccagcgcagcttctcttcctcctgctactctggctccagataccactggaataatagtgatgacgcagtctccagccaccctgtctgtgtttccaggagaaacagccactctcacctacagggccagtcagagtcttggcaccaacttagcctggtaccagcagagacctggcttggcctcccgagggtcctcatcgtacggtgcgtccagcagggccacgtgggtactcccggcaggttcaggtggtacgtggggtcgtggggacaggtagttcgttctctacatcagcagcctgcagtctgtaagtatttttgacttagttttatacttgtacagtctaacttaagttaagttaggttcggccgtcttaccgtacggtttcggggacgggtaacgggtaccgtaaaggggtcgggacgtacgttacggaaaacgtaaccgttggtacggtccgttaggacctaacccgtagttccgttacgttcctttacctactttcccgttcccccg

SEQ ID NO: 368578 - DNA, 735 bp, Homo sapiens
  misc_feature: GZ8MTXP02F8ZBF.9.67.G01.1.454.CMB.2.raw
  modified_base (204)..(204): a, c, t, g, unknown or other
  modified_base (291)..(291): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacngccactctcacctgcgagggccagtcagagtcttggcacctaactgcctggtaccagcagagacctggcttggctcccgaggtcctnactcgtacggtgcgtccgagcgaggccagtcggtacgtccccggctaggttcaggtgggtaggtcggggtctaggggactaggtacggtttcggttcctacgaacctagttccgaaggtccacggtcccgtgacctagttacgtaggtaacgttattttcggactttaagttttactacgttacggtactaacggtacttaaacgttaagttaaacgttacggggttacggtacccccgttacgtttacccggtttaacccgggttttacgggggaaccggggtaaacccgggggtaacccgtaaaaggggggttacggaacgtacccggtttaaaaccggaaaaaccggttaaccggttggggttacgggtaccttacggaacccgtaacccgttaatttcccgttaacggtttccctttaacccggtaacttttccccccgg

SEQ ID NO: 368579 - DNA, 694 bp, Homo sapiens
  misc_feature: GZ8MTXP02IFIQA.9.67.G01.1.454.CMB.2.raw
  modified_base (307)..(307): a, c, t, g, unknown or other
  modified_base (332)..(332): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcgagggccagtcagagtcttggcaccaacttagcctggtaccagcagacgacctggcttcggcctccgaggtcctcatcgtacgggtcncgtcagcgacgggccagtcggtacncccggctaggtcaggttcggtaggttcgggtcgtggggaactaggtacgtttccgttactaccgacctagtccgagactacgcctgacgtagtcgtaggtaagttagttttcgacttaagttttacttacgtcgtacgtacgtactaagttaacttaagttacggttccggtaccgtcgtttaccggtaccggtttacggggaccggggttaacggggaaacccgtaaaacggggttcgggtaaaccgttaccggtaaaaccgtaaaaccgggtacgttacggggttccggtaaccgttacggaacccgtaacccgttaacgttccgttacggtttcccgttaacctttaccgtttcccccg

SEQ ID NO: 368580 - DNA, 614 bp, Homo sapiens
  misc_feature: GZ8MTXP02IBXZJ.9.67.G01.1.454.CMB.2.raw
  modified_base (262)..(262): a, c, t, g, unknown or other
  modified_base (264)..(264): a, c, t, g, unknown or other
  modified_base (471)..(471): a, c, t, g, unknown or other
  modified_base (577)..(577): a, c, t, g, unknown or other
tcagtgatacgtctcacgaccggtgctcgatttagagtatacatattggggtttgggggaggaactgctcagttaggacccagacggaaccatggaagccccagcgcagcttctcttcctcctgctactctggctcccagataccactggaataatagtgatgacgcagtctccagccaccctgtctgttgtttccaggagaaacagccactctcacctgcgagggccagtcagagtcttggcacctactagccttggaccngnagacgacctggcttggcctccgagggtcctcatcgttacgggtcgccgtcccgaaggccgaaggggtcccctaacgtcgggttaccgtcccccgggtccgtaaagggtttccgaggtcgggttaccggggtggggttcaggggtactaggtcgtttcggttctacacctatcgaggcacgcccgtagcctaagtcgtagaaagtttntttaggacttaggtttaacttctggactagtcaagtttaactagtggttcgccgtactcgtacggttcgggaggtacgacgtagtgggacttcgaacttaaacggngtcgagctacaactctacgtcgtctacgtctactccg

SEQ ID NO: 368581 - DNA, 730 bp, Homo sapiens
  misc_feature: GZ8MTXP02FVXMG.9.67.G01.1.454.CMB.2.raw
  modified_base (300)..(300): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagcccaccctgtctgtgttccaggagaaacagccactctcacctgcagggccagtcagtagtcttggccacctaattcgcctggtaccagcagacgaccgtggcttcggcctccccgagggtccctnatcgtacggtgccgtcagcgagggcctacgtcggtacctcccgggctaggttaccgaggtgggttaggtggggttcgtggggaacctagggttacgtttccggttacctccgtaaccgattcgaacggaccacgtcccgttgacccgtagtccgttaaggtaaagtttagttttacggttaccttaaaggtttttacttacgttgttaccgtacgtacttaaacttaagtttaaaacgtttacgggttcggtaccccgttcgttaccgttaccggttttaccgggggacggggtaaacggggtaacccggtaaaaggggtacggtaacggtacccgtaaaccggtaaaaccggtaacggttcggtacgggtccttagggaaccctaacccgtagttccgttcggttacctttaccgtacttttcccccgg

SEQ ID NO: 368582 - DNA, 698 bp, Homo sapiens
  misc_feature: GZ8MTXP02HO3MZ.9.67.G01.1.454.CMB.2.raw
  modified_base (198)..(198): a, c, t, g, unknown or other
  modified_base (203)..(203): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccagganaaacngccactctcacctacgagggccagtcagagtcgtggaccactaacttcgcctggtaccagcagacgaccgtggcttcggcctcccgagggtccctctacgtccgtacgggtcgccgtccgaggcgacggggcctacggtcgggtaccgtccccgggacgtaggggtttacgagggttaggggtagggttcgggggttaccgtagggggaacgtaggggttacgtttcgttaccgtccaaccgtatccgacggctaacgcccttagctagttcgtagaagtttagttttcgtactttagttttactacgttgtacacgtactaaacttaagtttaaagttacggttccgggtccgacgtttaccgtacgggtttcgggacggggtaacgggaccggtaaaggggtcggtaacgtcgttaaaccggaaaacgttacggtacggtcggtacctggaccctaactcgtctttcgtccttaccgtactttcccgtacccg

SEQ ID NO: 368583 - DNA, 527 bp, Homo sapiens
  misc_feature: GZ8MTXP02JZ7C1.9.67.G01.1.454.CMB.2.raw
  modified_base (398)..(398): a, c, t, g, unknown or other
  modified_base (513)..(513): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggcctcccgagggtcctcatctacggtgcgtccagcagggcccacgtggtactcccgggcctaggttcaggtggtagtggggtctggggacaggtagttcgtctcaccagtcagcagcctgcngtctgaagtatttgctagtttattactgtcagcactataatagttgccgtctcgtacgtttcggcggtaggacgaaggtcggagctacgaaacgactgacgctagcgacactctntcgttcacttcccg

SEQ ID NO: 368584 - DNA, 671 bp, Homo sapiens
  misc_feature: GZ8MTXP02F6GHQ.9.67.G01.1.454.CMB.2.raw
  modified_base (203)..(203): a, c, t, g, unknown or other
  modified_base (458)..(458): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaaacngccactctccacctgcgagggccagtcagtacgttcttcggacctaacccaacttacgcctacggtacccagacagacgaccgtggccgttcggccgtccccgacgggtccctcgacgttccgtacggtcgccgtccacggcgacgggccctagtcggtaccgtccccggcgtaggttcaggtcgggtagtcgggtcgtgggacaggttagttccgtcacactagtcacgtcagcctgctgtcgtaggtaagttntttgtacttaagtttactacgttcgtactacgtaccttaagttaagttaaagttcgggtttcgacccgttacgttaccgttaacgggtttcggggaccggggtaacgggtacggaacggggttcggaacgtacgtaaacggaaaacgtacgtggtacggtactacgaaccgtactaccgtttcgtaccgtttacctaccgtaccgtttccccg

SEQ ID NO: 368585 - DNA, 622 bp, Homo sapiens
  misc_feature: GZ8MTXP02HF78E.9.67.G01.1.454.CMB.2.raw
  modified_base (203)..(203): a, c, t, g, unknown or other
  modified_base (304)..(304): a, c, t, g, unknown or other
  modified_base (334)..(334): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaaacngccactctcacctgcagggccagtcagagtctggacactaacttagcctggaccagcagagacctggcttggcctcccgagggtcctcatcgtacgggtcnccgtccgagcgacgggcctacgtcggtacncccggctaggtcaggtcgggtagtgggtctaggggactaggtagtttccgttctacgaccctagtccaggccagtccctgctagtcgtaggtaagtttatttcgacttagtttactacgtgtactagacttaacttaagtagttacggtcgtaccgtcgttacctacggtttaccgggacggggaacggtaacgaaaggggttcgaacgtaccgtaaacgaaaaccggtacgttggtacggtcttaccgaacgactacttcgtacgttccttacctacgtttcccccg

SEQ ID NO: 368586 - DNA, 594 bp, Homo sapiens
  misc_feature: GZ8MTXP02INPSR.9.67.G01.1.454.CMB.2.raw
  modified_base (203)..(203): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccaggagaaacngccactctcacctgcagggccagtcagtagtcttggaccaccaacttagccctggtacccagcagacgacctggcttcggctccccgagggtcctcatctacggtgcgtccagcagggccacgtggtactcccggcaggttcaggttggtagtggtcgtgggactaggtagttcgttctcacctatcagcacgcctgctagtctaggtaagtattttggactagtttatactgtacagtctaacttataagttggttacggccgtacgttcgtacggtttccgggacgggtaacggggaccgaagggtacggacgtactaccgtaaaacggaacgtcggtacgggctacggtaaccgactacgttcgtacgttccttacgtactttccccg

SEQ ID NO: 368587 - DNA, 623 bp, Homo sapiens
  misc_feature: GZ8MTXP02IKSYP.9.67.G01.1.454.CMB.2.raw
  modified_base (308)..(308): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcacctaacttagcctaggtaccagcagagacctggcttggcctcccgagggtcctacatcgtacgggtncgtccagcgaggcctagtcggtactccccggctaggtcaggttggtagtgggtctggggactaggtacgttccgttcacaccatccagcacgcctgccagtctaggaagttatttaggacttaagtttattacgtagtacaagtctaacttaataagttacgggttacgcgtactacgttacggtttcggggacgggtacgggtaaccgaaagggttcggaacggtccgttaaacgaaaacggtacgttacgggcggtaacgtacggaacctaaccgtacttacgtacgtttaccttacgttaacgtttcccccg

SEQ ID NO: 368588 - DNA, 587 bp, Homo sapiens
  misc_feature: GZ8MTXP02FHCK2.9.67.G01.1.454.CMB.2.raw
  modified_base (201)..(201): a, c, t, g, unknown or other
  modified_base (206)..(206): a, c, t, g, unknown or other
  modified_base (260)..(260): a, c, t, g, unknown or other
  modified_base (290)..(290): a, c, t, g, unknown or other
  modified_base (407)..(407): a, c, t, g, unknown or other
tcagtgatacgtctcacgaccggtgctcgatttagagtatacatattggggtttgggggaggaactgctcagttaggacccagacggaaccatggaagccccagcgcagcttctcttcctcctgctactctggctcccagatacccactggaataatagtgatgacgcagtcctccagccaccctgtctgtgttccagganaaacngccactctcacctgcagggccagtcagtgtctggcacctaactgcctggtaccngcagacacctggctagcctccgaggtcctnatctagggtcaccgtcgagcgacgggccacgtcggtacctccccgggtcagggttccaggtcgggtagtcggggcttggggacaggtcgtttccactcaccgatccagccttagccngcagttcaggaacttattgctaagtttactactgttacagtctaactagtaaagttgggtccgtccgtacgtactaccggtttcggaccgggttagggacccgaagggttacgggacttacctaacgaaaacgtcgttggcggctacggccaaccgttctcgttctacctctacgtcccg

SEQ ID NO: 368589 - DNA, 593 bp, Homo sapiens
  misc_feature: GZ8MTXP02FIPM4.9.67.G01.1.454.CMB.2.raw
  modified_base (406)..(406): a, c, t, g, unknown or other
tcagtgatacgtctcacgaccggtgctcgatttagagtatacatattggggtttgggggaggaactgctcagttaggacccagacggaaccatggaagccccagcgcagcttctcttcctcctgctacctctggctcccagataccactggaataatagtgatgacgcagtctccagccaccctgtctgtgttccaggagaaacagccgactctcacctgcagggccagtcagatctggccacgaacttagcctaggtaccagcagtagacctgggccttggctccccgaggtcctgactctacgggtgcgttccaagtcacggggcccaagtggtactccccggacaggttccaggtcggtagtgggtactggggacagacgtttccgtcacgaacctatccgancgacgtctgcagtctagtaagtgttagacttagtttatacgtcgtacagtactaactaagttaacgttaggtacgacccgtacttacgtacggtttccgggacggaacgggacgaacgggtcgacgctaaccgaaacgacgtacggtacgtcgtacgaacctaccacgtcgtcgtcctactactccg

SEQ ID NO: 368590 - DNA, 646 bp, Homo sapiens
  misc_feature: GZ8MTXP02FOLZL.9.67.G01.1.454.CMB.2.raw
  modified_base (198)..(198): a, c, t, g, unknown or other
  modified_base (203)..(203): a, c, t, g, unknown or other
  modified_base (481)..(481): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgttccagganaaacngccactctcacctgcgacgggccagtcagtagtcgttggccacctaacttcgccgtcggtacccagcaggacgaccgtggcttcggcctcccgagggtcctcgatcgtacggtgaccgtccagcgacgggccacgtcggacctccccggacgtaggttcgaggtggtaggtcgggtcgtggggaactacggttcgttcgttcacgtaccagttccgagcagtccctagcctagtcgtagtaagttacttggtacttaaggttttacgtatcggttaanacgtcctaaagtaattaacggtacgtttcgggacccgtcttaccgttacggtttaccgggacggaaacggggtaccgtaaaaggggtcgtaagaccgtaaaccgtaaacgtaacgttggaacgggtcacgaacctactacgttcgtcttactactactttccccg

SEQ ID NO: 368591 - DNA, 637 bp, Homo sapiens
  misc_feature: GZ8MTXP02GTCVZ.9.67.G01.1.454.CMB.2.raw
  modified_base (188)..(188): a, c, t, g, unknown or other
  modified_base (203)..(203): a, c, t, g, unknown or other
  modified_base (253)..(253): a, c, t, g, unknown or other
  modified_base (294)..(294): a, c, t, g, unknown or other
tcagtgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgagcagtctccagccaccctgtctgtnttccaggagaaacanccactctcacctgcagggccagtcagagtctgcacaacttagctgtaccngcagagacctggcttggctcccgaggtcctcatctacggtncgccagtcaaggcccagtcggacttcccggccgaggttcaggtggtagtgggtactggggtacagtacgttcggttcctacaccgtatactaagccaagcctgccgtagtctagtaagtattttggtcttaaggtttattactgtacgacgtatacctaattaagttacgttacggtaccgtaccgttcctaaccggttttacgggcgggtaacggggaacccggtaagggtaacgggtacgaccggtaaacctaaaacgggtaaaccgttggaaccggtccgttacggaaccgttaaaaccctcgttacgttaccggtacctttccccgtaatttacccccg

SEQ ID NO: 368592 - DNA, 529 bp, Homo sapiens
  misc_feature: GZ8MTXP01A4E56.22.27.C05.1.454.CMB.2.raw
  modified_base (502)..(502): a, c, t, g, unknown or other
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctactagcttggttccagcagaaaccaggacatcctcctctactgctctatttactgggcgtcgtacccgggaagtcccggggtccctgaccccgattcagtgcaagcgggtcgtgggacagtatttcactctacaccatcagcacgcctgctaggctagagatgtggctagtttattacctgtcagcaattattatacttcctctcaagtacgttcggaccgaacgggacctaaggttaggaaanacaaagactgtggcttacgcaactaac

SEQ ID NO: 368593 - DNA, 642 bp, Homo sapiens
  misc_feature: GZ8MTXP02G6PTS.22.27.C05.1.454.CMB.2.raw
  modified_base (254)..(254): a, c, t, g, unknown or other
tcagacatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccacaataaganctactagcttggttccagcagaaaccagacatcctcctctactgctctatttacgtgggtccgtccgtaccccggggtaattccccggggtccctaggacccccgtatccgtagtcggaccaggccggggtcgttgggggactaggactttccaactccttccaaacgtatccgaagccagcccgtgcccgaaggtccgttaggaagtagttgggacggtactaaggtttttacttacttagggtaccagattaaacttatttaacttactttaccctccttaccgtaacggttacggttacccggtacgaaacggggaaccctaaggggtaacgaaactaaccggtaaacggtaagtttacggaggtacctacgtaccaacgttacg

SEQ ID NO: 368594 - DNA, 541 bp, Homo sapiens
  misc_feature: GZ8MTXP01D568Q.25.37.D04.1.454.CMB.2.raw
  modified_base (299)..(299): a, c, t, g, unknown or other
  modified_base (478)..(478): a, c, t, g, unknown or other
  modified_base (484)..(484): a, c, t, g, unknown or other
  modified_base (490)..(490): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctctgggttcagcgttagcacagctacttgatctgggtccnccagggctccgaggggaaggggctgggagtgcgtctcagtttattatagccgataataccacctactaacgcaagactccgtagaacgggccgattcctatctcagagacaattccaagaaccacctctatcttacaaatcgaacggccctgagagccgagacacggacctgtattacngtgcgngggganattacgtagtgttattcgattaactacttccagtggggcctggttccctgg

SEQ ID NO: 368595 - DNA, 641 bp, Homo sapiens
  misc_feature: GZ8MTXP01EH24K.25.37.D04.1.454.CMB.2.raw
  modified_base (293)..(293): a, c, t, g, unknown or other
  modified_base (313)..(313): a, c, t, g, unknown or other
  modified_base (315)..(315): a, c, t, g, unknown or other
  modified_base (317)..(317): a, c, t, g, unknown or other
  modified_base (326)..(326): a, c, t, g, unknown or other
  modified_base (367)..(367): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcgtggtttcgtgtagctgtttaaagtgtcagtgtgaggtgcagctggcggagtgtggaggaggcctgatccagccgtggggggtcctgagctctcctgtgcagcctgtgggttcagtcgttagcacagctacttgatcgtggtccnccaggctcgaggggaagggngngngtgcgtctntagttattatagacgtataactaacctacctactaacgacncgacgtacgtacggacggtaccgtacttacttactactacgacgaacgaactaactaccgtaacgtaacctaacctactacttactaactaaactaacgaaccggaccgtacgacgacgaccgaacggaccgaccggtaccgtacgttacgttacgtcggtcggaacgggacgggaggtaacgttaacgttaggttaggtttacgtttacgttacgtttaactttaccgtttaaccgttacggtcgggttaccggttaaccggttccggttcgg

SEQ ID NO: 368596 - DNA, 618 bp, Homo sapiens
  misc_feature: GZ8MTXP01DBYZP.25.37.D04.1.454.CMB.2.raw
  modified_base (272)..(272): a, c, t, g, unknown or other
  modified_base (280)..(280): a, c, t, g, unknown or other
  modified_base (316)..(316): a, c, t, g, unknown or other
  modified_base (326)..(326): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcgtggtttcgtgtaggctgtttaaaagtgtcagtgtgaggtgcagctggcggagtcgtggaggaggcctgatccagcctgggggtcctgagctctcctgtgcagctctggttcagcgtagtcacanctactgtntcgtcggtccgcgacgcgacggagggagggcgtggngtgtcgtctntagttattatagtactaataactaacctacctactaacgacaacgacgtacggtacggaacgggtaccgtacttacttactactacagaacgaactaactacgaacgaacctacctactacttactaactaactacgacggacgtacgacgacggacggacgacgacggtacgtacgtagtacgtcgtggcggacgggaggtagttacgttaggttaggtttacgtttacgttacgtttaacctttaccgtttaaccgttacggtcgggttaccggttaaccggttccgtcg

SEQ ID NO: 368597 - DNA, 541 bp, Homo sapiens
  misc_feature: GZ8MTXP01ECNBQ.25.37.D04.1.454.CMB.2.raw
  modified_base (298)..(298): a, c, t, g, unknown or other
  modified_base (396)..(396): a, c, t, g, unknown or other
  modified_base (403)..(403): a, c, t, g, unknown or other
  modified_base (405)..(405): a, c, t, g, unknown or other
  modified_base (475)..(475): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcgtggttttctgttagctgtttaaaaggtgtcagtgtgaggtgcagctggcggagtctggaggaggcctgatccagccgtggggggtccctgagactctcctgtgcagcctcgtgggttcagcgttagtcacagctacttgatctgggtccnccaggctccgagggaaggggctgggagtgcgtctctagtttattatagccgataataccactactaacgcaagactccgtgaacgggcctattcctanctcagananatcagacacctctatctactaatagaacggacctcgagacgacgacgacgacgccgtcgtatactgtggnggcgggagattagtagtgttagttcttacttaacttacttccgtcgtcggttcgtcggttccgtcg

SEQ ID NO: 368598 - DNA, 647 bp, Homo sapiens
  misc_feature: GZ8MTXP01DKG45.25.37.D04.1.454.CMB.2.raw
  modified_base (246)..(246): a, c, t, g, unknown or other
tcagactgtacagtcacgaccggtgctcgatttagtagcatactgttgggtttgggggagaggagcccagcactgggattccgaggtgtttccattcggtgatcagcactgaacacagaggactcaccatggcgttttggctgagcgtggttttcgtgtaggctgtttaaaagtgtcagtgtgaggtgcagctggcggagtctggaggaggcctgatccagcctgggggtccctgagctctcctgngcagcctgtggttcagtcgttagcacagtctacttgactcgtcggtccgccgacggcgtccggaggggaaggggacggtgggtaggtgtcgtcgtacgtagtttatttatagacgtaataaactaacctaaccctaactaaacgacaacgtacgtaccgtacggtaacgggaccgtacttaccttactactacagaagaactaacttacgtaacgaacctaacctactacttactaactaaactaacgaaccggaccgtacgacgacgaccgacgacgacgtaccgtacgttattacgtcgtggcggacgggaggtaacgttaacgttagttaggtttacgtttacgttactttaacttacctttaacccgttacgtcgggttaccggtccggttccgtcg

SEQ ID NO: 368599 - DNA, 561 bp, Homo sapiens
  misc_feature: GZ8MTXP01EA680.25.37.D04.1.454.CMB.2.raw
  modified_base (261)..(261): a, c, t, g, unknown or other
  modified_base (346)..(346): a, c, t, g, unknown or other
  modified_base (430)..(430): a, c, t, g, unknown or other
  modified_base (439)..(439): a, c, t, g, unknown or other
  modified_base (491)..(491): a, c, t, g, unknown or other
  modified_base (498)..(498): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctntgggttcagcgttagcacagctacttgatcgtgggtccgccaggctccgaggggaaggggctgggagtgcgtctctagttattanagccgataactacccacctactaacgcaagactccgtagaagggccgtattccttatctccagagacattccaagaacaccctntatccttanaaatcgaacgccctgacgacgccgagacgacggcctgtacttactgtgcggnggggganagttacgtaggtgtttatttcgatttaaccttcttccctagtcgggctaacgggttccctcgg

SEQ ID NO: 368600 - DNA, 601 bp, Homo sapiens
  misc_feature: GZ8MTXP01A8DZA.25.37.D04.1.454.CMB.2.raw
  modified_base (203)..(203): a, c, t, g, unknown or other
  modified_base (239)..(239): a, c, t, g, unknown or other
  modified_base (264)..(264): a, c, t, g, unknown or other
  modified_base (280)..(280): a, c, t, g, unknown or other
  modified_base (289)..(289): a, c, t, g, unknown or other
  modified_base (296)..(296): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctccagatagcaccggagaagttgtgttgacacagtctccacacaccctgtctttgctccgaaggggaaangcccaccctctcctgcagggccagtcagagtgttancaggttacttagcctggtaaccaanagaacctggccaggcncccagctcncatctangatgcatccaaggcggccagtggaccactccccgaagcccgtaggttccaggtcggacgtagggtgggggctagggggaaccagggtcttccaactcctacaccgatcgaagcagtcgtgggacgtccgtagtaagttagttttgtacgttagtttacttacgttgttacgaggtcgagtcgtagtcgtaggttcggtccggttaccggggttacgtaggtttcggaccggtaacggggaaccgaaggcgtaggagtaacgtacgaaacgacgttggtaagcgtcgactaccttatcgttcgttc

SEQ ID NO: 368601 - DNA, 502 bp, Homo sapiens
  misc_feature: GZ8MTXP01BJI5Q.25.37.D04.1.454.CMB.2.raw
  modified_base (202)..(202): a, c, t, g, unknown or other
  modified_base (212)..(212): a, c, t, g, unknown or other
  modified_base (262)..(262): a, c, t, g, unknown or other
  modified_base (291)..(291): a, c, t, g, unknown or other
  modified_base (359)..(359): a, c, t, g, unknown or other
tcagactgtacagtcacgaccggtgctcgatttagtagcatactgttgggtttggggaggaactgctcagttaggacccagagggaaccatggaagccccagctcagcttctcttcctcctgctactctggctcccagatagcaccggagaagttgtgttgacacagtctccagacaccctgtctttgtctccaggggaaanagccaccctntcctgcagggccagtcagagtgttatcaggtacttagcctggtaccaaanagaaacctggccaggctcccaggctcctnatctatgatgcatccaagaggccatggcatcccagccaggttcagtcggcagtggggctgggaacagngttcactctcaccatcagcagtctggagcctgaagtatttgctagttattactgtcagggcagcgtagcagtggctcggggtactgtttggcgagggaacaagcgtggagatcgaaacgacttagtggctgcacatcttgttc

SEQ ID NO: 368602 - DNA, 570 bp, Homo sapiens
  misc_feature: GZ8MTXP01A19Q6.25.37.D04.1.454.CMB.2.raw
  modified_base (314)..(314): a, c, t, g, unknown or other
  modified_base (323)..(323): a, c, t, g, unknown or other
  modified_base (363)..(363): a, c, t, g, unknown or other
tcagactgtacagtcacgaccggtgctcgatttagtagcatactgttgggtttgggggagaggagcccagcactgggattccgaggtgtttccattcggtgatcagcactgaacacagaggactcaccatggcgttttggctgagcgtggtttcgtgttaggctgtttaaagtgtcagtgtgaggtgcagctggcgagtctggaggaggcctgatccagccgtgggggtccctgagactctcctgtgcagctctggttcagcgtagtcacagctactgatctggtccgccagctccgagggaaggggcgtgggngtgcgtctntagttattagtagacgataactacctacctactaacgacncgacgtacgtacgacggtacgtacttacttactctacagacgactactacgaacgacctacctactacttactactaactacgacggacgtacgacgacgaccgacggacgacggtacgtcgtagtacgtcgtgcggcgggagtagttagtagttgttacgttcgttacttaacttacttccgtcgtcgggttcgtcggttccgtcg

SEQ ID NO: 368603 - DNA, 575 bp, Homo sapiens
  misc_feature: GZ8MTXP01AOQLZ.25.37.D04.1.454.CMB.2.raw
  modified_base (281)..(281): a, c, t, g, unknown or other
  modified_base (324)..(324): a, c, t, g, unknown or other
tcagactgtacagtcacgaccggtgctcgatttagtagcatactgttgggtttgggggagaggagcccagcactgggattccgaggtgtttccattcggtgatcagcactgaacacagaggactcaccatggcgttttggctgagcgtggtttcgtgttagctgtttaaaagtgtcagtgtgaggtgcagctggcggagtctggaggaggcctgatccagcctggggggtccctgagactctcctgtgcagctctggttcagcgtagtcacagctacttgntctgcgtccgcgacgcgtcgagggagggcgtggagtgcgtctntagttattagtacgagataactacctacctaactacgcacgacgtacgtacggacggtacgtacttacttactactacgagagaacaactacgacgaactacctactactactactaacacggacgaccgtacgacgacgacgacgacgacgcgtcgtacgttacgtgtcggcggcgggagagtacgtagttaggtttgttacgttaattacttaacgtttaccgttacgttcgggtccggttcggttccg

SEQ ID NO: 368604 - DNA, 581 bp, Homo sapiens
  misc_feature: GZ8MTXP01EPIM9.25.37.D04.1.454.CMB.2.raw
  modified_base (346)..(346): a, c, t, g, unknown or other
  modified_base (492)..(492): a, c, t, g, unknown or other
  modified_base (498)..(498): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctctgggttcagcgttagcacagctacttgatctgggtccgccaggctccgagggggaaggggctgggagtgcgtctctagttatttanagaccgataaactaccacctactaacgcaagactccggtagaacgggccgtattccttatcctaccagacacaattccaaggaaccaccctctatcttacaaatcgaacgccctagacgacgccgagcgacggcgtgtatactggnggcggngggatagttacgtaggttgtttacgttcgttacttaaccttaccgtttccgtcggtcgggttaccgtccgggtttcccgtcgg

SEQ ID NO: 368605 - DNA, 688 bp, Homo sapiens
  misc_feature: GZ8MTXP01AEWHP.25.37.D04.1.454.CMB.2.raw
  modified_base (282)..(282): a, c, t, g, unknown or other
  modified_base (302)..(302): a, c, t, g, unknown or other
  modified_base (346)..(346): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggtcgttttggctgagcttgggttttccttgttgcttagttttaaaaggtgtccagtgtgaggtgcagctggcggagtctggaggaggcctgatccagccgtgggggtccctgagctctcctgtgcagcctgtggttcagcgttagcacngctacttgatcgtgggtccncgaggctccgaggggagggctggagtgcgtctctagtttattanagccgtaataactaccaccctactaacgctaagacctccgtaggaacgggccgtatttccttaatcctaccaagacgaacctaaactttcccgaaacggtaaaccctaccccttacttaacttacctttaacaaaacgttcggaaacccggtcccctaggaacgaacggcccggaggaccgaccgggtacccgttgttaacttaccgtggtgggccgggagggggttataacgttacgttaagggttttagggtttactttaccggttactttttaacccgttaccgttttccccgtaacggttcgggggttacccttaacgggggtttccccgttaacggg

SEQ ID NO: 368606 - DNA, 777 bp, Homo sapiens
  misc_feature: GZ8MTXP01CNEVO.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgctgttttaaaaggtgtccagtgtgaggtgcagctggcggagtctggaggaggcctgatccagccgtgggggtccctgagactctcctgtgcagcctgtgggttcagtcgttagcacagctacttgatcgtgggtccgcaggctccgaggggaaggggctggagtgcgtctacgtagtttatttatagccgtaataaactacccaaccctactaaacgacaacgactcccggtaggaacgggccgtaatttcccttaatccctaccgaaggaacgtaactaaactttcccgaaacgggtaaaccctacccttacttaacttacctttaacaaaagttccggaaaccggtccccgttaagggaaccggaacgggaccccggaaagggacccgtaaccggggtacccggttaggttaaactttaccggtgggtcgggaacccgggggtaacggggggaagtaaacgttaccggtttaaaggggtttggggttttttaaactttttccgggttaaacgttttttaaaccccttaccccgttttttaacccccggttaacggggtttcccgggggggttacccctttaacggggggtttttccccccttaacggggg

SEQ ID NO: 368607 - DNA, 588 bp, Homo sapiens
  misc_feature: GZ8MTXP01EQX3Q.25.37.D04.1.454.CMB.2.raw
  modified_base (300)..(300): a, c, t, g, unknown or other
  modified_base (345)..(345): a, c, t, g, unknown or other
  modified_base (426)..(426): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgctgttttaaaaggtgtccagtgtgaggtgcagctggcggagtctggaggaggcctgatccagccgtgggggtccctgagactctcctgtgcagcctctgggttcagcgttagcacagctacttgatctgggtccnccaggctccgaggggaagggctggagtgcgtctctagttatttanagccgaataactaccacctactaacgcaagactcgagaacgggcctattccttatctccagagacaattcaagacaccctntatcttacaaatcgaaaccgccctagacgacgaccgaaggacacggccgtgtaattaccgtggtggcgggcggggagtattacgtagttgggtttactttcgttaactttaactactttccccgtacggtcgggggttacctaacggggtttccccgtcggg

SEQ ID NO: 368608 - DNA, 732 bp, Homo sapiens
  misc_feature: GZ8MTXP01D4AXC.25.37.D04.1.454.CMB.2.raw
  modified_base (180)..(180): a, c, t, g, unknown or other
  modified_base (306)..(306): a, c, t, g, unknown or other
  modified_base (361)..(361): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgcttagtttaaagtgtnagtgtgaggtgcagcgtggcggagtcgtggaggagcctgatccgagccgtgggggtcctgagactctctgtgcacgtcctcgtgggtcagtcgttagcacagtctaacttgactcgtcgggtcccnccgaggccgtaccggagggggaagggcgtggagtcgcgtctagtagtttatttanagaccgaataaactaccctaacctactaacgcaacgactaccgtaggaaacgggtcctacttccttatcctacgaaggaacaactaacttacccgaaacggaaccctaccctacttaacgttaccctttaacaaaaacgttcggaaacccgggtccccgttaagggaaacggaccgggaacccggtaaacgggacccgtaccgggtacccggtttaggttaactttaaccgtgggtcgggccgggagggggttaataaacgtttaacgtttaagggttagggttttaactttcggttaaattttaacccttaaccgttttccccgttaacgggtcgggggttacccttaaccggggtttcccgttcccggg

SEQ ID NO: 368609 - DNA, 571 bp, Homo sapiens
  misc_feature: GZ8MTXP01ETXOZ.25.37.D04.1.454.CMB.2.raw
  modified_base (347)..(347): a, c, t, g, unknown or other
  modified_base (356)..(356): a, c, t, g, unknown or other
  modified_base (483)..(483): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtcgtggaggaggcctgatccagccgtgggggtcctgagactctcctgtgcagcctcgtgggttcaggcgttagcacagctacttgatcgtgggtccgccaggcctccgaggggaagggctggagtgcgtctctagttattanagcgataanaccacctactaacgcaagactccgtagaacgggcctattcctatcctacagaagacaacttcaacgaaccaccctctatcttacaaatcgaacgccctagagacgccgagcacggcctgtacttacngtgcggcggggatacgttacgtaggttgttatttcgactttaacttcctttcccgtacgtcggggttacctaacgggtttcccgtcgg

SEQ ID NO: 368610 - DNA, 550 bp, Homo sapiens
  misc_feature: GZ8MTXP01D6541.25.37.D04.1.454.CMB.2.raw
  modified_base (344)..(344): a, c, t, g, unknown or other
  modified_base (423)..(423): a, c, t, g, unknown or other
  modified_base (488)..(488): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctctgggttcagcgttagtcacagctacttgatctgggtccgccaggctccgaggggaaggggctggagtgcgtctcagttattanagccgataataccactactaacgcaagactccgtagaagggccgattccttatctcagagacattccaagaacaccctntatcttacaaatcgaaacgccctgacgagccgagacacggcctgtattactgtggcgtcgggganagttacgtaggttggttatttcgatttctactttccctagtgggcctaaggggttccctcgg

SEQ ID NO: 368611 - DNA, 568 bp, Homo sapiens
  misc_feature: GZ8MTXP01AHEKR.25.37.D04.1.454.CMB.2.raw
  modified_base (201)..(201): a, c, t, g, unknown or other
  modified_base (263)..(263): a, c, t, g, unknown or other
  modified_base (370)..(370): a, c, t, g, unknown or other
  modified_base (379)..(379): a, c, t, g, unknown or other
tcagactgtacagtcacgaccggtgctcgatttagtagcatactgttgggtttggggaggaactgctcagttaggacccagagggaaccatggaagccccagctcagcttctcttcctcctgctactctggctccagatagcaccggagaagttgtgttgacacagtctccagacacctgtctttgtctccgaggggaaancgccaccctctcctgcagggccagtcagtagtgttatcaggtacttagcctaggtaccaaanagaaacctggccaggcctcccgaggcctcctcatctatgatgcatccgaaaggcggccacgtggcactcccagccaggttcaggtcgcaggtggggctgggaacagngttcactcncacatcagcagtcgtggacgctagaagtatttgactagtttatacgtgtacagggcaggtcgtacgacgtaggttcggccggttccggggtacgttaggtttcggaccgtagggggaaccaaggcgtagggacgtacgtaacgaaacgttacgttggtggtctcggccaccgttattcgttcgtttccg

SEQ ID NO: 368612 - DNA, 518 bp, Homo sapiens
  misc_feature: GZ8MTXP01BNK8P.25.37.D04.1.454.CMB.2.raw
  modified_base (204)..(204): a, c, t, g, unknown or other
  modified_base (239)..(239): a, c, t, g, unknown or other
  modified_base (310)..(310): a, c, t, g, unknown or other
  modified_base (360)..(360): a, c, t, g, unknown or other
  modified_base (387)..(387): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccgaggggaaangccaccctctcctgcagggccagtcagagtgttancaggtacttagcctggtaccaacagaaacctggccaggctcccaggctcctcatctatgatgcatccaagngggccactggcatccagccaggttcagtggcaggtggggctgggaacagngttcactctcacatcagcagtctggancctgaagtattttgctagtttattactgtcaggcagcgtagctaggtcggccgtccggggtataggtttggccgtaggggaaccaagcgtaggagtactacgaacgcgttgtggctgcacatcgttgttcc

SEQ ID NO: 368613 - DNA, 686 bp, Homo sapiens
  misc_feature: GZ8MTXP01AOCIF.25.37.D04.1.454.CMB.2.raw
  modified_base (300)..(300): a, c, t, g, unknown or other
  modified_base (566)..(566): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaggtgtccagtgtgaggtgcagctggcggagtctggaggaggcctgatccagccgtggggggtccctgagactctcctgtgcagcctcgtgggttcagcgttagcacagctactgatcgtgggtccnccaggctccgaggggaggggctgggagtgcgtctcgtagtttattatagccgaataactacccacctactaacgcaacgacctccggtaggaacggggcccgtattccttaatccctaccgaaggacgtaacctaaactttcccgaaacgggtaaaccctaaccccttcttaacgttaccctttaaacaaaagttccggaaaacccggtccccttaggaacggacgacccgaagggacccaacggggtcccgtagttacttaccgnggttcggcgggtcgggggaagtacgttaaccgtagggttagggtttaactttcggttaatttaacccttacctttccccgtacggtccgggggttccctaacggggtttccccgtcgggg

SEQ ID NO: 368614 - DNA, 559 bp, Homo sapiens
  misc_feature: GZ8MTXP01EHICM.25.37.D04.1.454.CMB.2.raw
  modified_base (346)..(346): a, c, t, g, unknown or other
  modified_base (490)..(490): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctctgggttcagtcgttagcacagctacttgatcgtgggtcccgcaggctccgaggggaaggggctggagtgcgtctctagttattanagccgataactaccacctactaacgcaagactccgtgacgggcctattctatctcagagacaattccaagacacctctatcttacaaatcgaacgcctagacgacgccgagacgacggcctgtattacgtgtggcggcgggganagttacgtagttggttatttcgatttaactactttccctacggtcggggcctaacgggtttcccgtcgg

SEQ ID NO: 368615 - DNA, 613 bp, Homo sapiens
  misc_feature: GZ8MTXP01DU4SC.25.37.D04.1.454.CMB.2.raw
  modified_base (311)..(311): a, c, t, g, unknown or other
  modified_base (343)..(343): a, c, t, g, unknown or other
  modified_base (356)..(356): a, c, t, g, unknown or other
  modified_base (422)..(422): a, c, t, g, unknown or other
  modified_base (440)..(440): a, c, t, g, unknown or other
  modified_base (444)..(444): a, c, t, g, unknown or other
tcagactgtacagtcacgaccggtgctcgatttagtagcatactgttggggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtcgtgggaggaggcctgactccgagccgtgggggtccctgagactctcctgtgcacgtcctcgtgggttcagtcgttagtcacagtctacttgatcgtgggtccncgaggctcgagggggagggctgggagtgcgtntctagtttattanagaccgataactaccacctactaacgcaagactccggtagaacgggtccattcctatcctacaganactaattccaagtaaccncctntatacttacaaatcgaacgcctgacgacgaccgagaccacggtccgtagtacttacgtggtggcggtggggatagttacgttaggttggtttactttcggttactttaaccgttaccttttaaccccggtaggtccggggttaccgttaacggggtttccccgttcggg

SEQ ID NO: 368616 - DNA, 576 bp, Homo sapiens
  misc_feature: GZ8MTXP01EWIN3.25.37.D04.1.454.CMB.2.raw
  modified_base (372)..(372): a, c, t, g, unknown or other
  modified_base (429)..(429): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtcgtggaggaggcctgatccagccgtggggggtccctgagactctcctgtgcagcctctggggttcagtcgttagcacagctacttgatcgtgggtccgcaggctcgaggggagggctggagtgcgtctctagttattatagccgataactaccacctactaacgcncgactcgtgaacgggccgtattccttatctacagagactaattccaagactaccctntactctacaaatcgaacgcctagacgacgcgaggacacggtcctggtaacttacgtggtggcggacgggggatacgttagtaggttggtttactttcggatttaacctacttttcccgagttcggggcctaacgggtttcccgtcgg

SEQ ID NO: 368617 - DNA, 630 bp, Homo sapiens
  misc_feature: GZ8MTXP01ECUBO.25.37.D04.1.454.CMB.2.raw
  modified_base (252)..(252): a, c, t, g, unknown or other
  modified_base (254)..(254): a, c, t, g, unknown or other
  modified_base (264)..(264): a, c, t, g, unknown or other
  modified_base (269)..(269): a, c, t, g, unknown or other
  modified_base (273)..(273): a, c, t, g, unknown or other
  modified_base (310)..(310): a, c, t, g, unknown or other
  modified_base (315)..(315): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcgtggtttcgtgtagctgtttaaaagtgtcagtgtgaggtgcagctggcggagtcgtggaggaggcctggatccagccgtgggggtccctgagctctcctgtgcncnctcgtggtgngtgtncacntctatgtgtcgtcggccgcgcgcgacggagggagggngtggngtgcgtctagtagttattagtagtacgtaactaactaacctaacctaacgtaacgacgaacgtacgtaccggtacggaacggtaccgtacttacttactacctacgaagaacgtaactaacgtaccgaaccgtaacctaaccctactacttacttaactaaacgtaacgaaccggtacgtacgacgacggaccggacggacgacggtacgtacgtagttacgtcgtggcggacgggaggtagttacgttaggttagtttacgttcgttacttaacttaccgttccgttcggtcgggttccggtccggttccgtcg

SEQ ID NO: 368618 - DNA, 531 bp, Homo sapiens
  misc_feature: GZ8MTXP01CNAQG.25.37.D04.1.454.CMB.2.raw
  modified_base (296)..(296): a, c, t, g, unknown or other
  modified_base (444)..(444): a, c, t, g, unknown or other
  modified_base (476)..(476): a, c, t, g, unknown or other
tcagactgtacagtcacgaccggtgctcgatttagtagcatactgttgggtttggggagaggagcccagcactgggattccgaggtgtttccattcggtgatcagcactgaacacagaggactcaccatggcgttttggctgagctgggttttccttgttgctgtttaaaaggtgtccagtgtgaggtgcagctggcggagtctggaggaggcctgatccagccgtggggggtccctgagactctcctgtgcagcctctgggttcagcgttagcacagctacttgatctgggtccncaggctccgaggggaagggctggagtgcgtctcagttattatagccgataaataccacctactaacgcaagactccgtagaacgggccattcctatctcagagacaattccagaaccaccctctatctacaaatgaacggccctgagngccgagacacggccgtgtattactgtgcgggngggatattagtagttgttattcattaactacttccgacgtcgggctcggttcctg

SEQ ID NO: 368619 - DNA, 654 bp, Homo sapiens
  misc_feature: GZ8MTXP01EULI7.25.37.D04.1.454.CMB.2.raw
  modified_base (346)..(346): a, c, t, g, unknown or other
  modified_base (563)..(563): a, c, t, g, unknown or other
tcagactgtacagtcacgaccggtgctcgatttagtagcatactgttgggtttggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagcgttagcacagctacttgatcgtgggtccgccaggctccgaggggaagggctgggagtgcgttctctagtttatttanagaccgtataaactacccaacccttactaaccgacaacgtacctacccggtggaaacggggtcccgtactttcccttaactccttacccagtacgacctaaattcccgaaacggtaaccaccccttctaattaccttacaaaagttcgaaaccggccccttaggacgacgaccgaaggaccacggtccgtagtattaccgtgtggcggcggggttanagttacgtaggtttggtttaactttcgaacttttaacctccgtttttaaccccgacggttcgggggcccttaagggggttttcccctcggg

SEQ ID NO: 368620 - DNA, 557 bp, Homo sapiens
  misc_feature: GZ8MTXP01C54IA.25.37.D04.1.454.CMB.2.raw
  modified_base (205)..(205): a, c, t, g, unknown or other
  modified_base (241)..(241): a, c, t, g, unknown or other
  modified_base (264)..(264): a, c, t, g, unknown or other
  modified_base (280)..(280): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgttctttgtctccgaggggaaancgccaccctctcctgcagggccagtcagagtgttancaggtacttagcctggtaccaanagaacctggccaggcncccaggctcctcatctatgatgcatccaaaggacggccacgtggacactccccgagcctagggttcaggtcggcaggtggggctggggaacagtgttcactctacaccatcagcagtctggacgccgtagaagtatttgctagtttattactgtcaggcagcgtagcgtaggttcggccgttccggggtacgtaggttttcggccggtagggaaccgaaggcgtaggagtaagtacgaaacgttacgttggtggcgtgcacgttacttcttgtttcc

SEQ ID NO: 368621 - DNA, 737 bp, Homo sapiens
  misc_feature: GZ8MTXP01A9PEH.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagcgttagcacagctacttgatcgtgggtcccgccaggcctccgagggggaaggggctgggagtgcgtctctagttattatagccgaataaactacccaaccctactaaaccgcaagaccgtccggtaggaacggggccgtattccctttatccttaccaaggacgaactaacttacccgaaagggtaaaccctaccccttacttaacttacctttaaccaaaacgttccggaaaacccgggtccccgttaaggaacggaacgggaccccggaaaggacccgaaccggggtacccgttaggttaactttaaccggtgggttcgggccgggtaccggggggaaaggtactttaaccggtaagggtttcgggttttaaactttttccggaaactttttaacccttacccgtttttaaccccgtacgggtcggggggttaccccgttaaccgggggttttcccctcggggg

SEQ ID NO: 368622 - DNA, 660 bp, Homo sapiens
  misc_feature: GZ8MTXP01AMANS.25.37.D04.1.454.CMB.2.raw
  modified_base (263)..(263): a, c, t, g, unknown or other
  modified_base (284)..(284): a, c, t, g, unknown or other
  modified_base (322)..(322): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcgtggtttcgtgtaggctgtttaaagtgtcagtgtgaggtgcagctggcggagtctggaggaggcctgatccagccgtggggggtccctgagctctcctgtgcacgctcgtggtcgngtcgtagcacagtctactgtntcgtcggtccgccgacgcgtcggaggggagggcgtggngtgtcgtctctagttattagtagtacgtaactaactaacctacctactaacgacaacgtaccgtaccgtacggacgggtacgtacttacttactacctaccgacgaacgtaactaacttaccgtaacgaacctaccctactacttacttaactaaactacgaaccggtaccgtacgacgacggaccggacggacgaccggtaccgtacgtacgttacgtcggtcggcgggtacgggttacggtacgttacgttacggttaggtttacgtttacgttactttaaccttaccgtttaacccgttaccggtacgggttaccggtccgggttcccggttccg

SEQ ID NO: 368623 - DNA, 576 bp, Homo sapiens
  misc_feature: GZ8MTXP01AMU5M.25.37.D04.1.454.CMB.2.raw
  modified_base (203)..(203): a, c, t, g, unknown or other
  modified_base (262)..(262): a, c, t, g, unknown or other
  modified_base (279)..(279): a, c, t, g, unknown or other
  modified_base (291)..(291): a, c, t, g, unknown or other
  modified_base (366)..(366): a, c, t, g, unknown or other
  modified_base (375)..(375): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgctccgaggggaaanagccaccctctcctgcagggccagtcagagtgttatcaggtacttagcctggtaccaanagaaacctggccaggcncccaggctcctnatctatgatgcatccaagcgggccacgtggcatcccagccaggttcaggtcggcaggtggggctggggaacaggngttcactcncacatcagcagtctggacgcctagaagtattttgacttagtttattactgtacaggtcaggtcgtagcgtacggttcggcccggttaccgggggtactgggttttcgggaccggaacgggggaaccaaagggccgtagggacgtaacgtaccgaaaacgttacgttggtggcgtcgacctacccgttattccgttcgttcc

SEQ ID NO: 368624 - DNA, 546 bp, Homo sapiens
  misc_feature: GZ8MTXP01DADJI.25.37.D04.1.454.CMB.2.raw
  modified_base (375)..(375): a, c, t, g, unknown or other
  modified_base (398)..(398): a, c, t, g, unknown or other
  modified_base (405)..(405): a, c, t, g, unknown or other
  modified_base (417)..(417): a, c, t, g, unknown or other
  modified_base (421)..(421): a, c, t, g, unknown or other
  modified_base (438)..(438): a, c, t, g, unknown or other
  modified_base (469)..(469): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctctgggttcagcgttagcacagctacttgatcgtgggtccgccagggcctccgagggggaagggctgggagtgcgtctctagttatttatagcccgataataccactactaacgcngactccgtgaagggccattctanctcaganacattcaagacncctntatctacgaaatgaacncctgagacgccgagcacggcctgtattacgngtggcggacggggatattacgtagttggtttattcgatttaactactttcccgtacgtgggacctgggttcccctgg

SEQ ID NO: 368625 - DNA, 667 bp, Homo sapiens
  misc_feature: GZ8MTXP01EK9TV.25.37.D04.1.454.CMB.2.raw
  modified_base (353)..(353): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgtttaaaaggtgtccagtgtgaggtgcagctggcggagtctggaggaggcctgatccagccgtgggggtccctgagactctcctgtgcagcctcgtgggttcagtcgttagcacagctactgactcgtgggtcccgccgaggctccgagggggaaggggctgggagtcgcgtctacgtagtttattanagccgataactaccaacctactaaaccgcaacgactcccggtagaacgggcctattccttatcctaccaagacgaactaacttcccaaacggaacctaccctctacttaccttaacaaaagttcgaaaccggtccccgttaggaacgacggaccgaacggaaccgaccgggtcccgttagttacgttaccgtggtcgggcgggcgggggttagtaagtttaccgtaaggtttgggttttaactttcggttaactttaaccgttaccctttcccgttacgtcgggggttcccttaacggggtttccccttccggg

SEQ ID NO: 368626 - DNA, 637 bp, Homo sapiens
  misc_feature: GZ8MTXP01D4SS7.25.37.D04.1.454.CMB.2.raw
  modified_base (291)..(291): a, c, t, g, unknown or other
  modified_base (392)..(392): a, c, t, g, unknown or other
  modified_base (402)..(402): a, c, t, g, unknown or other
  modified_base (408)..(408): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcgtggttttctgtgctgtttaaagtgtcagtgtgaggtgcagctggcggagtctggaggaggcctgatccagccgtgggggtccctgagactctcctgtgcagcctctgggttcagcgttagcacagctacttgatctgggtccnccaggctcgaggggaagggctggagtgcgtctctagttattatagcgataataccactactaacgcaagactccgtagaagggcctattcctatctcaganacatcagacnctctancttacaaagtgaaccgctagacgacgacgacgacgtacggtacgtgtaacgttacgtcgggtgggaacggggtacggggttacgggtaacggttaacggttaacgggtttaacgggttttaacggttttacgtttaacgtttaacccgttttaacccgttttaaccccggtttacccgggttaccgggggttacccgggttaacccggggtttccccgggtttcccggg

SEQ ID NO: 368627 - DNA, 510 bp, Homo sapiens
  misc_feature: GZ8MTXP01AFLPT.25.37.D04.1.454.CMB.2.raw
  modified_base (203)..(203): a, c, t, g, unknown or other
  modified_base (262)..(262): a, c, t, g, unknown or other
  modified_base (279)..(279): a, c, t, g, unknown or other
  modified_base (363)..(363): a, c, t, g, unknown or other
  modified_base (381)..(381): a, c, t, g, unknown or other
  modified_base (406)..(406): a, c, t, g, unknown or other
  modified_base (424)..(424): a, c, t, g, unknown or other
  modified_base (434)..(434): a, c, t, g, unknown or other
  modified_base (472)..(472): a, c, t, g, unknown or other
  modified_base (493)..(493): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccaggggaaangccaccctctcctgcagggccagtcagagtgttatcaggtacttagcctggtaccaaanagaaacctggccaggcncccaggctcctcatctatgatgcatccaaagagggccactggcatcccagccaggttcagtggcagtgggggctggggaacagngttcactctcaccatcancagtgtgagcgtagaagtatttgtntagtttattactgtcagnagcgtagcgngtgtcgtcgggtacgtagttcggtcgacggaacgaagngtgagagacaacgacgagtgngcgcacactcgttcgtc

SEQ ID NO: 368628 - DNA, 587 bp, Homo sapiens
  misc_feature: GZ8MTXP01AU3XE.25.37.D04.1.454.CMB.2.raw
  modified_base (252)..(252): a, c, t, g, unknown or other
  modified_base (265)..(265): a, c, t, g, unknown or other
  modified_base (272)..(272): a, c, t, g, unknown or other
  modified_base (276)..(276): a, c, t, g, unknown or other
  modified_base (287)..(287): a, c, t, g, unknown or other
  modified_base (315)..(315): a, c, t, g, unknown or other
  modified_base (319)..(319): a, c, t, g, unknown or other
  modified_base (328)..(328): a, c, t, g, unknown or other
  modified_base (368)..(368): a, c, t, g, unknown or other
  modified_base (499)..(499): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcggtggtttcgtgtaggctgtttaaaagtgtcagtgtgaggtgcagctggcggagtgtggaggagggcctgatccagccgtgggggtccgtgagctctcctgtgcncgctcgtggtcgngtcgtancacncgtctactgtntcgtcggtccgcgcgcgcggagggaggngtgngtgcgtctntagttattatagtactactactacctacctactaacgacncgtacgtacgtacggacggtacgtacttacttactactacagacgactactacgacgacctacctactactactaactaactacgaccgacgacgacgacgacgacgacgacgtcgtcgtacgtacgtcgnggcggacgggagtagttacgttaggttagtttacgttcgttacttaacttaccgttccgttcggtcgggttccggtccggttccgtcg

SEQ ID NO: 368629 - DNA, 548 bp, Homo sapiens
  misc_feature: GZ8MTXP01CX3JE.25.37.D04.1.454.CMB.2.raw
  modified_base (203)..(203): a, c, t, g, unknown or other
  modified_base (240)..(240): a, c, t, g, unknown or other
  modified_base (265)..(265): a, c, t, g, unknown or other
  modified_base (279)..(279): a, c, t, g, unknown or other
  modified_base (301)..(301): a, c, t, g, unknown or other
  modified_base (361)..(361): a, c, t, g, unknown or other
tcagactgtacagtcacgaccggtgctcgatttagtagcatactgttgggtttgggggagaactgctcagttaggacccagagggaaccatggaagccccagctcagcttctcttcctcctgctactctggctcccagatagcaccggagaagttgtgttgacacagtctccagacaccctgtctttgctccgaaggggaaancgcccaccctctcctgcagggccagtcagagtgttancaggtacttagcctaggtaccaaanagaaacctgcagcnccagctctcatctatgatgcanacagacggaccacacggcactccacgaccgacgttcagtgcgagtgggcgtggaacgagngtcactctcacacacacgcagtcgtgaggctagaagtaatttgtatagttattactagttagagacgtagtacgtacgacgtcgtcggtccggtacggtacgttcggttacggtacggacggaacgtacgagtaggagtacgtaacgaacgttacgttagtcgcgtcgactacttacgtcgttcgtc

SEQ ID NO: 368630 - DNA, 631 bp, Homo sapiens
  misc_feature: GZ8MTXP01BC8AQ.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctcgtgggttcagcgttagtcacagctacttgatcgtgggtccgccaggctccgaggggaagggctggagtgcgtctctagtttattatagaccgataactaccacctactaacgcaagactccggtagaacgggccgtattccgttaatcctccaagacgaactaacttcccgaaaggaaccctaccctactaacttacttacaaaattcggaaaccggcccttaggaacgacggacccgaagggaccgacgggtacccgttgtaacttaccgtgtcggcggacgggggatagttacgtaggttggttacgtttcggttactttaacttacctttccgtacggtcggggacctaacgggtttcccgtcggg

SEQ ID NO: 368631 - DNA, 535 bp, Homo sapiens
  misc_feature: GZ8MTXP01DIUK2.25.37.D04.1.454.CMB.2.raw
  modified_base (202)..(202): a, c, t, g, unknown or other
  modified_base (212)..(212): a, c, t, g, unknown or other
  modified_base (238)..(238): a, c, t, g, unknown or other
  modified_base (263)..(263): a, c, t, g, unknown or other
  modified_base (278)..(278): a, c, t, g, unknown or other
  modified_base (309)..(309): a, c, t, g, unknown or other
  modified_base (375)..(375): a, c, t, g, unknown or other
  modified_base (391)..(391): a, c, t, g, unknown or other
  modified_base (457)..(457): a, c, t, g, unknown or other
  modified_base (526)..(526): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgctccaggggaaancgccaccctntcctgcagggccagtcagagtgttancaggtacttagcctaggtaccaaanagaacctggcaggcncccagctctcatctatgatgcatccaaaggnggccacgtggcactcccagccaggttcagtcggcaggtggggctggggaacagtgtcactctcacngtcagcagtctggacncgtagaagttatttgactagttattactgtcaggcagtcgtagctaggttcggtccgtaccgggtntaggtttcggcgagggaaccaaggcgtaggagtaagtcgaaaacgacgttgtgggacctggccaccttntcgttcgtc

SEQ ID NO: 368632 - DNA, 675 bp, Homo sapiens
  misc_feature: GZ8MTXP01ASJVH.25.37.D04.1.454.CMB.2.raw
  modified_base (300)..(300): a, c, t, g, unknown or other
  modified_base (346)..(346): a, c, t, g, unknown or other
tcagactgtacagtcacgaccggtgctcgatttagtagcatactgttgggtttggggagaggagcccagcactgggattccgaggtgtttccattcggtgatcagcactgaacacagaggactcaccatggcgttttggctgagcttgggttttccttgttgctgttttaaaaggtgtccagtgtgaggtgcagctggcggagtcgtggaggaggcctgatccagccgtgggggtccctgagactctcctgtgcagcctctgggttcagcgttagcacagctacttgatcgtcgggtccnccaggcctccgaggggaaggggctggagtgcgtctctagttattanagccgataactaccactactaacgcaacgactccgagaacgggcctaattccttaatcctaccaagacgaactaattcccgaaaggtaaccctacccttactaacttacctttaacaaaacttcggaaaccgtccctaggaacgacggaccgaaggaccacgggtccgttagtaacgttaccgtggttcgggccgggtcgggggttaagtaacttaccggtttaagggttacgggttttaacttttccggttacttttaacccgttaccgttttaaccccgttaacgggtccgggggttacccgttaaccggggtttccccgttccggg

SEQ ID NO: 368633 - DNA, 596 bp, Homo sapiens
  misc_feature: GZ8MTXP01CFREX.25.37.D04.1.454.CMB.2.raw
  modified_base (434)..(434): a, c, t, g, unknown or other
  modified_base (488)..(488): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcatctggcggagtctggaggaggcctgatccagccgtgggggtccctgagactctctgtgcagcctcgtgggttcagtcgttagcacagctacttgatcgtggtccgcaggctccgaggggaagggctggagtgcgtctcgtagtttatttatagccgaataaactacccaccttactaacgcaacgactccgtaggaacgggccacttcctatctcagagacaattccaagaccaccctnaactctaacaaatcgaaccgcctgacgacgccgaaggcacggcgtatacttacnggtcgcggtcggggatacttacgttaggttggttactttcggttacttttaaccttaccgttttcccgtacggtcggggttacccgtaaggggtttccccgttccggg

SEQ ID NO: 368634 - DNA, 608 bp, Homo sapiens
  misc_feature: GZ8MTXP01CZLBP.25.37.D04.1.454.CMB.2.raw
  modified_base (266)..(266): a, c, t, g, unknown or other
  modified_base (268)..(268): a, c, t, g, unknown or other
  modified_base (369)..(369): a, c, t, g, unknown or other
  modified_base (455)..(455): a, c, t, g, unknown or other
  modified_base (481)..(481): a, c, t, g, unknown or other
  modified_base (520)..(520): a, c, t, g, unknown or other
  modified_base (528)..(528): a, c, t, g, unknown or other
  modified_base (536)..(536): a, c, t, g, unknown or other
  modified_base (538)..(538): a, c, t, g, unknown or other
  modified_base (541)..(541): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggtcgttttggctgagtcttgggtttttccttgttgtcttagttttaaaaggtgtccagtgtgaggtgcagcgtggcggagtcgtggaggaggcctgatccgacgccggtgggggtccctgagtctctcctgtncncgtcctcgtcgggttcagtcgttagtcacagtctattgactcgtcggtcccgccgaggccgtccggaggggagggctggagtgtcgtctatagtttattanacgacctaattaactaccctaacctactaaaccgacaacgtaccctacggtaaggaaccgggtacctacttcctatccacaagganaactaactaccgaaagtaccctcctntatcctaagaaatcgaactccaggagacgcgaacgttcncggtcgtntaacttgngnggnggagatagttagttagttgtttacttcttactttcctcgtttcgcggtcggttaccttcggttcctg

SEQ ID NO: 368635 - DNA, 686 bp, Homo sapiens
  misc_feature: GZ8MTXP01ADG7Z.25.37.D04.1.454.CMB.2.raw
  modified_base (341)..(341): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtcgtggaggaggcctgatccagccgtgggggtccctgagactctcctgtgcagcctctgggttcagcgttagcacagctacttgatcgtgggtccgccaggcctccggaggggaacgggggctgggagtgcgtctntagttattagtacgccaataactaccacctactaaacgcaagacctccggtagaaacgggcctattccttaatcctaccaagaacgactaaacttcccgaaaggaacctaccctctaaacttcccttaacgaaaattcggaaaccggtcccctaggaacgacggccggaaggttaccgaacggggtcccgttaggtaaacttaccggttggtgggcccgggagggggttaaataaccttaacggttaaagggtttgggttttaatttcggttaaacttttaacccgttaactttcccccgtaagggtcccggggggttcccttaacgggggttccccctaacggg

SEQ ID NO: 368636 - DNA, 571 bp, Homo sapiens
  misc_feature: GZ8MTXP01AW5AE.25.37.D04.1.454.CMB.2.raw
  modified_base (262)..(262): a, c, t, g, unknown or other
  modified_base (299)..(299): a, c, t, g, unknown or other
  modified_base (343)..(343): a, c, t, g, unknown or other
  modified_base (429)..(429): a, c, t, g, unknown or other
  modified_base (485)..(485): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgcttgttttaaaaggtgtccagtgtgaggtgcagctggcggagtctggaggaggcctgatccagccgtgggggtccctgagactctcctgtgcagcctntgggttcagcgttagcacagctactgatcgtggtccncaggctccgaggggagggctgggagtgcgtctctagtttattanagccgtaatatacccactactaacgcaagactccggtagaacgggccgtattccttatctccagacgacaattccaagaccacctntatctacaaatcgaaacgccctaggacgacgccgaggacacggccgtgtattacgngtcgcggcgggatattcgtagttggttatttcgactttaaccttacctttcccgtagtcggggttaccctaagggttcccgtcggg

SEQ ID NO: 368637 - DNA, 659 bp, Homo sapiens
  misc_feature: GZ8MTXP01ENMZA.25.37.D04.1.454.CMB.2.raw
  modified_base (473)..(473): a, c, t, g, unknown or other
  modified_base (553)..(553): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttggggttttccttgttgctgttttaaaaggtgtccagtgtgaggtgcagctggcggagtcgtggaggagcctgatccagccgtgggggtcctgagctctctgtgcagcctgtgggttcagtcgttagcacagtctactgactcgtcgggtcccgccaggcctaccggagggggaaggggcgtgggagtcgcgtctacgtagtttattatagaccgtataactacccacctactaaccgacaacgaccgtcggtaggaacgggtcctacgtttcctaactcctacgaagacgtaactaacttaccgaacgaaaccctaccccttntaacttccgttaacaaagtcgaaaccggtcccgtaggacgacgaccgtaaggcccgtaacggtccgtagttacttacggnggtcggcgggtacgggataagttacgttaggtttacgtttacgttcttaacgtttaaccgttaccgtttccggtacgggtccgggttacccgttccggttcccgtg

SEQ ID NO: 368638 - DNA, 673 bp, Homo sapiens
  misc_feature: GZ8MTXP01BIKCW.25.37.D04.1.454.CMB.2.raw
  modified_base (298)..(298): a, c, t, g, unknown or other
  modified_base (340)..(340): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgtttaaaaggtgtccagtgtgaggtgcagctggcggagtctggaggaggcctgatccagccgtgggggtccctgagactctcctgtgcagcctgtgggttcagcgttagcacagctactgatcgtgggtccncaggctccgaggggagggctggagtgcgtctctagttattanagcgaataactacccacctactaacgcaagacctccggtagaacgggccgtattccttatcctaccagacgactaacttcccgaacggtaaccctacccttacttaacttacctttaacaaaacgttaccggaaacccgggtccccttaggaacggaacggacccggaacgggacccgaaccggggtcccgttagttaacgtttaccgtggtcggcgggtacgggggataacgttaccgttaggttggttttaacgtttcggttaactttaaccttacccgtttccccgtaacgggtcggggttacccgttaacggggtttccccgttccggg

SEQ ID NO: 368639 - DNA, 568 bp, Homo sapiens
  misc_feature: GZ8MTXP01DRGDH.25.37.D04.1.454.CMB.2.raw
  modified_base (300)..(300): a, c, t, g, unknown or other
  modified_base (343)..(343): a, c, t, g, unknown or other
  modified_base (405)..(405): a, c, t, g, unknown or other
  modified_base (438)..(438): a, c, t, g, unknown or other
  modified_base (491)..(491): a, c, t, g, unknown or other
  modified_base (504)..(504): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctctgggttcagcgttagcacagctacttgatcgtgggtccncaggctcgaggggaagggctggagtgcgtctctagtttattanagccgaataatacccacctactaacgcaagacctcccggtagaacggggtccatttccttancctcagtagactaattcccaaggaaccaccctntactcttacgaaaatcgaacgccctgacgacgcgaggcacggcctgtaattcngtgcggcgggganattcgtagtggtttattcgatttctactttcccgtacgcggggttcctaacgggtttccctcgg

SEQ ID NO: 368640 - DNA, 582 bp, Homo sapiens
  misc_feature: GZ8MTXP01DZ46Q.25.37.D04.1.454.CMB.2.raw
tcagactgtacagtcacgaccggtgctcgatttagtagcatactgttgggtttgggggagaggagcccagcactgggattccgaggtgtttccattcggtgatcagcactgaacacagaggactcaccatggcgttttggctgagctgggttttccttgttgctgtttaaaaggtgtccagtgtgaggtgcagctggcggagtctggaggaggcctgatccagcctgggggtccctgagactctcctgtgcagcctctgggttcagcgttagcacagctacttgatcgtgggtccgccaggctccgaggggaaggggctgggagtgcgtctctagttattatagcgataataccacctactaacgcaagactccgtgaacgggccgattccttatctccagagacaattccgaagacctaccctctaatcttacaaaatcgaaacgccctgaacgagccggagacacgggacctggtaattacgtggtggcggtcgggggatagttacgttaggttggtttaatttcgaatttaaccttactttccccgtacgtcggggttcctaacggggtttccctcggg

SEQ ID NO: 368641 - DNA, 616 bp, Homo sapiens
  misc_feature: GZ8MTXP01CSJTI.25.37.D04.1.454.CMB.2.raw
  modified_base (278)..(278): a, c, t, g, unknown or other
  modified_base (398)..(398): a, c, t, g, unknown or other
tcagactgtacagtcacgaccggtgctcgatttagtagcatactgttgggtttggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtcgtggaggaggcctgatccagccgtgggggtccctgagactctcctgtgcagcctcgtgggttcagcgttagcanagctactgatcgtggtccgcaggctccgaggggaaggggctggagtgcgtctcagtttatttagagaccgaataactcccaacctactaacgcaagactccgtagaacgggccattctanctccagtagacaattccaaggtaacctaccctatactcttaacaaatacgaaccggcccctaggaacgacgcccgaaggaccacggcccgtagtactaccgtggtcggcggacgggggatacttaacggtaggttggtttactttcggaactttttaaccttacccgtttcccgtacgggttaccgggggttcccttaacggggttccccgttccggg

SEQ ID NO: 368642 - DNA, 579 bp, Homo sapiens
  misc_feature: GZ8MTXP01A3JIS.25.37.D04.1.454.CMB.2.raw
  modified_base (284)..(284): a, c, t, g, unknown or other
  modified_base (460)..(460): a, c, t, g, unknown or other
  modified_base (512)..(512): a, c, t, g, unknown or other
  modified_base (520)..(520): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgcttgttttaaaaggtgtccagtgtgaggtgcagctggcggagtcgtggaggaggcctgatccagccgtgggggtccctgagactctcctgtgcagcctcgtgggttcagtcgttagcacngctacttgactcgtcgggtcccgccgaggtcctccggagggggaagggggctgggagtcgcgtctcgtagtttatttatagaccgtaataactacccacctactaacgacaagacctccgtagaacgggcctattaccttatcctcaagacgactaattccgaacgaaccaccctntactctacaaatcgaacgcctagacgagccgagtacacggcctgtattacgngtggcggngggatattacgtagtggttattcgattaactacttccagtcgggcctaaggttcccgtg

SEQ ID NO: 368643 - DNA, 533 bp, Homo sapiens
  misc_feature: GZ8MTXP01E0XKC.25.37.D04.1.454.CMB.2.raw
  modified_base (204)..(204): a, c, t, g, unknown or other
  modified_base (239)..(239): a, c, t, g, unknown or other
  modified_base (262)..(262): a, c, t, g, unknown or other
  modified_base (310)..(310): a, c, t, g, unknown or other
  modified_base (361)..(361): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagaccaccctgtctttgtctccaggggaaangccaccctctcctgcagggccagtcagagtgttancaggtacttagcctggtaccaanagaaacctggccaggctcccaggctcctcatctatgatgcatccaagnggccactggcatcccagccaggttcagtcggcaggtggggctgggaacagngttcactctcaccatcagcagtctggacgcctagaagtattttgctagtttattactgtcaggcagtcgtatcgtaggttcgggcccgttaccgggggtactaggttttcgggccgtagggggaaccaaggcgtgggagatacaaacgacttgtggctgcacatcttgttcc

SEQ ID NO: 368644 - DNA, 661 bp, Homo sapiens
  misc_feature: GZ8MTXP01E0K9U.25.37.D04.1.454.CMB.2.raw
  modified_base (156)..(156): a, c, t, g, unknown or other
  modified_base (195)..(195): a, c, t, g, unknown or other
  modified_base (200)..(200): a, c, t, g, unknown or other
  modified_base (239)..(239): a, c, t, g, unknown or other
  modified_base (262)..(262): a, c, t, g, unknown or other
  modified_base (269)..(269): a, c, t, g, unknown or other
tcagactgtacagtcacgaccggtgctcgatttagtagcatactgttgggtttgggggagaggagcccagcactgggattccgaggtgtttccattcggtgatcagcactgaacacagaggactcaccatggcgttttggctgagcgtgtttcgtntagctgtttaaagtgtcagtgtgagtgcagctgcgagtntgagngctgatccagccgtgggggtccctgagctctcctgtgcncgctcgtgtcagtcgtagcacanctactgntcgtcggtccgcgcgcgtcgaggaggcgtgtgtgtcgtctagtagttattagtacgtaccgtaactaactaccctacctaccgtaaccgacgtaacgtaccgtaccgtacggtacggtaccgtacttaccttactacctacgaacgtaacgtaactaaccgtaaccgtaaccgaaaccctaccctactacttaccttaactaacgtacgacccggtaccgtacgaccgacggaccggacggtaccgtaccggtacgtacgttacgttacgtcggtcggtaacggtacggttaacgtacgttaacgttacggttgttaagtttccgttactttaacccgttaacgtttaacccggtaccttacggggttcccctaacgggttccccgtaacgg

SEQ ID NO: 368645 - DNA, 613 bp, Homo sapiens
  misc_feature: GZ8MTXP01BOXK1.25.37.D04.1.454.CMB.2.raw
  modified_base (345)..(345): a, c, t, g, unknown or other
  modified_base (418)..(418): a, c, t, g, unknown or other
  modified_base (444)..(444): a, c, t, g, unknown or other
  modified_base (513)..(513): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcgtgggttttccttgttgctgtttaaaaggtgtccagtgtgaggtgcagctggcggagtctggaggaggcctgatccagccgtgggggtccctgagctctcctgtgcagcctctgggttcagcgttagcacagctacttgatcgtgggtcccgccagggctccgaggggaaggggctggagtgcgtctcagttatttanacgccgataactacccacctactaacgcaagacctccggtaggaacgggccctattccttaatctaccagganacaacttccaaaggaaccctaccctntactacttagaaaatcgaaccggcccgtagacgaacgcccgaaggaccgtacggccgtgtatttaccgnggtggcgggtagggatagttacgttaggttgtttacgtttcgttactttaaccttaccgtttccgtacggtcggggttaccgtaacgggttcccgtaagg

SEQ ID NO: 368646 - DNA, 565 bp, Homo sapiens
  misc_feature: GZ8MTXP01A4HOO.25.37.D04.1.454.CMB.2.raw
  modified_base (303)..(303): a, c, t, g, unknown or other
  modified_base (348)..(348): a, c, t, g, unknown or other
  modified_base (400)..(400): a, c, t, g, unknown or other
  modified_base (482)..(482): a, c, t, g, unknown or other
  modified_base (497)..(497): a, c, t, g, unknown or other
  modified_base (508)..(508): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgcttgttttaaaaggtgtccagtgtgaggtgcagctgggcggagtcgtggaggaggcctgatccagccgtgggggtccctgagactctcctgtgcagcctcgtgggttcagcgttagcacagctacttgatcgtggtccnccaggctccggaggggaagggctggagtgcgtctctagttattanagcgaatactaccactactaacgcaagctccgagaacgggcctattccttanctaccagagactaacttccaacggaacctaccctactactacttacaaactcgaaaccggtccctagacgacgccgaggacncggctgtactactgngtcggcggganattcgtagtggttatttcgattaactctttcctacgtcgggcctcgggttccgtcgg

SEQ ID NO: 368647 - DNA, 621 bp, Homo sapiens
  misc_feature: GZ8MTXP01DSJ6U.25.37.D04.1.454.CMB.2.raw
  modified_base (372)..(372): a, c, t, g, unknown or other
  modified_base (481)..(481): a, c, t, g, unknown or other
tcagactgtacagtcacgaccggtgctcgatttagtagcatactgttgggtttggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcacgcctcgtgggttcaggtcgttagtcacagctacttgatcgtggtccgccaggctccgaggggaagggctggagtgcgtctctagttattagagccgataactaccacctactaacgcngactccgtagaacgggcctattccttatctccagagactaattccgaagaccacctctatctacaaagtcgaaccggcctgacgacgccgaaggaccgacggtccgttntaacgttacgtggtcggaacggtcgggggaatacgttaacgttagggttcggttttacttttcggttaacgttttaaccttacccgttttcccgtaacgggttccggggttaccgtaacggggttttccccgttccgggg

SEQ ID NO: 368648 - DNA, 659 bp, Homo sapiens
  misc_feature: GZ8MTXP01AHC57.25.37.D04.1.454.CMB.2.raw
  modified_base (356)..(356): a, c, t, g, unknown or other
  modified_base (457)..(457): a, c, t, g, unknown or other
  modified_base (480)..(480): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgcttgttttaaaaggtgtccagtgtgaggtgcagctggcggagtcgtggaggaggcctgatccagccgtcggggggtccctgagactctcctgtgcacgcctcgtgggttcagcgttagcacagctacttgatcgtgggtcccgccaggctccgagggggaggggctgggagtgcgtctcgtagtttattanagccgaataactaccaacctactaacgcaacgactccggtagaacgggcctattccttaatcctaccagaacgactaaacgttcccgggaaacctaccctntactcttaacaaactcgaaaccnccgtaggacgacgccggaaggaccacggccgttagtaacttcgtggtcggcgggaacgggggtattaacgttacgttaggtttagggtttacttttacggactttaccctttaacctttaccccggtaacgggttcgggggcccgttaacgggggtttccccgttaacggggttccccg

SEQ ID NO: 368649 - DNA, 673 bp, Homo sapiens
  misc_feature: GZ8MTXP01CGWBN.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggtttttccttgttgctgttttaaaaggtgtccagtgtgaggtgcagctggcggagtctggaggaggcctgatccagccgtgggggtcctgagactctcctgtgcagcctcgtgggttcagtcgttagcacagctactgatcgtgggtccgccaggctccgagggggaaggggctgggagtgcgtctctagtttattatagaccgtaataatacccacctataacgcaagactccggtaggaacggggtcctatttcccttatccctacgaaggaacaactaaacttcccgaaacggtaaaccctaccccttctaaattccttaaaccgaaattaccggaaaccgtccccgtaggaacgaacggcccggaaaggacccacggggtcccgtgttaacgttcgtggtgggcgggacgggggatacttaccgttaagggttcgttttaagtttccggttaacttttaacctacccttttcccgtaaggtcgggggttaccctaacgggggtttccccttaacggg

SEQ ID NO: 368650 - DNA, 604 bp, Homo sapiens
  misc_feature: GZ8MTXP01CVBJK.25.37.D04.1.454.CMB.2.raw
  modified_base (301)..(301): a, c, t, g, unknown or other
  modified_base (344)..(344): a, c, t, g, unknown or other
  modified_base (400)..(400): a, c, t, g, unknown or other
  modified_base (425)..(425): a, c, t, g, unknown or other
  modified_base (430)..(430): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgtttaaaaggtgtccagtgtggggtgcagctggcggagtctggaggaggcctgatccagccgtgggggtccctgagactctcctgtgcagcctcgtgggtcagcgttagtcacagctacttgatcgtcgggtccncaggctccgaggggagggctggagtgcgtctctagtttattanagcgaactaactaccactactacgacagcctccgtaggaaacgggccattccttancctacagacaacattccaggaaccnccctntactacttacaaatgaaccgcctagacgacgccgaggaccacggtcgtagttataccgtgtaggcgggcgggaagattaccgttaggttggtttatttacgacttttaccgttaacccttttacccgaacggtttcgggggacccttacgggggtttccccttgggttaacccc

SEQ ID NO: 368651 - DNA, 661 bp, Homo sapiens
  misc_feature: GZ8MTXP01EZ47N.25.37.D04.1.454.CMB.2.raw
  modified_base (352)..(352): a, c, t, g, unknown or other
  modified_base (455)..(455): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctctgggttcagtcgttagcacagctacttgatcgtgggtcccgccaggctccggagggggaaggggctgggagtgcgtctctagtttattanagcgaataactacccacctactaacgcaagacctccggtaggaacggggcctaatttcccttaatcctaccagagactaacttcccgaacggaacctaccctntactccttacgaaatcgaaccgccctagacgacgaccgaggaccgacgggtccgttagtacttaccgtggtggccgggcgggggttaataagtttaccgtaagggtttagggtttaactttttccggttaacttttaaccctaccgtttttcccccgtaacgggttcggggggttaccccttaacgggggtttcccccgttcgggg

SEQ ID NO: 368652 - DNA, 548 bp, Homo sapiens
  misc_feature: GZ8MTXP01D947C.25.37.D04.1.454.CMB.2.raw
  modified_base (429)..(429): a, c, t, g, unknown or other
  modified_base (449)..(449): a, c, t, g, unknown or other
  modified_base (487)..(487): a, c, t, g, unknown or other
  modified_base (496)..(496): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtcgtggaggaggcctgatccagccgtgggggtccctgagactctcctgtgcacgcctcgtgggttcagtcgttagcacagctacttgatcgtgggtccgccgaggcctccgaggggaaggggctgggagtcgcgtctctaagtttattagagccgaattaaactacccaacctactaaccgcaaggacctccgggtagaacgggcctattcccttatctcaganacatcagacactctatctanaatgaacgcctgagacgcgagcacggcctgtatactgngcgcggganttacgtgtgtttattcgttacttctactttccagtcgggctcggttccgtcg

SEQ ID NO: 368653 - DNA, 589 bp, Homo sapiens
  misc_feature: GZ8MTXP01DY41W.25.37.D04.1.454.CMB.2.raw
  modified_base (426)..(426): a, c, t, g, unknown or other
  modified_base (434)..(434): a, c, t, g, unknown or other
  modified_base (452)..(452): a, c, t, g, unknown or other
  modified_base (456)..(456): a, c, t, g, unknown or other
  modified_base (517)..(517): a, c, t, g, unknown or other
  modified_base (566)..(566): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttggggtttttccttgttgcttagttttaaaaaggtgtccagtgtgaggtgcagctggcggagtcgtggaggaggcctgatccagccgtgggggtccctgagctctcctgtgcagcctcgtgggttcagtcgttagcacagtctacttgactcgtcgggtcccgccgacggcctaccggagggggaacggggctgggtagtcgcgtctctagtttattatagacgtaataactaccacctactaacgacaacgactcggtagacggcctattccttanctacaganactaattccgaagtaccncctntaagtctaacaaatcgaacgtccgtagacgacgaccggagaccacgggtcctagtattcgnggtcgcggagggatattacgtagtgttatttcgatttaacctcttccgnggtgggcctaacggttcctaacg

SEQ ID NO: 368654 - DNA, 595 bp, Homo sapiens
  misc_feature: GZ8MTXP01DZ7V4.25.37.D04.1.454.CMB.2.raw
  modified_base (344)..(344): a, c, t, g, unknown or other
  modified_base (402)..(402): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctgtgggttcagtcgttagcacagctactgatcgtggtccgccaggctccgaggggaagggctggagtgcgtctctagttattanagccgataaactacccacctacaacgcaagactccgtagaacgggccgtattccttanctccagagacaattccaagaacctacctctatcgttacaaatcgaacgccctaggaacgacgccggaaggacacggccgtagtacttacgtggtggccggtgggggatacgttacgtaggttacggtttatttcggttatttaacctaactttcccgtaggtcgggggttacctaacgggttcccttaacggg

SEQ ID NO: 368655 - DNA, 647 bp, Homo sapiens
  misc_feature: GZ8MTXP01D0J95.25.37.D04.1.454.CMB.2.raw
  modified_base (302)..(302): a, c, t, g, unknown or other
  modified_base (346)..(346): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggtttttccttgttgcttgttttaaaaggtgtccagtgtgaggtgcagctggcggagtcgtggaggaggcctgatccagccgtgggggtcctgagactctcctgtgcagcctcgtgggttcagcgttagcacagctacttgatcgtggtccnccaggctcggaggggaagggctggagtgcgtctcagtttattanagcgaatactaccacctactaacgcaaggactccggtagaacgggccctattccgttatctccaagtagacaaacttccgaacggaaaccacccttactactaccttaacaaaacttcgaaacgggcccctaggacgacggaccgaaggaccgacgggtccgttagtacgtttacgtggtcggcgggcggggagtacgttagttaaggtttgggttttactttcggttaacttttaacttacccgtttttaacccgtaacggttcgggggttacccgttaacgggggtttccccgttgggg

SEQ ID NO: 368656 - DNA, 702 bp, Homo sapiens
  misc_feature: GZ8MTXP01BGWWV.25.37.D04.1.454.CMB.2.raw
  modified_base (279)..(279): a, c, t, g, unknown or other
  modified_base (348)..(348): a, c, t, g, unknown or other
  modified_base (452)..(452): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgctgttttaaaaggtgtcagtgtgaggtgcagctggcggagtctggaggaggcctgatccagccgtgggggtcctgagactctctgtgcacgcctgtgggttcagtcgttagcangtctacttgatcgtcgggtcccgcgaggcctccggagggggacggggtcgtgggtagtcgtcgttcgtntagtttaattagtacggacctaattaaactacccaccctacgtaacgactaagaccctaccggtaggaacggggtcctatttccttaattcccgacaacggtanaacctaaactttccgaaacgtaaccctaccctacttacttacccgttaaactaaacgtaccgaaccgggtcgtaggaacgaccggtaccggacggaccgtcgggttaccgttagttaccgttaggtcggacggggcgggtaagggttatacggtttacgttagggtttacgttttacgtttacgttacttttaacccgtttccgtttaaccggtcggggtccggggttaccgttcccgggtttcccgtcg

SEQ ID NO: 368657 - DNA, 651 bp, Homo sapiens
  misc_feature: GZ8MTXP01A2DWR.25.37.D04.1.454.CMB.2.raw
  modified_base (311)..(311): a, c, t, g, unknown or other
  modified_base (564)..(564): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggtttttccttgttgcttagttttaaaaggtgtcagtgtgaggtgcagctggcggagtcgtggaggaggcctgatccgagccgtgggggtccctgacgactctccgtgtgcacgcctgttgggttcaggcgttagcacagtctactgatcgtcgggtccnccgaggctccggaggggaaggggctgggagtgcgtctacgtagtttattaatagtaccgaataaactacccaacctactaacgacaacgacctccggtacggaacgggtccgtacttccttaatcctacgaagaacactaacttccgaaacggaaccctacccttactacttaccttaacaaacgttaccgaaccggtcccgtaggaacgaccgccggaacggaccgtcggtaccggtatacgttacgtcggnggaacggaggggatagttacgtagttggtttattccgttatttaacctaccgtttccgtagtcggggttccctggtttccccgtcgg

SEQ ID NO: 368658 - DNA, 533 bp, Homo sapiens
  misc_feature: GZ8MTXP01CM4P1.25.37.D04.1.454.CMB.2.raw
  modified_base (427)..(427): a, c, t, g, unknown or other
  modified_base (434)..(434): a, c, t, g, unknown or other
  modified_base (448)..(448): a, c, t, g, unknown or other
  modified_base (468)..(468): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgtttaaaaggtgtccagtgtgaggtgcagctggcggagtctggaggaggcctgatccagccgtgggggtccctgagactctcctgtgcagcctcgtgggttcagcgttagcacagctactgatcgtggtcccgcaggctcgaggggaagggctgggagtgcgtctctagttattagtagccgtaataactaccaccctactaacgcaagactcgtagaacgggtccgattcctatctcagagacaattccagaaccacctntatctanaatgacgcctaganagcgagcacggctgtatacngtgcggtgggatattcgtagtggttattcgattaactcttccgtacgtgggcctaaggttccctg

SEQ ID NO: 368659 - DNA, 682 bp, Homo sapiens
  misc_feature: GZ8MTXP01B31WW.25.37.D04.1.454.CMB.2.raw
  modified_base (251)..(251): a, c, t, g, unknown or other
  modified_base (604)..(604): a, c, t, g, unknown or other
  modified_base (672)..(672): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggtcgttttggctgagtcttgggtttttccttgttgtcttagttttaaaaggtgtcagtgtgaggtgcagcgtggcggagtcgtggaggaggcctgactccgagccggtgggggtcccngacgtactctctgtcgtacgccttgtggttcagtcgttacgtcacgacgtcttacgtgacgttcggtccgggtaccgccgacgggtccgtaccgggaagggggaacgggggtcgtagggtacgtcggtccgtcgttagttagtttaatttagacggacttaaactaaaccgtacctaactaacctacgactaacgtccgtccggtaggaacgggtcctacttaccttactcctacgagtaacgactacaccgaaacgaaccctaccttatactacttaacaactacgaacccgtcgagacgacggccgtaacgcgtaccggtcgttatacgtacgtggcggcggaaggggtanagttacgttagttacgttattccgttattaccgtttcgttcccgtaaggtcgggccttacgggttccncgttaacccg

SEQ ID NO: 368660 - DNA, 685 bp, Homo sapiens
  misc_feature: GZ8MTXP01AN92Z.25.37.D04.1.454.CMB.2.raw
  modified_base (334)..(334): a, c, t, g, unknown or other
  modified_base (344)..(344): a, c, t, g, unknown or other
  modified_base (368)..(368): a, c, t, g, unknown or other
  modified_base (398)..(398): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcttgggttttccttgttgcttagttttaaaaggtgtccagtgtgaggtgcagctggcggagtctggaggaggcctgatccagccgtgggggtccctgagactctctgtgcacgcctcgtgggttcagtcgttagcacagtctacttgatcgtggtccgcaggctcgagggagggctggagtgcgtctntagttattanagcaatactaccactactaacgcngtactcgtagacgggtcctattaccttacnctacgaagacgtaactaacgtaccgaacgtaaccctaccttatacttacgtaacaaacgtaccggaaccggtccgtaaggaaccggaaccggtaccgggaacggtaacccggtacggttaccggtttattaacgttaccggtggggtcgggaacggggtaacgggttaaattacgttaacgggttaggttttacgttttaacgtttccgttaaccgttttaaccctttcccggtttaaccccggtacggggtcccgggggttaccgttaacccgggtttcccgtcgg

SEQ ID NO: 368661 - DNA, 792 bp, Homo sapiens
  misc_feature: GZ8MTXP01AR5TS.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagtcgttagcacagtctacttgactcgtcgggtcccgcgaggctccggaggggaagggctgggagtgcgtctctagtttattatagactaataactacccacctactaacgcaagaccgtccggtaggaacgggtccgtaactttccttaatcctaccgaagtaacgacctaaacttcccgaaacggtaaacccctacccttactaacttccttaaacgaaaacgttaccggaaacccgggttccccgtagggaaaccggacgggaccccggaaacgggacccgaaccgggggttaccccgttaaggtttaacccgtttaacggtggggtaacgggcccgggggtaaacgggggttaaataaacccggtttaacggtttaaacggggttgggttttttaaaccgttttccgggttaaaacctttttaaccccgtttaaccccgttttttaacccccgggtaaacggggttttcccggggggacccccgtttaacggggggttttcccccccctttaacggggg

SEQ ID NO: 368662 - DNA, 589 bp, Homo sapiens
  misc_feature: GZ8MTXP01BSFBH.25.37.D04.1.454.CMB.2.raw
  modified_base (443)..(443): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctctggggttcagcgttagcacagctacttgatcgtgggtccgccaggctccgaggggaaggggctgggagtgcgtctctagtttattatagccgataaactacccacctactaacgcaagactccggtagaacgggcctattccttatcctaccagacgactaattccaaggaaccacccttntaacttcttacaaaatcgaaaccggccctagagacgccgaggtaccacggtccgtgtattacgtggtggcggcgggggatattacgtaggtggtttatttcggatttaacgtctttcccaggtcggggcctaacgggtttccctgg

SEQ ID NO: 368663 - DNA, 745 bp, Homo sapiens
  misc_feature: GZ8MTXP01CN628.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgcttgttttaaaaggtgtccagtgtgaggtgcagctggcggagtcgtggaggaggcctgatccgagccgtggggggtccctgagactctcctgtgcacgcctgtgggttcagtcgttagcacagctacttgactcgtcgggtcccgccgaggcctccggagggggaagggggctgggagtgcgtctacgtagtttaatttagtagtacccgtaaataaactaccctaaacccttaacccgtaaaccgacctaacggaccgttacccgggtagggaaaccggggtcccgtaactttcccttatcccttacccaaaggaacgtaactaaacgttacccgaaacgggtaaacccctaccccttactaacttaccgttaacaaaacgttccgaaacccgggtcccctagggaacgaccggaccggaacggacccgaaccgggtccgttagttaacgttacgtcgggttcggaacgggtcgggggaagtacgttacgttagggtttggtttaacgtttcggttaacttttaaccttaccgttttcccgtacggtcggggttcccgtaacgggtttcccgtaaccggg

SEQ ID NO: 368664 - DNA, 529 bp, Homo sapiens
  misc_feature: GZ8MTXP01A4H15.25.37.D04.1.454.CMB.2.raw
  modified_base (299)..(299): a, c, t, g, unknown or other
  modified_base (344)..(344): a, c, t, g, unknown or other
  modified_base (366)..(366): a, c, t, g, unknown or other
  modified_base (391)..(391): a, c, t, g, unknown or other
  modified_base (393)..(393): a, c, t, g, unknown or other
  modified_base (398)..(398): a, c, t, g, unknown or other
  modified_base (416)..(416): a, c, t, g, unknown or other
  modified_base (432)..(432): a, c, t, g, unknown or other
  modified_base (488)..(488): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctggggggtccctgagactctcctgtgcagcctctgggttcagcgttagcacagctacttgatctgggtcccnccaggctccaggggaaggggctggagtgcgtctcagttatttaanagcaataataccactactaacncaagactcgagaacgggcattctancncaganacaatcaagaaccacctnatctacaaatgacgcngagagacgacgacgacgcgtgtatactgtgcggcgggagattagtagtgttagttnttattaacttacttcctacgtcgggccggtcggttccgtcg

SEQ ID NO: 368665 - DNA, 675 bp, Homo sapiens
  misc_feature: GZ8MTXP01BOEES.25.37.D04.1.454.CMB.2.raw
  modified_base (313)..(313): a, c, t, g, unknown or other
  modified_base (383)..(383): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagattccactggagaaatagtgatgacgcagtctccagccaccctgtctgtgtctccgaggggacagacgcccacccctctcctgcgacgggccagtcagagtatagcgactaacttagcctggtaccagcaagaaacctggccacgggtcccaggcctccgcacgtccgacggtnccactccccgaccgagggtcccagtcgggaacttccgaggccctaggttcgaggtcggctaggtgggtcnggggaacagtccttctctcctaccactatcgacgcgacgccgtagctacgtctacgtacgttatttcgtacttagtttacgtacttacgtagtacgtaataaacgttaaacgttaaaccgttcggtaaccgtttacggttacgggtttaccggaaccggggttaaaccgggaaccgtaacgggtccggtaacgttacgttaaacgaccggtaaacggaacggttacggttcgggttccggaacgtaccggtaacctacccttacgtttccggttcgtttcccgtttaacccg

SEQ ID NO: 368666 - DNA, 739 bp, Homo sapiens
  misc_feature: GZ8MTXP01CBHA1.25.37.D04.1.454.CMB.2.raw
  modified_base (301)..(301): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctctgtgcagcctcgtggttcagtcgttagcacagctacttgatcgtcgggtccnccgaggcctccgagggggaaggggctgggagtgtcgtctcgtaagtttatttagagtccgtaataaactaacccaccttacgtaaaccgccaagacctcccgggtaggaaacggggccctaatttcccttaacgtccctacgaaggacgaacctaacttacccgaaacggtaaccctaccccttactacttaccttaacaaaagttccggaaacccgggtccccgttaaggaaccggaaccggacccgggaaagggtaacccgaccggggttacccgttaggttaacctttaccggtgggtcgggaaccggggacggggggttaataaacgtttacggtttaagggttcgggttttaactttcggttaacttttaacccgttaaccgtttccccgtagggtcgggggttacccttaacggggtttccccgttaacggg

SEQ ID NO: 368667 - DNA, 612 bp, Homo sapiens
  misc_feature: GZ8MTXP01ANBTZ.25.37.D04.1.454.CMB.2.raw
  modified_base (438)..(438): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctctgggttcagtcgttagcacagctacttgatcgtgggtccgccaggctccgaggggaaggggctgggagtgcgtctctagtttatttatagccgaataactacccacctactaacgcaagacctccgtagaacgggccgtattccttatctccagagacaattccaagaaccaccctntactcttacaaatcgaacgcctagacgacgaccgaggaccacggccgtagtacttacgtggtggcgggacgggggatacgttacgttagggttgtttacgtttcgttaactttaacccttaccttttccccgtacggtcgggggttcccgttaacggggttccccgttccgggg

SEQ ID NO: 368668 - DNA, 545 bp, Homo sapiens
  misc_feature: GZ8MTXP01AVFHS.25.37.D04.1.454.CMB.2.raw
  modified_base (204)..(204): a, c, t, g, unknown or other
  modified_base (241)..(241): a, c, t, g, unknown or other
  modified_base (292)..(292): a, c, t, g, unknown or other
  modified_base (378)..(378): a, c, t, g, unknown or other
  modified_base (493)..(493): a, c, t, g, unknown or other
  modified_base (509)..(509): a, c, t, g, unknown or other
  modified_base (522)..(522): a, c, t, g, unknown or other
  modified_base (527)..(527): a, c, t, g, unknown or other
  modified_base (537)..(537): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccgaggggaaanagcccaccctctcctgcagggccagtcagagtgttancaggtactagcctaggtaccaaacagaaacctggccaggcctccaggctcncatctatgatgcagtccaaaggcggaccacgtggaccacgtccccagccgaaggttcaggtcggcgtaggtgggggctggggaacnggaacgttcactctacaccatcagcagtctaggacgtctagaagttattttgacttagtttatactgtcaggcagcgtagcgtagtcggccgtacggggtatggtttcgaccggngggaacctagcgtagngaactacgaacgnttggngctgcacttntcgttgtc

SEQ ID NO: 368669 - DNA, 620 bp, Homo sapiens
  misc_feature: GZ8MTXP01EM7P2.25.37.D04.1.454.CMB.2.raw
  modified_base (254)..(254): a, c, t, g, unknown or other
  modified_base (301)..(301): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtncagcctctgggttcagcgttagcacagctacttgatcgtcgggtccnccaggcctccgaggggaaggggctgggagtgcgtctctagtttatttatagcccgtaataaactaccgacctactaaaccgcaagactccgtgaacgggtcctattcctatctcagacgacaattcccgaagacctaccctactatcttacaaatcaaccggtcccctgaacgacgcccgaaggaccacgggtccgtagtacttaccgtggtacggcggacgggggaatacgttacgtaaggttgggtttatttccgaattttaaccgtaccctttcccgtaacggtcgggggttacccttaacgggggtttccctcgg

SEQ ID NO: 368670 - DNA, 732 bp, Homo sapiens
  misc_feature: GZ8MTXP01EF7DO.25.37.D04.1.454.CMB.2.raw
  modified_base (255)..(255): a, c, t, g, unknown or other
  modified_base (303)..(303): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgcttgttttaaaaggtgtccagtgtgaggtgcagctgggcggagtcgtggaggaggcctgatccagccgtgggggtcctgagctctctgtncacgcctcgtgggttcagcgttagcacagctacttgatcgtgggtccnccgaggctccggaggggaaggggctgggagtcgcgtctactagtttatttagtagaccgtaataactacccacctactaacgcaagacctccggtaggaacgggtccgtaatttcccgttatcctaccaagaacgactaaacttacccaaacgggtaaccttaccctactaacttaccttaactaaaacgtacgtaaacccggtccccttaaggaacggaaccggaccggaacggaacccgtaccgggtaccgttagttaacgtttaaccgtgggttcgggccgggtacgggggttaagtaacgtttaacggttacggtttaaggggttttacttttaccggttaacgttttaacctttacccgttttccccgttaacgggttcccgggggttacccgttaaccggggttttccccggtttaacccggg

SEQ ID NO: 368671 - DNA, 607 bp, Homo sapiens
  misc_feature: GZ8MTXP01B2WCH.25.37.D04.1.454.CMB.2.raw
  modified_base (301)..(301): a, c, t, g, unknown or other
  modified_base (487)..(487): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccaggccgtggggggtccctgagactctcctgtgcagcctctgggttcagcgttagcacagctacttgatctgggtccnccaggcctccgaggggaaggggctgggagtgcgtctcagtttattatagccgataaactacccacctactaacgcaagacctcccggtagaacggggcctatttccttatcctacagagacaacttccaggaaccaccctctatcttacaaatcgaacgccctgacgacgccgaggcacggccgtntacgttaccgtggtggcggcgggggaatacttacgtaggttgggtttaactttcggttactttaaccgttaccttttccccgtacggtcgggggaccctaacgggggtttcccctccggg

SEQ ID NO: 368672 - DNA, 647 bp, Homo sapiens
  misc_feature: GZ8MTXP01CAB48.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagtcgttagcacagctacttgatcgtcgggtccgccgaggctccgagggggaaggggctgggagtgcgtctctagtttattatagaccgtaataactacccacctacaacgcaagacctccgtaggaacgggccgtattcctatcctaccgaagtacgaactaacttcccgaaacggtaaccctacccttctaacttacctttaacaaacttcggaaaccgtcccgtaggacgacgccgaagtaccgacggtccgtgttaacttacgtggtgggcggacggggatacgttacgttaggttggttttaacgttcgttattttaaccgttaccgtttcccgtacggtcggggttaccctaacgggggtttcccttccggg

SEQ ID NO: 368673 - DNA, 722 bp, Homo sapiens
  misc_feature: GZ8MTXP01DZE89.25.37.D04.1.454.CMB.2.raw
  modified_base (255)..(255): a, c, t, g, unknown or other
  modified_base (313)..(313): a, c, t, g, unknown or other
  modified_base (606)..(606): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggaggtctgggaggaggcctgatccagccgtgggggtcctgagactctcctgtncacgtcctcgtggggttcaggtcgttagcacagtctacttgacttcggtcgggtcccnccgaggcctccggaagggggaacgggctgggagtggtcgttcttacgtaagtttatttagacgtaccgtaataaactacccaacctacgtaaaccgctaacgtaccgtacgggtacggaacggggccttactttaccttatcctacgaacgaaacgtacctaaacgttacccgaaaggtaaacccttcccctacttaacttaccgttaacaaaattccgggaaaacggcccccgttaagggaacggaacggacccggtaaggaccgtaccgggtaccgttagtaacgttacgnggtggaaccgggtcgggggaattaacgttacgttagggtttacggtttacttttccggttactttaacttaccgtttccgttacgggcggggttaccgttaacgggttcccgttcg

SEQ ID NO: 368674 - DNA, 786 bp, Homo sapiens
  misc_feature: GZ8MTXP01ANSP9.25.37.D04.1.454.CMB.2.raw
  modified_base (290)..(290): a, c, t, g, unknown or other
tcagactgtacagtcacgaccggtgctcgatttagtagcatactgttgggtttggggaggagaggagcccagcactgggattccgaggtgtttccattcggtgatcagcactgaacacagaggactcaccatggcgttttggctgagcttgggttttccttgttgcttgttttaaaaggtgtccagtgtgaggtgcagctggcggagtcgtgggaggaggcctggactccgagccggtgggggtccctgacgactctcctgtgcacgcctcgtggtcagtcgtagtcacncgtctacttgacgtcgtcgggtcccgccgacggccgtaccggagggggaacggggtcgtagggagtcggtccgttacttacgtaagttttaatttaagtacgacgtaaattaaactaccctaccctaaacgtaccgcgtaacgacccgtacggtacggaacgggtccgtactttcctactcctaccgaagtaaacgaactaaaccgttacccgaacgtaaacccctaccccttacttaacttaccgttaaaccaaaagtaccgggtaaacccgtaccccggtagaaccgggaccggaccggaaacggaacccggtaccgggtcccgttagttaaaccgttccggtgggttcgggaaccggggttacgggggaaattaacggtttaaccggttaagggtttcgggttttaaacttaccggttaaccgtttaccctttaaccccggtttacccgttaacggggttcggggttaaccccgttcccggggtttttccccg

SEQ ID NO: 368675 - DNA, 658 bp, Homo sapiens
  misc_feature: GZ8MTXP01A7YHX.25.37.D04.1.454.CMB.2.raw
  modified_base (290)..(290): a, c, t, g, unknown or other
  modified_base (308)..(308): a, c, t, g, unknown or other
  modified_base (358)..(358): a, c, t, g, unknown or other
  modified_base (427)..(427): a, c, t, g, unknown or other
  modified_base (440)..(440): a, c, t, g, unknown or other
  modified_base (475)..(475): a, c, t, g, unknown or other
  modified_base (490)..(490): a, c, t, g, unknown or other
  modified_base (534)..(534): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttggggttttccttgttgcttagttttaaaaggtgtccagtgtgaggtgcagctgggcggagtcgtggaggaggcctgatccgagccgtggggggtccctgagactctcctgtgcacgcctgtgggttcagtcgttagcacngctatgatcgtgggtccncgaggcctaccggaggggaaggggctggagtgcgtctcgtagtttattanagtacgtataaactacccacctactaaacgctaagacctccggtagaaacggggcctaacttccttaanccctacgaagganacctaacgttacccgaaacggaaccctaccccttntaagttcccttaaanaactcgaaccggtcgtaggacgacggacgtacgaccgtacggtnttacgtacgttacgtgggcggcggggtagggttatacgttacggttaggtttacgttttacttcgttactttaacccttaccgttcccgacgggtccgggttacccgttccgggttcccgtcgg

SEQ ID NO: 368676 - DNA, 540 bp, Homo sapiens
  misc_feature: GZ8MTXP01ALKS1.25.37.D04.1.454.CMB.2.raw
  modified_base (203)..(203): a, c, t, g, unknown or other
  modified_base (213)..(213): a, c, t, g, unknown or other
  modified_base (265)..(265): a, c, t, g, unknown or other
  modified_base (282)..(282): a, c, t, g, unknown or other
  modified_base (514)..(514): a, c, t, g, unknown or other
  modified_base (522)..(522): a, c, t, g, unknown or other
  modified_base (531)..(531): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgctccgaggggaaanagccaccctntcctgcagggccagtcagtagtgttatcaggtacttagcctaggtaaccaanagaaacctggccaggcncccaggctcctcatctatgatgcatccgaagacggccacgtggcaactcccagcaggttcaggtcggcagggtgggctgggaacagtgttcactctacactatcagcagtcgtggacgctagaagttactttgacttagtttatacgtgtcaggcgagtcgtaagcgtagtcggccggttacgggtatggttcggcgtaggggaacagttcgaggagagtaacgaaacgttnaggtcggntcgcacttntcttgttcc

SEQ ID NO: 368677 - DNA, 678 bp, Homo sapiens
  misc_feature: GZ8MTXP01EW8LZ.25.37.D04.1.454.CMB.2.raw
  modified_base (303)..(303): a, c, t, g, unknown or other
  modified_base (379)..(379): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgctgttttaaaaggtgtccagtgtgaggtgcagctggcggagtctggaggaggcctgatccagccgtgggggtcctgagactctcctgtgcacgcctcgtgggttcagtcgttagcacagtctacttgatcgtggtccncgaggctccgaggggagggctgggagtgcgttctacgtagtttattatagccgaataactacccactactacgacngacctcggagaacgggtcctattccttatcctcgaagacgaactaacttccgaaacggtaacctaccccttacttaacttaccttaacaaaacgttccggaaaccgggtccccttaggggaacgacgggacccggaacgggtaccgtaaccgggtcccgttagttaacgttaccgtggtcgggcggcgggggaaatacgttaaccgttagggtttagtttacgttttacggttacttttaaccgtaccttttccccgtacggttcgggggttaccctaacgggggtttccccgttcggg

SEQ ID NO: 368678 - DNA, 644 bp, Homo sapiens
  misc_feature: GZ8MTXP01EZR0O.25.37.D04.1.454.CMB.2.raw
  modified_base (424)..(424): a, c, t, g, unknown or other
  modified_base (461)..(461): a, c, t, g, unknown or other
tcagactgtacagtcacgaccggtgctcgatttagtagcatactgttggggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccgagccgtgggggtccctgagactctctgtgcagcctcgtgggtcagtcgttagcacagctattgactcgtcgggtcccgccgaggcctaccggaggggaaggggcgtggagtcgcgtctgtagttattagtagaccgtaataaactacccgaacctacgtaaacgcaagtacctccggaggacgggtcctattccttancctacagacgactaacgttcgaacggaacctaccctntatacctacaaatcgaaccggcctaggacgacggaccgacggaaccgtcggtaccgtaggtaacttacggtcggcggcgggtacgggggaaatacgttaacgttaggttaggtttaaccgtttgactttaaaccgttccgtttaacccgtacggtcggggttaccgttcgggtttcccgtcgg

SEQ ID NO: 368679 - DNA, 576 bp, Homo sapiens
  misc_feature: GZ8MTXP01EANLV.25.37.D04.1.454.CMB.2.raw
  modified_base (214)..(214): a, c, t, g, unknown or other
  modified_base (372)..(372): a, c, t, g, unknown or other
  modified_base (474)..(474): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggnggcctgatccagccgtgggggtcctgagctctcctgtgcagcctcgtgggttcagtcgttagcacagctacttgattcgtgggtcccgcaggctccgagggggaagggctggagtgcgtctctagttattatagaccgataataccactactaacgcngactcgtagaacggccgtatttctatctcaagagacaacttaccaacgaaccacctctattcttaacaaatcgaacgcctgacgagaccgagacgcggcgtntatactgtggcggcgggagattacgtaggttacggttatttcggttatttaacctacctttcccgtacggtcggggttaccttaacgggttcccgttaacgg

SEQ ID NO: 368680 - DNA, 678 bp, Homo sapiens
  misc_feature: GZ8MTXP01AITKT.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgcttgttttaaaaggtgtccagtgtgaggtgcagctggcggagtcgtggaggaggcctgatccaggccgtgggggtccctgacgactctcctgtgcacgcctcgtgggttcagtcgttagtcacagtctactgactcgtcgggtccgcgaggcctacggaggggaaggggctgggagtgcgtctactagtttatttagtagaccgtaataaactaccctaacctacgtaaaccgcaacgtacctccgggtaggaacggggtccctactttccgttactacctaccaagacgtaactaaacgttccgaacggaacctacccttactacttaccgttaacaaagttaccgaaaccggtcccgtaggacgaccggaccgaacggaccgacggtaccgttagtaacttccgtggtcggcggacgggggatacgttacgttaaggttggtttacgtttcgttaactttaaccttacgtttcccgtacgggtcgggttaccgtaacgggttcccgttccgg

SEQ ID NO: 368681 - DNA, 652 bp, Homo sapiens
  misc_feature: GZ8MTXP01DITJK.25.37.D04.1.454.CMB.2.raw
  modified_base (267)..(267): a, c, t, g, unknown or other
  modified_base (269)..(269): a, c, t, g, unknown or other
  modified_base (376)..(376): a, c, t, g, unknown or other
  modified_base (568)..(568): a, c, t, g, unknown or other
tcagactgtacagtcacgaccggtgctcgatttagtagcatactgttggggtttgggggggagaggagcccagcactgggattccgaggtgtttccattcggtgatcagcactgaacacagaggactcaccatggcgttttggctgagtcttgggtttttccttgttgtcttagttttaaaaggtgtccagtgtgaggtgcagcgtggcggagtcgtgggaggaggcctgactccgagccggtgggggtccctgagactctcctgtncngtcctcgtgggttcagtcgttagcacagtctaacttgactccgtgggtcccgccgaggcctccggagggggaagggcgtaggagtgcgtcttacgtagtttaattanagacctaataactaccacctactaacgcaagtactccggtaggaacgggtcctacttcttactcctacaaggaacactaacttacccgaaagtaaccctacccttcttaataccgttaacaaaagtccgaaaccgtccctaggaacgaccgcgaacgcgacggtacctgtaactacgtggcgcgggtagggntaacttagttagttgtttactttcgaaccttttaactacccgttttccaacgggcgggttaccctaacgggtttcccctaacgg

SEQ ID NO: 368682 - DNA, 685 bp, Homo sapiens
  misc_feature: GZ8MTXP01BK28J.25.37.D04.1.454.CMB.2.raw
  modified_base (307)..(307): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttggggttttccttgttgcttagttttaaaaggtgtccagtgtgaggtgcagctggcggagtctggaggaggcctgatccagccgtgggggtcctgagctctcctgtgcagcctcgtgggttcaggtcgttagcacagtctacttgatcgtcgggtccnccgaggcctccggagggggaacgggggctgggagtgcgtctctaagtttattagtacgaccgtaataaactacccaaccctaactaaccgcaacgtaccgtccggtacggaacggggtaccctagttccttactcctaccaagaacgaactaaacttcccgaaacggaaccctacctactacttaccttaacaaatcgaaaccggccctaggaacgacgaccggacgaccgacggtccgtgttacgttacgtggtggccgggaggggttatacgttacgttaggttaggtttaacgtttccggttaaacttttccttaaccgttttcccgtaacggttcggggttacccgttaaccggggtttcccgttaacccgggg

SEQ ID NO: 368683 - DNA, 648 bp, Homo sapiens
  misc_feature: GZ8MTXP01D6RU4.25.37.D04.1.454.CMB.2.raw
  modified_base (312)..(312): a, c, t, g, unknown or other
  modified_base (366)..(366): a, c, t, g, unknown or other
  modified_base (464)..(464): a, c, t, g, unknown or other
  modified_base (534)..(534): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagtcttgggtttttccttgttgcttagttttaaaaggtgtccagtgtgaggtgcagctggcggagtcgtggaggaggcctgagtccagccgtgggggtccctgagactctcctgtgcagcctgtgggttcagtcgttagcacagtctacttgactcgtcgggtcccnccgaggcctaccggagggggaagggctgggagtcgtcgtctactagtttattanagaccgaataactaccctacctactacgacaagactcggagaacgggtctacttccttatcctacaaggaacactaacttacaaacggaacctacctntacgtcttaacaaacttcgaaccgcctagaacgacggacgaacggaccacggtcgtacgttagtttacgnggtcggcgggtaggagtaacgttacgttaggtttacgtttacgtttacgttaactttaacctttacccgtttaaccgtacgggtccgggttacccgttaaccggttcccgtcgg

SEQ ID NO: 368684 - DNA, 751 bp, Homo sapiens
  misc_feature: GZ8MTXP01BTZ6A.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgcttgttttaaaaggtgtccagtgtgaggtgcagctggcggagtcgtggaggaggcctgatccagccgtgggggtccctgagactctcctgtgcagcctgtgggttcagtcgttagcacagctacttgatcgtgggtccgccaggctccggaggggaaggggctgggagtgcgtctctagtttatttatagaccgtataactacccgacctactaacgcaagactccgtagacgggccgattccttatctacagacgaactaacttacccgaacggaaaccctaccccttactaacttccctttaacaaaacgtttccggaaacccgggtcccccgttagggaaccggaacgggacccccggaaagggacccgtaacccggggtcccggtttagttaaacgtttaacccgtggggttacgggaacccggggtcggggggttaaactaacgtttaaccggttaaagggtttgggtttttaaacgttttccgggttaaacttttaaccccgtttacccgtttttcccccgttaaacggggttccggggggttacccccgtttaaccgggggttttcccccgtttccgggg

SEQ ID NO: 368685 - DNA, 663 bp, Homo sapiens
  misc_feature: GZ8MTXP01BEYDK.25.37.D04.1.454.CMB.2.raw
  modified_base (283)..(283): a, c, t, g, unknown or other
  modified_base (396)..(396): a, c, t, g, unknown or other
  modified_base (558)..(558): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgcttgttttaaaaggtgtccagtgtgaggtgcagctggcggagtcgtgggaggaggcctgatccgagccgtgggggtccctgagactctcctgtgcagcctcgtgggttcagtcgttancacagctacttgatcgtcgggtcccgcgaggcctccggagggggaaggggctgggagtcgcgttctactaggtttattagagaccgtaataaactacccacctactaacgacncgactccggtagaacgggtccgtacttccttatcctaccgaggacaactaaacttccgaaacgtaacctcccttctaagttacctaacgaaaatccggaaaccggtccctaggaccgaacggcccgaaggaccgacggtcccgttagttaacttcgttcggnggaaccggggagggttaatattacgttaggttcggtttactttcggaacttttaaccttcccgtttaaccgagggttcggggacccgttaagggtttcccctggg

SEQ ID NO: 368686 - DNA, 768 bp, Homo sapiens
  misc_feature: GZ8MTXP01C22KY.25.37.D04.1.454.CMB.2.raw
  modified_base (336)..(336): a, c, t, g, unknown or other
  modified_base (346)..(346): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgtttaaaaggtgtccagtgtgaggtgcagctggcggagtctggaggagcctgatccagccgtggggggtccctgagactctcctgtgcagcctctggggttcagcgttagcacagctacttgatcgtgggtcccgccagggctccgagggggaagggctggagtgcgtctnagttatttanagccgaataactacctactactaaacgccaagacttacccgggagaaacggggtcctaactttcccttaaatcctaacccaagggaaacgaaactaaactttcccggaaacgggtaaaacccctaaccccccttcgttaaattaccccttttaaccaaaaaatttccggaaaaccggggtccccccgtagggaaaccggaacggaccccggggaaggttaacccgaaccggggtcccgtacggtttaactaaacgtttgggcggtaacccggggacggggggaactaaagtttacccgtaaagggtttcggggtttaaaagtttttccgttaaacgttttaacccttaaacccgtttttccccggttaaaccccgtgggggggttacccccgttaaacgggggttttccccccgttaacggg

SEQ ID NO: 368687 - DNA, 666 bp, Homo sapiens
  misc_feature: GZ8MTXP01DIZYB.25.37.D04.1.454.CMB.2.raw
  modified_base (282)..(282): a, c, t, g, unknown or other
  modified_base (286)..(286): a, c, t, g, unknown or other
  modified_base (306)..(306): a, c, t, g, unknown or other
  modified_base (352)..(352): a, c, t, g, unknown or other
  modified_base (545)..(545): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggtttttccttgttgcttagttttaaaaggtgtccagtgtgaggtgcagctggcggagtcgtggaggaggcctgatccagccgtgggggtccctgagactctcctgtgcagcctcgtgggtcagtcgttancacngtctattgatcgtggtcccncgaggctccggaggggagggctgggagtgcgtctctagtttattanagaccgaataactacccaacctactaacgcaacgaccgtccggtagaacggggtcctatttccttaactctacgaagaacgactaacttccgaaacgtaacctacccttatacttaccttacaaattccgaaaccggtcccgtaggaacgacggacccggaaggaccgaccggtaccgtagttaacttaccgngggtacggcgggacggggttagtaacttacgttaaggtttcggttttaatttccggttacttttaacccgttacttttcccgtaacgggtcggggttaccgtaacgggtttcccgtaacgg

SEQ ID NO: 368688 - DNA, 769 bp, Homo sapiens
  misc_feature: GZ8MTXP01EOEWB.25.37.D04.1.454.CMB.2.raw
  modified_base (259)..(259): a, c, t, g, unknown or other
  modified_base (306)..(306): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgcttgttttaaaaggtgtccagtgtgaggtgcagcgtggcggagtcgtggaggaggcctgatccaggccgtgggggtcctgagactctcctgtgcngcctcgtgggtcagtcgttagtcacagctactgatcgtcgggtcccncgaggccgtccggaagggggaaggggtcgtgggagtcgtccgttcgtactaagtttatttagtacgaccgtaactaaactaaccctaacctaaccgtaaacgacctaacggtacccgttccgggtagggaaccgggtacccgttactttaccctttaactccctaaccaaggaacgtaacctaaaacttcccgaaaaccggtaaaccctacccttacttaacttacccgttaacaaaagttccgaacccggtccccgtaggaacgaccgggacccgaaggacccgtacgggtacccggttagtaacgttaccgtgggtccggaaggggtaacccgggggttataaaccgtttaacggttacggttttaggtttaacttttccggaactttttaacccttaccccgttttaacccggtaaccgggtcgggggttaccccgttaacggggttttcccccgtcggg

SEQ ID NO: 368689 - DNA, 666 bp, Homo sapiens
  misc_feature: GZ8MTXP01EUEZL.25.37.D04.1.454.CMB.2.raw
  modified_base (309)..(309): a, c, t, g, unknown or other
  modified_base (497)..(497): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgcttagttttaaaaggtgtccagtgtgaggtgcagctggcggagtcgtggaggaggcctgatccaggccgtgggggtccctgagactctcctgtgcagcctcgtgggttcagtcgttagcacagtctacttgatcgtcgggtccnccgaggcctacggagggggagggctgggagtcgcttctacgtagtttattagagaccgaataactacccacctactaaccgacaacgtactccgggtaggaccggggtccttactttcccttaactccctacgaacgacgaacctaacttacccgaaacgtaaccctaccctactacgttaccttaanaaacgttcgaaccggtccctaggacgacgaccggaacgccgacggtccgttgtacttacgtggtcgaaccggggtgggatacttacgtaggtttgttaacgtttcgttaactttaacctttaccgtttcccgtaggtcggggttaccctaacgggtttcccgtaaccgg

SEQ ID NO: 368690 - DNA, 615 bp, Homo sapiens
  misc_feature: GZ8MTXP01AZ57A.25.37.D04.1.454.CMB.2.raw
  modified_base (203)..(203): a, c, t, g, unknown or other
  modified_base (238)..(238): a, c, t, g, unknown or other
  modified_base (262)..(262): a, c, t, g, unknown or other
  modified_base (290)..(290): a, c, t, g, unknown or other
  modified_base (310)..(310): a, c, t, g, unknown or other
  modified_base (362)..(362): a, c, t, g, unknown or other
  modified_base (364)..(364): a, c, t, g, unknown or other
  modified_base (397)..(397): a, c, t, g, unknown or other
  modified_base (408)..(408): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgctccgaggggaaangccaccctctcctgcagggccagtcagagtgttancaggtacttagcctggtaaccaanagaaacctggccaggctccaggctcctnatctatgatgcatccaaggnggccacgtggccactcccagccaggttcaggtcgcaggtggggctgggaacngngttcacgtctcaccatcgagcagtccgtggacnccgtgaagttnttttcgacttagttttattacgtgtacgagggacgtacggtacgtacggtcgtaagggttcccgggtacccggtttacccggggggtacttacggggttttccggggacccggtaacgggggaaccctaaagggttccggtagggaagtaacgtaacgaaaacggttcgttaggttcgggcctcggaccacttacgtcgttcgttcc

SEQ ID NO: 368691 - DNA, 656 bp, Homo sapiens
  misc_feature: GZ8MTXP01DLQHY.25.37.D04.1.454.CMB.2.raw
  modified_base (200)..(200): a, c, t, g, unknown or other
  modified_base (263)..(263): a, c, t, g, unknown or other
tcagactgtacagtcacgaccggtgctcgatttagtagcatactgttgggtttgggggggagaggagcccagcactggggattccgaggtgtttccattcggtgatcagcactgaacacagaggactcaccatggcgttttggctgagcgtggttttcgtgtaggctgtttaaaagtgtcagtgtgaggtgcagctgggnggagtcgtggaggacgcgtgactcgacgtcggtcggggtccgtgtacgtactctcgtgtcgcncgtcgtcgtggtcgtagtcgtacgtacacatctacgtgtgtcgtcggtcgcgcgtcgacgagggaggtgtggagtcgtcgtctattagttattagtagtacgtaactactaacctaacctacgtaacgtacgtcgtacgtacggtacggtacggtaccgttacttacttactactacgtaacgtaacgtaactaacgtaacgtaacgtaacctacctactacttactaactaacgtacgacgtacgacgaacgacgacgacgacgtacggtacgtacgtacgtacgtcggtcggtaacggtaggttagtaacgttagttacgttagttacgtttacttacgtttaaccgtttaccgttccggttacggtaccggttaccggttcggttcgtcg

SEQ ID NO: 368692 - DNA, 612 bp, Homo sapiens
  misc_feature: GZ8MTXP01A1A58.25.37.D04.1.454.CMB.2.raw
  modified_base (367)..(367): a, c, t, g, unknown or other
  modified_base (396)..(396): a, c, t, g, unknown or other
  modified_base (418)..(418): a, c, t, g, unknown or other
  modified_base (457)..(457): a, c, t, g, unknown or other
tcagactgtacagtcacgaccggtgctcgatttagtagcatactgttgggtttggggagaggagcccagcactgggattccgaggtgtttccattcggtgatcagcactgaacacagaggactcaccatggcgttttggctgagcttgggttttccttgttgtcttagttttaaaaggtgtccagtgtgaggtgcagctggcggagtcgtgggaggaggcctgactccgaggccggtcggggggtccctgacgtacctctcctggtgcacgcctcgtgggttcagtcgttagcacagtctactgactcgtcggtcccgcgaggcctccggaggggagggcgtgggagtgtcgtctactagttattanagtaccgaataactaccactactaacgcngactcgagacggctacttctanctacagacaacactacacgaacctctacgtacttctaanaacgtacgaccgcgtagacggacgaccggacgaccgacgggtaccttagtaacttcgtcggcggggccggtaggggttatagttacgtaggttagttacgttcgttaacttcgttacccgttcgtacgggtcggttaccgttcggttccgtccgg

SEQ ID NO: 368693 - DNA, 770 bp, Homo sapiens
  misc_feature: GZ8MTXP01EQKEM.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgtttaaaaggtgtcagtgtgaggtgcagctggcggagtcgtggaggaggcctgatccaggccgtgggggtccctgagactctcctgtgcagcctgtgggttcagtcgttagcacagctatgatcgtcgggtccgcgacggctccggagggggaaggggctgggagtcggccgttcgtacgttagtttatttagtacgaccgtaaattaaactacccaaccctacctaaaccgcaacgtaccgtccgggtaggaaccgggaccgttacttcctttaactcctacccgtaaggacgtaaacctaaacttcccgaaacgggtaaccctaccctacttaaccttccttaactaaaaacgttcggaaaccccgggtccccgtaggaaacggaccgggaccccggaacggacccggtaccggggtacccggttgttaaaccgttacgttcggggcggaacggggtaaccgggggttagtaaccctttacgggttaaggtttaccggggttttaactttccgggttaaacttaaccctttttaacccgtttcccccgttaaggggttaccgggggttccccggtttaacggggttttcccccgttccgggg

SEQ ID NO: 368694 - DNA, 635 bp, Homo sapiens
  misc_feature: GZ8MTXP01DP43J.25.37.D04.1.454.CMB.2.raw
  modified_base (271)..(271): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgttctttgtctccgaaggggaaagacgccaccctctcctgcagggccagtcagagtgttatcgaggtacttagcctaggtaacccaaanagaaacctggccaaggctcccaggcctcctcatctatgatgcatccaagacggccacgtggcactcccagcctaggttcaggtcggcaggtggggctggggaacagtgttcactctcaccatcagcagtctgggatcctagaaagttgttttgacttagtttaacttacgttgtaccgagggtcaggtaccgttaggtcgttaacggtttcgggcccggtttacccgggggttacgttacgggttttacgggacccggttaacgggggaaccctaaagggcggttaggaacgtaacgttaccgaaaacggttacgttgggttaaggccgttcggacccgtacgttacttcgttcgtttaacccg

SEQ ID NO: 368695 - DNA, 780 bp, Homo sapiens
  misc_feature: GZ8MTXP01ASYNZ.25.37.D04.1.454.CMB.2.raw
  modified_base (302)..(302): a, c, t, g, unknown or other
tcagactgtacagtcacgaccggtgctcgatttagtagcatactgttggggtttgggggggagaggagcccagcactgggattccgaggtgtttccattcggtgatcagcactgaacacagaggactcaccatggcgttttggctgagcttgggttttccttgttgcttgttttaaaaggtgtccagtgtgaggtgcagctggcggagtctggaggaggcctgatccagccgtgggggtcctgagactctctgtgcagcctctgggttcagtcgttagcacagctacttgatcgtgggtccnccaggctaccgaggggagggctggagtgcgtctctagtttattagtacgaccgtataactaccctacctacctaaaccgccaacgtaccgtcccggtaggaaacgggccgtaacttcctttaactcccttaccgaaggtaacgaacctaaacgttacccgaaacgggtaaaccctaccccgttacttaaacttaccctttaaacggaaaacttccgggaaaacccgtccccgttaggaacggaaccggggttaccccgacggggtaaacccgaacccgggggtttcccgttaggttaacctttaaccgttcgggtacgggcccggggtacggggggttaactactttaaaccggttaagggttttacgggttttaaatttttccggaaacgtttttaacccctttaacccttttccccccgtaacggggttaccggggggttccccttaacggggggtttttcccccttaacccgggg

SEQ ID NO: 368696 - DNA, 643 bp, Homo sapiens
  misc_feature: GZ8MTXP01DKDE5.25.37.D04.1.454.CMB.2.raw
  modified_base (204)..(204): a, c, t, g, unknown or other
  modified_base (270)..(270): a, c, t, g, unknown or other
  modified_base (288)..(288): a, c, t, g, unknown or other
  modified_base (302)..(302): a, c, t, g, unknown or other
  modified_base (628)..(628): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctccagatagcaccggagaagttgtgttgacacagtctccagacaccctgtctttgtctccgaaggggaaanacgcccacctctcctgcgagggccagtcagtagttgttatcaggtacttagcctaggtaaccaaanacgaaacctggccaggcncccgaggcctcctnatctatgatgacactaccgaaaggacggcccagtcggcactcccgagcctaggtcaggtcggcgaggtggggctggggaactaggtcgttcactctaccacatcgagctagtcgtaggactaccgtaggtaaacgtttgttttacgactttaaggttttaacttaacgttgttaccaggggtcaaggtccgtaggccgttagggttccggtcccgggttacgggggttacttaggggtttccgggaacccggtaagggggaaacccaagggttccgtagggttaagaacgtaacgaaaacgttcgttggtcggctcgacaccgttnttcgttcgtttaacc

SEQ ID NO: 368697 - DNA, 672 bp, Homo sapiens
  misc_feature: GZ8MTXP01EZO3B.25.37.D04.1.454.CMB.2.raw
  modified_base (518)..(518): a, c, t, g, unknown or other
  modified_base (526)..(526): a, c, t, g, unknown or other
  modified_base (579)..(579): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagtcttgggttttccttgttgcttagttttaaaaggtgtccagtgtgaggtgcagctggcggagtcgtggaggaggcctgatccgacggcccggtggggggtccctgacgtactctccgtgtgcacgtcctcgtggggttcaggtcgttaagtcacagtctaacttgatcgtcgggtccccgcgaggtcctaccggaggggaaggggctgggagtcgcgttctcgtagtttattagacgtccgtaataaactacccctaacctaacctaaaccggactaacgtaccgtaccggtagggaaccggggtccctaactttcccttaaactcccttacgaagtaacgaacctaacttccgaaacgaacctacccctntactctanaaatcgaaacggccctagagcgaccgagacgtcggtccgtagttacttacggnggcggcggtagggttatacgttagtaggttgttacgtttcgttactttaaccgttccgtttccgtcgggtcggttaccgttccggttccgtcg

SEQ ID NO: 368698 - DNA, 655 bp, Homo sapiens
  misc_feature: GZ8MTXP01AHRHX.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgcttagtttttaaaaggtgtccagtgtgaggtgcagctggcggagtcgtggaggaggcctgatccgaggccgtgggggtccctgagacctctcctgtgcagcctcgtggttcagtcgttagcacagtctacttgatcgtcgggtcccgcgacggcctaccggagggggaacgggcgtggaggtcgcgttctacgtagtttattagtacgaccgtaataaactacccgacctaacgtaaccgacaacgaccgtccggtaggaacggtctactttccttatcctacagaacgtaactaacgttcccgaaacggtacccacccttctaacgttctaacaaacgttacgaaaccgtcgtaggacgacggccgaaggacgtcggtccttagtcttacgtgtcgggcggcgggatattacgttaggttggtttactttcgttactttaaccgttaccgtttcccgtagggtccgggttaccgttcggttcccgtcgg

SEQ ID NO: 368699 - DNA, 769 bp, Homo sapiens
  misc_feature: GZ8MTXP01DREFG.25.37.D04.1.454.CMB.2.raw
  modified_base (316)..(316): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagtcttgggtttttccttgttgtcttagttttaaaaggtgtccagtgtgaggtgcagcgtggcggagtcgtggaggaggcctgactccgagccggtgggggtccctgacgtctctccgtgtcgcacgtcctgtggttcagtcgttagcacagtctactgatcgtcggtccncgaggtcgtaccggagggggaacgggctgggacgtgtcgtcttagttaagtttattaagacgtaccgtaaactaaactaccctaacctaacctaaaccggacctaacgacccgttaccgggtaagggtaaaccggggtacccttaactttcccttaacttcccgtaacccgaaagtaaaccgtaacttaaaccgttacccgaaaacggtaacccctaaccctttctaaacggttacccttaaacgaaaacgttaccggaacccggtaccccgttaggaaaccggaccgaccgggttaaccggacgtacccggtaccgttaagtaccgttacgcgggtcggaacgggacgggttataactttaacggttggtttaggtttaactttcgaacgttttaaccccttaccgtttccccgaagggtcgggttacccgttaaccgggttttccccgtcg

SEQ ID NO: 368700 - DNA, 868 bp, Homo sapiens
  misc_feature: GZ8MTXP01EA6HU.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggtcgttttggctgagtcttgggtttttccttgttgcttagttttaaaaaggtgtccagtgtgaggtgcagcgtggcggagtcgtgggaggaggcctgatccgaggccgtcgggggtccctgacgtactctctgtgcacgtcctgtgggtcagtcgttagtcacagtcttactgtactcgtcgggtcccgaccgacgggtccgtaccggagggggtaacggggtcgtagggtacggttcgtccgttccttagttaagttttagtttaatacggtaccgtaaacttaaaacctaacccctaaaccctttaaccgtaaacccgaccgtaaccggtaacccgttcccgggttaacggggtaaaccggggtacccccggttaaacgttttacccgtttaactaccccgttaaccgaaacggtaaacggtaaccttaaacgttacccgaaaacggttaacccctaacccctttacttaaacttcccgttaaaactaaaccgttaccgggtaaacccccgtccccggttaaaggggaaccggtaaccccggtacccggggaaccggttaacccgacccggggtttaccccggttagtttaaaccgtttacggtcgggttcgggaacggggtaacgggggataacgtttacgttaaggtttacgttttagtttcgaactttttaacccgtaacctttcccggtaggtccgggggttacctaaccggggttttcccgtaaccgg

SEQ ID NO: 368701 - DNA, 702 bp, Homo sapiens
  misc_feature: GZ8MTXP01B01UX.25.37.D04.1.454.CMB.2.raw
  modified_base (364)..(364): a, c, t, g, unknown or other
  modified_base (394)..(394): a, c, t, g, unknown or other
tcagactgtacagtcacgaccggtgctcgatttagtagcatactgttggggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtcgtggaggaggcctgatccgagccgtgggggtccctgagactctcctgtgcagcctcgttgggttcagtcgttacgtcacagtctacttgatcgtcgggtccgccgaggcctccggagggggaagggggcgtgggagtgcgtctctagtttatttanagtaccgataactaccacctactaacgacngactccgagacgggtcacttctactctaccagacgacaacttccgaacggaacctacccgttcttaacttaccttaacgaaacttcggaaaccgggtccccgttaggaacggaaccggccggaacgggtaaccgaccgggtacccggttagttacgtttaccggtggtcgggaacggggtacgggggaagtacgtttacggttaggttacgggttttacgtttccggttacttttaaccgttacccttttaacccggtccgggttacgggggttcccggttaaccggggtttccccgttaaccggggg

SEQ ID NO: 368702 - DNA, 778 bp, Homo sapiens
  misc_feature: GZ8MTXP01CH5Z7.25.37.D04.1.454.CMB.2.raw
  modified_base (308)..(308): a, c, t, g, unknown or other
  modified_base (657)..(657): a, c, t, g, unknown or other
  modified_base (669)..(669): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggtcgttttggctgagtcgttgggtttttccttgttgtcttagttttaaaaggtgtccagtgtggaggtgcagcgtgggcggagtcgtgggaggaggcctgactccgaggtcccggtcggggggtccctgacgtactctcctgtcgcacgtcctgtgggttcaggtcgttagcacncgtcttacttgactcggtcgggtcccgccgaggcccgtaccgggagggggtacgggggcgtgggtaggtcggaccgttcgtacgtttagtttaatttacgtagtacccgtaataaactaccctacctaacgtaacgactaacgtaccgtaccggtacgggaacgggtaccttactttaccttactacccttacgaaagtaaccgtaaacctaaaccgttcccgaaaacggtaaacccctaccctttacttaaacgttccttaaaacaaacgttccggaaacccggtcccggtaaggaaccggaccggccggaacggtacccgacggttccgtagttaacgttcgtgggngggtaaccgggngggttaaactgtttaggttaaacgggtttggtttacctttgttaccttttaacccgttaccccgtttaaccggtcggtccggggttacccgtcgggtttccccgtccgg

SEQ ID NO: 368703 - DNA, 704 bp, Homo sapiens
  misc_feature: GZ8MTXP01BYPLH.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgcttagttttaaaaggtgtccagtgtgaggtgcagctggcggagtcgtggaggaggcctgatccgagccgtgggggtccctgagactctctgtcgcagcctgtgggttcagcgttagcacagtctacttgactcgtcgggtccgccgaggcctccggaagggggaacgggggctgggtagtcgcgttctacgttagtttaatttagtagaccgtaacttaactacccaccttactaacgactaacgtaccgtcccgggtaggaaaccggggtccttaactttcccttacgtccttaccgaagtaacgactaaacttccgaaacggtaacctaccctattactaccttacaaaacgttcgaaaccggtccctaggaacgacgccggaacggtaccacggtacccgttagttacgttacgtggtcggcgggtcggggttaatacggttacttaagggttgggtttaactttccggttaacttttaaccgtacccgttttcccgtacggtcggggttacccgttaacggggtttccccgttcgg

SEQ ID NO: 368704 - DNA, 608 bp, Homo sapiens
  misc_feature: GZ8MTXP01AS8OQ.25.37.D04.1.454.CMB.2.raw
  modified_base (205)..(205): a, c, t, g, unknown or other
  modified_base (267)..(267): a, c, t, g, unknown or other
  modified_base (297)..(297): a, c, t, g, unknown or other
  modified_base (318)..(318): a, c, t, g, unknown or other
  modified_base (569)..(569): a, c, t, g, unknown or other
  modified_base (593)..(593): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccgaaggggaaancgcccaccctctcctgcagggccagtcagagtgttatcaggttacttgcctaggtaccaaanagaaacctggccaggcctcccaggcctccncatctatgatgcatccgaagnggccagtggcactcccgagcctaggttcaggtcggacgagggtcgggggctaggggaaccaggtcgttccacttcacaccatcgaacgctacgtcgtagggacgtccgttaggaaagtttcttttaggaccttaaggttttacttacgtgttcaggcgtaaggtccgtagcgtgggttcggcccgtttcgggggtacttgggtttacggcccggtaagggggccctaaggctaggacgtaatacgaaacgngttgtaacggctaacgctaccttnttcgttaagtttccg

SEQ ID NO: 368705 - DNA, 723 bp, Homo sapiens
  misc_feature: GZ8MTXP01CFQQM.25.37.D04.1.454.CMB.2.raw
  modified_base (261)..(261): a, c, t, g, unknown or other
  modified_base (281)..(281): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctntgggttcagtcgttagcacngctacttgatcgtcggtcccgccgaggctccggagggggaagggctggagtgcgtctctagtttaattatacgaccgtaataaactacccaccctaactaaccgcaagacctccggtaggaaacgggccgtacttccttatcctaccgagtacgaactaacttacccgaaacggtaaaccctaccctacttaactacgtttaaccaaagttaccggaaaccggtccccgtaggaacgacggaccggaacggaccgaccgggtacccgttgttaaacgtttcccgtgggttccggaaccgggacggggggttaactagttaaaccgttaaggggtttggtttttaaccgtttccggttaactttttaacccttaacccggttttccccgtaacgggttccgggggttacccgttaaccgggggttttccccgttaacccgggg

SEQ ID NO: 368706 - DNA, 604 bp, Homo sapiens
  misc_feature: GZ8MTXP01D3OPK.25.37.D04.1.454.CMB.2.raw
  modified_base (261)..(262): a, c, t, g, unknown or other
  modified_base (326)..(326): a, c, t, g, unknown or other
  modified_base (539)..(539): a, c, t, g, unknown or other
tcagactgtacagtcacgaccggtgctcgatttagtagcatactgttggggtttggggggggagaggagcccagcactggggattccgagggtgtttccattcggtgatcagcactgaacacagaggactcaccatggcgttttggctgagctgggttttccttgttgctgttttaaaaaggtgtccagtgtgaggtgcagctggcggagtctggaggaggcctgatccagcctggggggtccctgagactctcctgtgcnnctcgtggtcgagcgtagcacagctactgatcgtcggtccgccgacgcgtacgaggggaaggggngtggagtgtcgtctctaagttaattaatagaccgaataaactaacctaaccctaacctaaacgacaacgactaccgtacggaacgggaccgtacttacttacttactaccaacgaagaactaaacttactaacgaaaccaaccctactactactaactaaactaagaacggaccgacgacgacgacgacggacgacggacgtacgtatactgnggcggcgggagtattagtagtagttagttcttactaactacttcctcgtcggcgtcggttcgtcg

SEQ ID NO: 368707 - DNA, 738 bp, Homo sapiens
  misc_feature: GZ8MTXP01CY9ZL.25.37.D04.1.454.CMB.2.raw
  modified_base (254)..(254): a, c, t, g, unknown or other
  modified_base (295)..(295): a, c, t, g, unknown or other
tcagactgtacagtcacgaccggtgctcgatttagtagcatactgttggggtttgggggggagaggagcccagcactgggattccgaggtgtttccattcggtgatcagcactgaacacagaggactcaccatggcgttttggctgagtcttgggtttttcctttgttgtcttagttttaaaaggtgtccagtgtgaggtgcagctgggcggagtcgtgggaggaggcctgactccgagccggtgggggtcccngacgctctccgtgtgcacgtcctcgtgggttcagtcgttancacgagtctacttgactccggtcgggtcccgaccgacgggtccgtaccggaagggggtaacgggacgtgggggacgttcggtccgtcttacgtaagtttaatttagtagacccgtaaactaaactaccctaaacctaccgaaaccgtacaacgtaccgtaccggtagggtaaccgggtccttactttcctactccgtaccaaggacgtaaactaaccgttaccgaacggtaaaccctaccctacttaaacttacgtaactaaacgtaccgaaccgggtcccgtaggaaccgaccgggaccggaacggaaccgtaccggtccgttagtaacttacgtggtcggcgggtaggggttagtacgttagttagttacgtttcgttacgttacctttaaccgttcccgttaaccggtcgggtaccggttcggttaaccgttccgtcccg

SEQ ID NO: 368708 - DNA, 689 bp, Homo sapiens
  misc_feature: GZ8MTXP01EX3C5.25.37.D04.1.454.CMB.2.raw
  modified_base (333)..(333): a, c, t, g, unknown or other
tcagactgtacagtcacgaccggtgctcgatttagtagcatactgttgggtttgggggggagaggagcccagcactggcattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagctctcctgtgcagcctcgtgggtcagtcgtagtcacagctacttgatcgtgggtcccgcgaggctcgaggggaagggcgtggagtgcgtntctagtttattatacgcaataactaccacctaactacgcagacctcgagacgggtctacttcctatctaccgagacgaacaacttaccgaacgtaaccaccctactactacctttaacaaacgttacgggaacgaccccgttaggaacgacggacccggagggacccgtaccgggtccgttgttaagttacccggtggtcgggtacccggggttagggggaacgttacgttaaacggtttacgggtttaagggttttacttttacccgggtaacttttacccgtttaacccgtttttaccccggttaaccggggttccgggggttaacccgtttaacccgggggttttccccccgg

SEQ ID NO: 368709 - DNA, 685 bp, Homo sapiens
  misc_feature: GZ8MTXP01BDZFU.25.37.D04.1.454.CMB.2.raw
  modified_base (356)..(356): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagtcttgggttttccttgttgcttagttttaaaaggtgtccagtgtgaggtgcagctggcggagtcgtgggaggaggcctgactccggcgtcggggtccggtcgagactcctctcgtgcacgccgtcgtggttcgtacgcgtacgtcacagctacttgtagtcgtcggtccgccgacggcgtccggagggaggggcgtggagtgtcgtctntagttattatagcgtaactaactacactaacctacgaacagtaaccgtaccgtagggaaccgggtaccgtacgtttaccttacgtactcccgaaggtaacaacgttaacttaccgaaacgtaaaccctaaccccttctaacttactaacgaaacgtacgtaaacccggcccttagggaacgacggaccgagaccgacgtccggtattagtaccgtgtcgggcggtaacgggaattacgttacttgggtaggtttactttacgttacttaccgtttccgtttcccgtaacgggtcgggggtcccttacggggttccccgttcggtaaccc

SEQ ID NO: 368710 - DNA, 750 bp, Homo sapiens
  misc_feature: GZ8MTXP01B7XC9.25.37.D04.1.454.CMB.2.raw
  modified_base (330)..(330): a, c, t, g, unknown or other
  modified_base (543)..(543): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggtcgttttggctgagtcgttgggtttttccttgttgtcttagttttaaaaggtgtcagtgtggaggtgcgagcgtggcggagtcgtgggaggaggcctgactccgacggtccggtcgggggtccctgacgtactctccgtgtcgctacgtccgtgtggttcagtcgttagcactgtctagtgacgtcgtcggtcccnccgacggtccgtacggaggggaacgggtcgtgggagtcgtcgttcttacgttagtttaattagtacgtaacgtaaactaactacccaaccttaccgtaaacgaccaagtacccgtacgggtacggaaccggtccgttactttaccttacgtaccctacgaacgaacgtaacctaacgttaccgaacgtaaaccctccttactataccgttaanaaagttaccgaccgtcgtaagaccgaacggacccgacgggtaccgacggttccgttagttaaaccgtttcgcggggtcgggaaccggggtagggttaactacgtttacggtttaagttcggtttttaacttacggttaaccctttaaccctttcccggtttaaccgtacggggtcccggttaaccgttccgggtttcccgtaaccgg

SEQ ID NO: 368711 - DNA, 874 bp, Homo sapiens
  misc_feature: GZ8MTXP01D3JTQ.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgcttagttttaaaaggtgtccagtgtgaggtgcagcgtggcggagtcgtggaggacggcctgactccgacggccggtcggggggtccctggacgtaccttctccgtgtcgcacgtcctcgttcggtcagtcgttagcacgacgtctattgactcggtcgggtcccgacgacggccgtaccgggagggggaacggggtcgtgggtagtcggtccgttaccgttagttaaggtttaatttaagtaacggtacctaaacttaaactaacccctaacctaaccgtaaacccgggactaacgggtaccgttacccgggtaacgggtaaccggggtacccttaacgttttaccctttaacttacccgttaacccgaaaggtaaaccgtaaccttaaaccgtttacccggaaaaccggtaaacccccttacccctttaacttaactttacccgttaaaccgaaaaacgttacccggaaaacccgggtccccgttaaaggggaaaccggtaacccgggaacccggtaaaccgggacccgtaaccgggtttaccggttaacgtttaaacgtttcggtacgggtcgggcggggtaaccgggggttaaattaaccgttaacggtttacgggtttaagttttacgtttcgttaaactttaacccgtttaccgtttcccgttacggggtcgggttacccggttaacggtttccccggttccgg

SEQ ID NO: 368712 - DNA, 829 bp, Homo sapiens
  misc_feature: GZ8MTXP01AN6SN.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagtcttgggttttccttgttgtcttagttttaaaaggtgtccagtgtgaggtgcagcgtggcggagtcgtgggaggacggcctgactccgaggtccggtcgggggtccctggacgtactctccgtgtcgcacgtcctcgtgggttcaggtcgttagcacagtctacgttgatccgtcgggtcccgccgacgggtaccgtaccgggaagggggaacggggtcgtaggggacgtcggtcggttcttacgttaagtttatttaagtacgtaccgtaaataaacctaaccctaaccgtacgtaaacccgacgaaccggtaccgtaccgggtaacgggtaaccggggtcccttaactttaccctttaacgtcccgttaaccgaaacggtaaacgtaaacctaaaccggtttacccgaaaacggtaaaccccttacccttacttaactttacctaaactaaacgtacgaacccgggtacccgtaaggaacggaccggaccgggacgaacccgtaccggtacccggtttagtaacgtttaccgtcgggtcgggtaacccgggtagggggttaataaccggtttaggttacggtttaagggttttactttacggttaacctttaaccgtttacccgtttaaccggtaaccgggttcggggttaccccgttaacgggtttccccgttcccggg

SEQ ID NO: 368713 - DNA, 651 bp, Homo sapiens
  misc_feature: GZ8MTXP01ECD3J.25.37.D04.1.454.CMB.2.raw
  modified_base (356)..(356): a, c, t, g, unknown or other
  modified_base (417)..(417): a, c, t, g, unknown or other
  modified_base (448)..(448): a, c, t, g, unknown or other
  modified_base (522)..(522): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtcgtgggaggaggcctgatccgagccgtgggggtccctgagactctcctgtgcacgtcctgtgggttcagtcgttagcacagtctactgatcgtcggtccacgaggcctccggaggggaagggcgtggagtcgcgtctacgtagttattanagacctaataactacccactactaacgacaacgacgtccgtaggacgggtcctacttctancctacgagacactaactcgaacgacctcctntatactacggaaatcgaaacgcctaggaaacgcgacccggaagaccgacggttaccgttgtactttaccggggnggtcggaacgggtagggttaataacgtttacggttaggtttacgtttacgttccgttaaacgtttaacccgttaccggtttcccggtacggggtccggggttaccgtttaacccgggtttccgtaacgg

SEQ ID NO: 368714 - DNA, 679 bp, Homo sapiens
  misc_feature: GZ8MTXP01CA3RP.25.37.D04.1.454.CMB.2.raw
  modified_base (454)..(454): a, c, t, g, unknown or other
  modified_base (487)..(487): a, c, t, g, unknown or other
  modified_base (540)..(540): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggtcgttttggctgagtcttgggttttccttgttgtcttaggttttaaaaggtgtccaggtggtggggtgcagcgtggcggagtcgtgggaggaggcctgatccgaggccgtcgggggtccctgagactctcctgtgcacgcctcgtggttcagtcgttagtcacagcttacgtgactcgtcgggtccgccgtacggccgtaccggagggggacggggtcgtgggagtcgtcgttctcgttagtttaattagtacgacgtaaactaactacctaactactaccgaacacgcgtcgtaggacgggcctattcctatcacaganactaactccgaagaacctccctatactcttaanaatcgaaccgccgtagacgaccgacggaagccgacggtccttaagtcttacgngtcggccgggaaggggtaattacgttacggttaggttacggtttactttacgggttactttaacccgtttcccgtttaccccggttaacggtcccgggggttaccgttaccggggttttcccccgttgggtttcccccg

SEQ ID NO: 368715 - DNA, 708 bp, Homo sapiens
  misc_feature: GZ8MTXP01CLOL6.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgcttgttttaaaaggtgtccagtgtgaggtgcagctggcggagtcgtggaggaggcctgatccgagccgtgggggtccctgagactctcctgtgcagcctcgtgggttcagtgttagcacagctacttgatcgtcgggtccgccgacggcctccggagggggacgggggctgggagtgtcgtcttctagtttatttatagaccgtaataactaccctaaccctacctaacgaccaacgaccgtccggtacggaacgggccgtacttcccttactcctaccgaagacgaacctaacttcccgaacggtaaaccctaccccttcttaacttcctttaaacaaacttccggaaaccgtccccgtaggacgaaccggcccggaacgacccgtacggtccgttagttacttaccgtggtcggccgggtagggggagtacttacgttagggttcggttttaacgtttccggttaacttttaacccttacccgttttaaccccgtacggttccgggggttacccgttaaccgggggtttccccttaacggg

SEQ ID NO: 368716 - DNA, 662 bp, Homo sapiens
  misc_feature: GZ8MTXP01CXT6D.25.37.D04.1.454.CMB.2.raw
  modified_base (368)..(368): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagtcttgggtttttccttgttgcttagttttaaaaggtgtccagtgtgaggtgcagcgtggcggagtcgtggaggaggcctgatccgagccgtgggggtccctgacgactctcctgtgcacgtcctcgtgggttcagtcgttagcacagctacttgactcgtgggtccgccagggcctaccggaggggaacggggtctgggagtgtcgtctctagtttattanagtaccaataaactccaacctactaaacgcaacgactccggtagaacgggcctacttcctatcctacaggacaactaattcccgaaagaccctcctactatcttagaaactcgaaccggtcctaggaacacggaccggacgaaccgcgggtacccgttagttaaacgtttccgggtcggtcgggaacgggtagggttaattacgttacgttaggtttacgtttacgtttacgttaactttaaccgttacccgttccggtacgggtccgggttaccgttaaccgggttccgtcgg

SEQ ID NO: 368717 - DNA, 707 bp, Homo sapiens
  misc_feature: GZ8MTXP01EZEZJ.25.37.D04.1.454.CMB.2.raw
  modified_base (302)..(302): a, c, t, g, unknown or other
  modified_base (571)..(571): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtcgtggaggaggcctgatccagccgtgggggtccctgagactctcctgtgcagcctcgtgggttcagtcgttagcacagctattgatcgtgggtccncgaggctccggaggggagggctggagtgcgtctacgtagtttattatagccgaataactacccactacctaacgacaagacctcgtaggaacgggtccgtattccttatcctaccaggtaacgactaacgttcccgaaaggtaaccccttaccctcttaacttacccttaaacgaaaaacgttcccggaaacccggtccccgttaaggggaacgaacccggaccggaaaccggacccgtaccggggtacccgttagttaacttaccggngggttaaccggccgggggaacgggggttaataaccgtttacgtaggtttcgggtttaactttcggttaacttttaacccgttaccttttcccggtaacggtcgggggttacccttaaccggggtttcccgtccggg

SEQ ID NO: 368718 - DNA, 664 bp, Homo sapiens
  misc_feature: GZ8MTXP01CAW2Q.25.37.D04.1.454.CMB.2.raw
  modified_base (263)..(263): a, c, t, g, unknown or other
  modified_base (294)..(294): a, c, t, g, unknown or other
  modified_base (305)..(305): a, c, t, g, unknown or other
  modified_base (442)..(442): a, c, t, g, unknown or other
tcagactgtacagtcacgaccggtgctcgatttagtagcatactgttggggtttggggggggagaggagcccagcactgggattccgaggtgtttccattcggtgatcagcactgaacacagaggactcaccatggcgttttggctgagtcttgggttttccttgttgcttagttttaaaaaggtgtccagtgtgaggtgcagctggcggagtcgtgggaggaggcctgactccgagccgtgggggtcctgagctctcctgtncagcctgtggtcagtcgtagcacagctatgntcgtcggtccncgagctacgagggagggctggagtcgtcgtctacgttagttatttagacgtaccgaattaaactaccctaaccctactaaaccgacaacgacgttacccgtagggaacggtccgtaacttccttaactctaccgaanacgaactaacttaccgaaacgtaaccctacctatactcttaacgaaacttcgaaacccgcctaggaacgacgaccggacgtaccgacggtcgtacgttaattaccggtgtcgggaaccggggtaagttacgtaacgtttaggttagtttacgtttacgttactttaacgttaaccctttccgtaacggttcgggacccggttacggtttcccgttcgtcccg

SEQ ID NO: 368719 - DNA, 730 bp, Homo sapiens
  misc_feature: GZ8MTXP01D1JFL.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgcttgttttaaaaggtgtccagtgtgaggtgcagctgggcggagtcgtgggaggaggcctgatccaggccgtgggggtccctgagactctcctgtgcacgtcctcgtgggttcaggtcgttagtcacagtctaacgttgactcgtcgggtcccgccgaggcctaccggagggggaacggggtcgtgggagtcggtcgttcgtcgttaagtttatttagtacgtaccgaactaaactaccctacccttacgtaaccgctaacgaccgtaccgggtaggaacgggtccgtaactttccgttactccctacgaaacggtaacaacctaaacgttacccgaaacggtaaccctacccctacgttaactaccttaacaaacgttcgaaacccggtccccgtaaggaacgaccggaccgaacggaccgtacgggtacccttagttacttaccggtgggtacggccggggtacggggttatacgtttacgtaggtttaggttttacgttcgttaacctttaacctttaccgtttcccgtagggtccgggttaccgttcgggttcccgttccggg

SEQ ID NO: 368720 - DNA, 788 bp, Homo sapiens
  misc_feature: GZ8MTXP01CL5K1.25.37.D04.1.454.CMB.2.raw
  modified_base (317)..(317): a, c, t, g, unknown or other
  modified_base (534)..(534): a, c, t, g, unknown or other
tcagactgtacagtcacgaccggtgctcgatttagtagcatactgttgggtttggggggggagaggagcccagcactgggattccgaggtgtttccattcggtgatcagcactgaacacagaggactcaccatggtcgttttggctgagtcttgggtttttccttgttgtcttaggttttaaaaggtgtccagtgtgaggtgcagcgtggcggagtcgtgggaggaggcctgactccgacggtccggtcggggggtccctagacgtaccttcctccgtgtcgctacgtccttgttcgggttcacggtcgttagcacncgtcttacttgacttcggtcgggtccgccgcggtcctaccggagggggaacgggtctgggtagtcgtcgtcgttacttagtttaacttagacgtacccgtaattaaacaccctaacctacgtaaaccgactaacgtaccgtccggtagggaacgggtcctactttaccttaactccgtacgaagaccgtaactaaccgttaccgaaacgtaaccccnccttataacttaccgttaaacaaacgttccgaaacccggcccttaagggaacccgaggacccggaaacggaacccgtcgggttacccgtttaggttaacctccggttgggaccgggtaacgggtacggggttaaattaacgttaccgttaagggttttacggtttaacctttgttaaacccgtttaacccttacccgttttccccggaaggggtccggggttacccgttaaccgggggtttcccctttaaccgg

SEQ ID NO: 368721 - DNA, 737 bp, Homo sapiens
  misc_feature: GZ8MTXP01ESACE.25.37.D04.1.454.CMB.2.raw
  modified_base (203)..(203): a, c, t, g, unknown or other
  modified_base (297)..(297): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccgaggggaancgccaccctctcctgcagggccagtcagtagtgttatcgaggttacttagcctaggtaaccaaagagaaacctggccaggcctccgaggcctcncatctatgatgacataccgaaaggcggaccacgtcggaccactcccgagccgtaggttcaggtcgcgaggtggggctagggaacagtcgttcaccttctaccaacctagtcgacgcgtagttcgtagggacgtaccgttaggttaaacgttagtttttacgtaccgtttaaggtttaaactttacgttacgttaccgaacggggtacgtaagggttaccggtaacggtaccggttaacgggtttccgggtacccgggtttacccgggggtttaacgtttaccggggtttttaccggggaacccgggtaaacgggggtaaacccgtaaacgggttccgggtaagggttaaacgtaaacgtaaccggttaaaacggttacggttacgggttaacggggacttcgggaaccctaccggttaacttccgtttcggtttaacccg

SEQ ID NO: 368722 - DNA, 747 bp, Homo sapiens
  misc_feature: GZ8MTXP01CRW15.25.37.D04.1.454.CMB.2.raw
  modified_base (299)..(299): a, c, t, g, unknown or other
  modified_base (329)..(329): a, c, t, g, unknown or other
  modified_base (353)..(353): a, c, t, g, unknown or other
tcagactgtacagtcacgaccggtgctcgatttagtagcatactgttgggtttggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagcgttagcacagctacttgatcgtgggtcccncgaggcctccggagggggaacgggctgggngtggcgtctacgtagtttatttanagacccgtataaactacctaccctactaaaccgcgtaacgaccgttcccgggtaggaacgggtccctagtttacccttacgtccttcccgaaggtaacgaactaaacgtttcccgaaacgggtaacccaacccgttacttaacttcccgttaacaaaacgttccggaaaccgggtccccttaaggggaaccgtaacgggaccccgggaagggaacccgtaccggggtacccgttaggtttaacttacccggtgggttccggaacccggggtagggggaacgtacgttacgttaaaggggttggttttacgttttacgaaccgttttaaccttaaccccgtttttcccgtaacggggttccggggacccgttaacggggtttcccctttaacggg

SEQ ID NO: 368723 - DNA, 559 bp, Homo sapiens
  misc_feature: GZ8MTXP01BRPD9.25.37.D04.1.454.CMB.2.raw
  modified_base (198)..(198): a, c, t, g, unknown or other
  modified_base (202)..(202): a, c, t, g, unknown or other
  modified_base (233)..(233): a, c, t, g, unknown or other
  modified_base (240)..(240): a, c, t, g, unknown or other
  modified_base (242)..(243): a, c, t, g, unknown or other
  modified_base (251)..(251): a, c, t, g, unknown or other
  modified_base (254)..(254): a, c, t, g, unknown or other
  modified_base (256)..(257): a, c, t, g, unknown or other
  modified_base (259)..(260): a, c, t, g, unknown or other
  modified_base (262)..(262): a, c, t, g, unknown or other
  modified_base (264)..(265): a, c, t, g, unknown or other
  modified_base (287)..(287): a, c, t, g, unknown or other
  modified_base (289)..(289): a, c, t, g, unknown or other
  modified_base (291)..(291): a, c, t, g, unknown or other
  modified_base (300)..(300): a, c, t, g, unknown or other
  modified_base (339)..(339): a, c, t, g, unknown or other
tcagactgtacagtcacgaccggtgctcgatttagtagcatactgttgggtttgggggagaggagcccagcactgggattccgaggtgtttccattcggtgatcagcactgaacacagaggactcaccatggcgttttggctgagcgtggtttcgtgtagctgttaaagtgtcagtgtgaggtgcagctggcggagtntggnggagcctgatccagcctgggggcctgagctntcctgtncnnctcgtgtngtntnnanntntnntgtcgcgcgcgcgcgaggaggngngngtgcgtctntagtattagtagacgtatactacctacctactaacgacncgtacgtcgtacggacggtacgtacttacttactactacacgacactaactacgaacgaacctacctactacttactactaactacgaacggacgtacgacgacgacgacgacgtacgtacgtcgtgtacgtacgtgtcggtcggcgggtagagtacgtagttagttcgttacgttaacttacgttaacctttccgtacgttcgggtccgttcggttccg

SEQ ID NO: 368724 - DNA, 686 bp, Homo sapiens
  misc_feature: GZ8MTXP01A1591.25.37.D04.1.454.CMB.2.raw
  modified_base (318)..(318): a, c, t, g, unknown or other
  modified_base (380)..(380): a, c, t, g, unknown or other
  modified_base (573)..(573): a, c, t, g, unknown or other
tcagactgtacagtcacgaccggtgctcgatttagtagcatactgttggggtttgggggggagaggagcccagcactgggattccgaggtgtttccattcggtgatcagcactgaacacagaggactcaccatggtcgttttggctgagcttgggttttccttgttgtcttaggttttaaaaggtgtccagtgtgaggtgcagctggcggagtcgtggaggagcctgactccgaggccgtgggggtccctgacgctctcgtgtgcacgtcctgttcggtcaggtcgttagcacagtctacttgtactcgtcgggtccnccgaggccgtacgggagggggacggggtctaggggagtcgtcgttatacttagtttattaanacgtacgtaaactaacaccctaactacaacgacgaagtaccgtcgggtaggaaccgggtcttacttcttactacctacgaaggactaactaacgttaccaaacgtacctacctacttacgtactaactaacgtacgaccggtactagggacaccggacggaacggtccaggttcgtacgttacgtcggtcggnggtcggtaggggttatacgttgttaaaggttcgtttaaacgtttccttaactttaaccttccgttcccggttacggtccgggggttaccttaaccgggttcccgttaaccggg

SEQ ID NO: 368725 - DNA, 784 bp, Homo sapiens
  misc_feature: GZ8MTXP01EVQEI.25.37.D04.1.454.CMB.2.raw
  modified_base (324)..(324): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggtttttccttgttgcttagttttaaaaaggtgtccagtgtgaggtgcagctgggcggagtcgtgggaggaggcctgatccgaggcccggtggggggtccctgacgtactcctcctgtgcagtcctcgtgggttcagtcgttagtcactgctacgttgactcgtcgggtaccnccgaggcctaccgggagggggaacggggtcgtgggacgtcggccgttactacgtagtttattaatacgtacctaaattaaactaacccaaccttacctaaccgtacgaacgtcccgtaccgggtaacggaacggggtaccctacgtttacccttacttcccgtacgaacggaacgtaaactaaccgttaaccgaaaccggtaacccctacccttacttaacttacccttaaacgaaaacgttccgaaacccggtccctaaggaacggacggacccggaaacggaccccgtaacgggtccgttaacgttcgttaacgtcggggttcggaaccggggtaggggttaacgtaacgtttaaaggttcggtttaaggttttacgtttcgttaacgttttaacccgttacccttttaacccggtaacgggtccggggttacccgttaaccggggtttcccgtcccg

SEQ ID NO: 368726 - DNA, 731 bp, Homo sapiens
  misc_feature: GZ8MTXP01EDJ3J.25.37.D04.1.454.CMB.2.raw
  modified_base (184)..(184): a, c, t, g, unknown or other
  modified_base (557)..(557): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagtcttgggttttccttgttgtcttagttttaaaaggtntccagtgtgaggtgcagctggcggagtcgtgggaggaggcctgactccgaggtccgtcgggggtcctgacgactctcctgtgcacgtcctcgtggttcagtcgtagtcacacgcttacgttgacttcggtcgggtcccgaccgtaggccgtaccgggagggggtaacgggggcgtagggtaggtcggtccgttacgtacttaaggttttaattaagtaagtaccgtaaacttaaacctaaccctaacccttaaccgtaaaccgacaacggtaccgttaccggtacgggaaacgggtaccttacgttaccttactactaccgaaggactaacctaacttaccgaaacggtaaccctaccttctaacttcgtaanaacgtaccgacgtacccgtaggacgaacggaccggaaacggtaccgacgggtacgttacgttaagttacgtcgggtcggaacgggacggggttaagtaacttaggtagttacggtttcttacgttaacttcgttaccttccgggtcgtcgggttccgttaacggttccgtaacg

SEQ ID NO: 368727 - DNA, 630 bp, Homo sapiens
  misc_feature: GZ8MTXP01BEXFF.25.37.D04.1.454.CMB.2.raw
  modified_base (262)..(262): a, c, t, g, unknown or other
  modified_base (294)..(294): a, c, t, g, unknown or other
  modified_base (344)..(344): a, c, t, g, unknown or other
  modified_base (358)..(358): a, c, t, g, unknown or other
  modified_base (573)..(573): a, c, t, g, unknown or other
  modified_base (582)..(582): a, c, t, g, unknown or other
  modified_base (614)..(614): a, c, t, g, unknown or other
tcagactgtacagtcacgaccggtgctcgatttagtagcatactgttgggtttggggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctggggggtccctgagactctcctgtgcagcctntgggttcagcgttagcacagctacttgatcgngggtccgccgaggctccgaggggtaagggggctgggatcgcgttaccgtntagtttaagtttanaaggaccctaataaactaccgtaaccctaacttaaccggaccaagtaccgtcccgtacgggaagggaccggtactttacctaaactctacccgtaagacgaactaattacccgaaacggaaccaaccctacttaactcctaacctaaagtacgtaacgggccccgtgaacggacgccggaacggattccggaccgtggttaatcgtagtgaacgngggggttanattacgtgtcgttagttcttatcttacttccngtcggcgtcgttcgtg

SEQ ID NO: 368728 - DNA, 591 bp, Homo sapiens
  misc_feature: GZ8MTXP02GJRK8.25.37.D04.1.454.CMB.2.raw
  modified_base (355)..(355): a, c, t, g, unknown or other
  modified_base (357)..(357): a, c, t, g, unknown or other
  modified_base (391)..(391): a, c, t, g, unknown or other
tcagactgtacagtcacgaccggtgctcgatttagtagcatactgttgggtttgggggagaggagcccagcactgggattccgaggtgtttccattcggtgatcagcactgaacacagaggactcaccatggcgttttggctgagcgtggtttcgtgtaggctgtttaaagtgtcagtgtgaggtgcagctggcggagtctggaggaggcctgatccagcctggggggtccctgagactctcctgtgcagctctggttcagcgttagtcacagctacttgatctggtcgccaggctccaggaaggggcgtggagtgcggtctcagtattattagcgataatacacctactaaccncncgactcgtacgacggcgtactcttactctcaganacactacacgacacctactactactactaaatacgaacgacctacgagacgaccgacggacgaccggacgtacgttacgttacgtgtcggcgggacggggacggtacgtacgttacggttacggtttacgtttacgttacttaacgtttacctttacccgttaccggttacggggtaccggtaccgggttaccggttcgg

SEQ ID NO: 368729 - DNA, 602 bp, Homo sapiens
  misc_feature: GZ8MTXP02F1TVG.25.37.D04.1.454.CMB.2.raw
  modified_base (261)..(261): a, c, t, g, unknown or other
  modified_base (263)..(263): a, c, t, g, unknown or other
  modified_base (271)..(271): a, c, t, g, unknown or other
  modified_base (278)..(279): a, c, t, g, unknown or other
  modified_base (290)..(290): a, c, t, g, unknown or other
  modified_base (303)..(303): a, c, t, g, unknown or other
  modified_base (308)..(308): a, c, t, g, unknown or other
tcagactgtacagtcacgaccggtgctcgatttagtagcatactgttgggtttgggggagaggagcccagcactgggattccgaggtgtttccattcggtgatcagcactgaacacagaggactcaccatggcgttttggctgagcgtggtttcgtgtaggctgtttaaagtgtcagtgtgaggtgcagctggcggagtctggaggaggcctgatccagcctggggggtccctgagactctcctgtgcagctctggttcgngngtgtcacngctactnntcgtggccgcncgcgcgaggaggngtggngtgcgtctctagttattatagacgataactactacctactacgacacgacgtacgtacggacggaccgtacttaccttactactacacgacgaactaactaccgtaacgaacctacctactactacttactaaactacgaacgaccgtacgacgacgaccgacggacgacggacgtacgtacgtacgtgtcggcggacgggaggtacgtacgttacggttacgtttacgtttacgttacgtttaacgtttaccgtttaccgttacggtacggtaccggtacggttaccggtcgg

SEQ ID NO: 368730 - DNA, 531 bp, Homo sapiens
  misc_feature: GZ8MTXP02JW5LG.25.37.D04.1.454.CMB.2.raw
  modified_base (360)..(360): a, c, t, g, unknown or other
  modified_base (391)..(391): a, c, t, g, unknown or other
  modified_base (393)..(393): a, c, t, g, unknown or other
  modified_base (419)..(419): a, c, t, g, unknown or other
  modified_base (429)..(429): a, c, t, g, unknown or other
  modified_base (460)..(460): a, c, t, g, unknown or other
  modified_base (465)..(465): a, c, t, g, unknown or other
tcagactgtacagtcacgaccggtgctcgatttagtagcatactgttgggtttgggggagaggagcccagcactgggattccgaggtgtttccattcggtgatcagcactgaacacagaggactcaccatggcgttttggctgagcgtggtttcgtgtagctgtttaaagtgtcagtgtgagtgcagctggcggagtctggaggaggcctgatccagcctggggggtccctgagactctcctgtgcagcctctgggttcagcgttagtcacagctacttgatctgggtccgccaggctccgagggaaggggctgggagtgcgtctcagttatttatagccgataataccactactacgcngactcgagaacggctacttctatcctcagananactacacgacacctctctctactaanacgaacgccngagacgacgacgacgacggcgtgtatatggngcggnggagtacgtagtagttgttacgttacttacttaacgttacttaccgtcgtcggtcgtcggtcgtcg

SEQ ID NO: 368731 - DNA, 529 bp, Homo sapiens
  misc_feature: GZ8MTXP02FUAUP.25.37.D04.1.454.CMB.2.raw
  modified_base (292)..(292): a, c, t, g, unknown or other
  modified_base (395)..(395): a, c, t, g, unknown or other
  modified_base (412)..(412): a, c, t, g, unknown or other
  modified_base (415)..(415): a, c, t, g, unknown or other
  modified_base (419)..(419): a, c, t, g, unknown or other
  modified_base (422)..(422): a, c, t, g, unknown or other
  modified_base (424)..(424): a, c, t, g, unknown or other
  modified_base (429)..(429): a, c, t, g, unknown or other
tcagactgtacagtcacgaccggtgctcgattagtagcatactgttgggttgggggagaggagcccagcactgggattccgaggtgtttccattcggtgatcagcactgaacacagaggactcaccatggcgttttggctgagctgggttttccttgttgctgtttaaaaggtgtccagtgtgaggtgcagctggcggagtctggaggaggcctgatccagcctgggggtccctgagactctcctgtgcagcctctgggttcagcgttagcacagctacttgatctggtccnccaggctccgaggggaaggggctggagtgcgtctcagttatttatagccgataactaccactactacgcagactccgtgaacgggccaattcctatctcaganacaattccagacacctntanctanaananacacngagacgacgacgacgacgcgtcgtatacgtgtgcggcggagacgtagtagtagttacgttagtattaacttacttacctacgtcggtcgtacggtcgtcg

SEQ ID NO: 368732 - DNA, 535 bp, Homo sapiens
  misc_feature: GZ8MTXP02GA0VY.25.37.D04.1.454.CMB.2.raw
  modified_base (296)..(296): a, c, t, g, unknown or other
  modified_base (464)..(464): a, c, t, g, unknown or other
  modified_base (470)..(470): a, c, t, g, unknown or other
  modified_base (476)..(476): a, c, t, g, unknown or other
tcagactgtacagtcacgaccggtgctcgatttagtagcatactgttgggtttgggggagaggagcccagcactgggattccgaggtgtttccattcggtgatcagcactgaacacagaggactcaccatggcgttttggctgagctgggttttccttgttgctgtttaaaaggtgtccagtgtgaggtgcagctggcggagtctggaggaggcctgatccagcctgggggtccctgagactctcctgtgcagcctctgggttcagcgttagtcacagctacttgatctgggtccnccaggctccgagggaagggctggagtgcgtctcagttattatagccgataactaccacctactacgcagactccgtgaagggccgattcctatctccagagacaattccagacaccctctatctacaaatgaacgccctgagacgccgagacacggccgtgtatacgngtgcgngggganatactagtggttattcgtattaactactttaccctacgtcgggcctacgggtccctcgg

SEQ ID NO: 368733 - DNA, 581 bp, Homo sapiens
  misc_feature: GZ8MTXP02I0BNT.25.37.D04.1.454.CMB.2.raw
  modified_base (345)..(345): a, c, t, g, unknown or other
  modified_base (417)..(417): a, c, t, g, unknown or other
  modified_base (512)..(512): a, c, t, g, unknown or other
  modified_base (518)..(518): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctctgggttcagcgttagtcacagctacttgatcgtgggtccgccaggctccgaggggaagggctgggagtgcgtctcagtttattanagccgaataactaccacctactacgcagacctccgtagaaacgggccgtatttcccttaatcctcccagganaactaaattcccaaggaaccaccctctaatccttacaaaatcgaaaccgccctagagacgaccgaaggacgacggccgtagtattactgtgcggngggganatacgtagtggttaatttcgaattaacgtactttccctacgtggggcctacgggttccctcgg

SEQ ID NO: 368734 - DNA, 645 bp, Homo sapiens
  misc_feature: GZ8MTXP02IX4MM.25.37.D04.1.454.CMB.2.raw
  modified_base (292)..(292): a, c, t, g, unknown or other
  modified_base (310)..(310): a, c, t, g, unknown or other
tcagactgtacagtcacgaccggtgctcgatttagtagcatactgttgggtttgggggagaggagcccagcactgggattccgaggtgtttccattcggtgatcagcactgaacacagaggactcaccatggcgttttggctgagcgtggtttcgtgtagctgtttaaagtgtcagtgtgaggtgcagctggcggagtctggaggaggcctgatccagcctgggggtccctgagactctcctgtgcagctctggttcagcgtagtcacagctacttgatctggtcgccagcnccaggaaggggcgtgggngtgcgtctctagttattatagtacgtataactacctacctactacgacacgtacgtaccgtacggaacgggtaccgtacgtttaccttacttacctaccacgaacgaactaactaccgaacgaacctaaccctacctactacttactaaactaacgaaccgaccgtacgacggacggaccggaacggaaccggaccggtaccggtacgttacgttacgtacgtacggtcgggacggggaggtaacgtacgttacggttacggtttacgtttacgttacgttaacgtttaccgtttacccgttaccgtacgggtaccggtaccggttaccggtcgg

SEQ ID NO: 368735 - DNA, 596 bp, Homo sapiens
  misc_feature: GZ8MTXP02GZD9X.25.37.D04.1.454.CMB.2.raw
  modified_base (275)..(275): a, c, t, g, unknown or other
  modified_base (281)..(281): a, c, t, g, unknown or other
  modified_base (283)..(283): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcgtggtttcgtgtagctgtttaaaagtgtcagtgtgaggtgcagctggcggagtctggaggaggcctgatccagccgtggggggtccctgagctctcctgtgcagctctgggttcagcgttagtcacanctactntntcgtcggtccgccgacgcgtacggaggggaggggcggtggagtgtcgtctactagttatttagtagacgtaataactaacctaacctactacgacacgaccgtacggtacggacgggtaccgtacttaccttacttactaccacgacgaactaactacgacgaaccacctactactactactaaatacgaacgactagagacgacgacgacgacgacgtagtattacgtgtggcggacgggagtacgtacgtacgttacgttacgttacgttattaacttacttaccgttacgtcggtcggtacggtacgtcg

SEQ ID NO: 368736 - DNA, 544 bp, Homo sapiens
  misc_feature: GZ8MTXP02HVPG8.25.37.D04.1.454.CMB.2.raw
  modified_base (298)..(298): a, c, t, g, unknown or other
  modified_base (441)..(441): a, c, t, g, unknown or other
  modified_base (473)..(473): a, c, t, g, unknown or other
  modified_base (479)..(479): a, c, t, g, unknown or other
  modified_base (484)..(484): a, c, t, g, unknown or other
tcagactgtacagtcacgaccggtgctcgatttagtagcatactgttgggtttgggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctctgggttcagcgttagtcacagctacttgatctgggtccnccaggctccgaggggaagggctggagtgcgtctcagtttattatagccgataactaccacctactacgcagactccgtagaacgggccgattccttatctcagagacaattcccaagaccacctctatctacaaatcgaaacnccctagacgagccgagacacggctgtatacgngtgcgnggganactacgtagtgttacttcgtattaacgttacttccctagtcgggctacgggtttccctgg

SEQ ID NO: 368737 - DNA, 523 bp, Homo sapiens
  misc_feature: GZ8MTXP02G5DAO.25.37.D04.1.454.CMB.2.raw
  modified_base (204)..(204): a, c, t, g, unknown or other
  modified_base (262)..(262): a, c, t, g, unknown or other
  modified_base (290)..(290): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccgaggggaaangccaccctctcctgcagggccagtcagagtgttatcaggtacttagcctggtaccaanagaaacctggccaggctcccaggctccnatctatgatgcatccaagacggccactggcatcccagccaggttcagtcgcaggtggggctggggacaggcgttcactctacaccatcagcagtcgtggacgcctagtagtatttgacttagtttattactgtcagcagcgtagctagttcggccgtcgggtactaggtttggccgtagggaccaggcgtaggagacgtacgaaacgtactgtgctagacacgactctcgttc

SEQ ID NO: 368738 - DNA, 516 bp, Homo sapiens
  misc_feature: GZ8MTXP02F8728.25.37.D04.1.454.CMB.2.raw
  modified_base (201)..(201): a, c, t, g, unknown or other
  modified_base (259)..(259): a, c, t, g, unknown or other
  modified_base (351)..(351): a, c, t, g, unknown or other
  modified_base (389)..(389): a, c, t, g, unknown or other
  modified_base (421)..(421): a, c, t, g, unknown or other
tcagactgtacagtcacgaccggtgctcgatttagtagcatactgttgggtttggggaggaactgctcagttaggacccagagggaaccatggaagccccagctcagcttctcttcctcctgctactctggctcccagatagcaccggagaagttgtgttgacacagtctccagacaccctgtcttgtctccaggggaaangccaccctctcctgcagggccagtcagagtgttatcaggtacttagcctggtaccaanagaaacctggccaggctccaggctcctcatctatgatgcatccaagaggccatggcatcccagccaggttcagtgcagtgggctgggacagngttcactctcaccatcagcagtctggagcctagaagtnttttgactagtttatactgtcagcagcgtagngtagttggccgttcgggggtactaggtttcggccgtaagggggacctaaggcgtggaacgactacgaaaacgatggtgctagcacatcgtgttcc

SEQ ID NO: 368739 - DNA, 614 bp, Homo sapiens
  misc_feature: GZ8MTXP02J2PX5.25.37.D04.1.454.CMB.2.raw
  modified_base (290)..(290): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcgtggtttctgtgctgtttaaagtgtcagtgtgaggtgcagctggcggagtctggaggaggcctgatccagcctgggggtccctgagactctcctgtgcagcctctgggttcagcgttagtcacagctacttgatcgtggtccnccagggctccgagggaggggctgggacgtgcgtctcgtagttattatagccgataactaccactactacgcagactccggtgaaggggcctaatttccctatcctaccagacgacaacttccaggaaccaccctctactcttacaaacttcgaaaccgccctagacgaggacccgaggtaccgacggccgtagtaactttacggtcggtacggcgggacggggacggtacgtaacgttacggttacggtttacgtttacgttacgttaaccgttaccgtttacccgttaccggtaccgggtaccggtaccgggttaccggtcgg

SEQ ID NO: 368740 - DNA, 523 bp, Homo sapiens
  misc_feature: GZ8MTXP02ISG13.25.37.D04.1.454.CMB.2.raw
  modified_base (204)..(204): a, c, t, g, unknown or other
  modified_base (263)..(263): a, c, t, g, unknown or other
  modified_base (358)..(358): a, c, t, g, unknown or other
  modified_base (360)..(360): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtcttttgtctccaggggaaangccaccctctcctgcagggccagtcagagtgttatcaggttacttagcctggtaccaanagaaacctggccaggctcccaggctcctcatctatgatgcatccaagaggccatggcatcccagccaggttcagtggcaggtggggctggggacngngttcactctcaccatccagcagtcgtggacgcctagaagtatttgctagtttattacttgtctagcagtcgtagcgagttggtccgtcgggtacgtggtttcggcgacggggaccaggcgtaggagagtacgaaacgtactggtgcgtcgcacgactcgtgtc

SEQ ID NO: 368741 - DNA, 538 bp, Homo sapiens
  misc_feature: GZ8MTXP02IV4CV.25.37.D04.1.454.CMB.2.raw
  modified_base (298)..(298): a, c, t, g, unknown or other
  modified_base (475)..(475): a, c, t, g, unknown or other
  modified_base (486)..(486): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctgggggtccctgagactctcctgtgcagcctctgggttcagcgttagtcacagctacttgatctgggtccnccaggctccgaggggaaggggctggagtgcgtctcagttattatagccgataataccactactacgcagactccgtagaagggccatttcctatctcagagacaattccagaacacctctatcttcaaaatgaaacgccctgagagacccgaaggacacggccgtgtaattactggngcggacggganatacgtagtgttacttcgattaactacttcctacgtcggcctacggttcctg

SEQ ID NO: 368742 - DNA, 533 bp, Homo sapiens
  misc_feature: GZ8MTXP02JUWIT.25.37.D04.1.454.CMB.2.raw
  modified_base (203)..(203): a, c, t, g, unknown or other
  modified_base (289)..(289): a, c, t, g, unknown or other
  modified_base (377)..(377): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgctccgaggggaaanagccaccctctcctgcagggccagtcagagtgttatcaggtacttagcctggtaccaacagaacctggccaggctcccaggctccncatctatgatgcatccaagacggccacgtggcatcccagccaggttcagtcggcaggtggggctggggacagtcgttcactctcaccntcagcagtcgtggacgcctagtaagtatttgcttagtttactacgtgtcagcagcgtagcgtgtcggccgtcgggtactaggttcggacgaggggtacacggtgacggagacgtacgaaacgtcgtaggtcgacgtcgactacctgtcgtcgtttc

SEQ ID NO: 368743 - DNA, 557 bp, Homo sapiens
  misc_feature: GZ8MTXP02I88FP.25.37.D04.1.454.CMB.2.raw
  modified_base (491)..(491): a, c, t, g, unknown or other
tcagactgtacagtcacgaccggtgctcgatttagtagcatactgttgggtttggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctgggggtccctgagactctcctgtgcagcctctgggttcagcgttagtcacagctacttgatctgggtccgccaggctccgagggaagggctggagtgcgtctcagttattatagccgataactaccacctactacgcagactccgtgaacgggccgattcctatcctcagagacaattccaaggaaccaccctctactcttacaaaatcgaaacgccctagagagccgaaggacacgggccgtgtattacgtgtgcggcgggganactacgtagtggttaactttcgatttaactactttcccgtacgtcggggcctacggggttccctgg

SEQ ID NO: 368744 - DNA, 604 bp, Homo sapiens
  misc_feature: GZ8MTXP02G9RKC.25.37.D04.1.454.CMB.2.raw
  modified_base (302)..(302): a, c, t, g, unknown or other
  modified_base (444)..(444): a, c, t, g, unknown or other
  modified_base (486)..(486): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtcgtggaggaggcctgatccagccgtggggggtccctgagactctcctgtgcagcctctgggttcagcgttagtcacagctacttgatcgtgggtccnccaggctccgaggggagggctggagtgcgtctcagtttattatagcgaataactaccactactacgcacgactcgtagaacgggcctattcctatctcagacgacaatccagaaccaccctctatcttacaaatcggaaccnccctagacgacgaccgaggtaccacggccgtagtacttacgnggtgcggacgggggataacgttacgtaggttacggtttatttccggtaatttaacccttaccgttttaccccgtaacgggttcgggggtcccttaacgggggtttccccctttcgggg

SEQ ID NO: 368745 - DNA, 548 bp, Homo sapiens
  misc_feature: GZ8MTXP02IOXEF.25.37.D04.1.454.CMB.2.raw
  modified_base (204)..(204): a, c, t, g, unknown or other
  modified_base (360)..(360): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccgaggggaaangccaccctctcctgcagggccagtcagagtgttatcaggtacttagcctggtaaccaacagaaacctggccaggcctcccaggctcctcatctatgatgcatccaagcggccagtggcatcccagccagttcagtcgcaggtggggctgggacagngttcactctcacctatcagcagtctggagcctgaaagttatttgacttaagtttattacgttgtcagcgtagacgttagcgtagttcggtccgtacggggtataggtttcgggacgtacggggacgaagtcgaggagtacgtacgaaaacgtacgtaggtaagtcgtacgacactactctacgtttcc

SEQ ID NO: 368746 - DNA, 585 bp, Homo sapiens
  misc_feature: GZ8MTXP02F7ERO.25.37.D04.1.454.CMB.2.raw
  modified_base (302)..(302): a, c, t, g, unknown or other
  modified_base (348)..(348): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagtcgttagtcacagctacttgatcgtgggtccnccaggcctccgaggggaaggggctgggagtgcgtctcagttattangccgataactaccacctactacgcagactccggtagaacgggccgtatttccttatcctccaagacgaactaattcccaaggaaccctaccctcttatccttacaaatcgaaaccgccctagagacgccgaaggacgacggccgtgtattacgtgtcggcggcggggatacgtactagttcggttattcgaattaacgttacctttacctacggtcggggcctacgggttccctcgg

SEQ ID NO: 368747 - DNA, 621 bp, Homo sapiens
  misc_feature: GZ8MTXP02GNTBX.25.37.D04.1.454.CMB.2.raw
  modified_base (467)..(467): a, c, t, g, unknown or other
  modified_base (508)..(508): a, c, t, g, unknown or other
  modified_base (522)..(522): a, c, t, g, unknown or other
tcagactgtacagtcacgaccggtgctcgatttagtagcatactgttgggtttgggggagaggagcccagcactgggattccgaggtgtttccattcggtgatcagcactgaacacagaggactcaccatggcgttttggctgagctgggtttcctgttgctgtttaaagtgtccagtgtgaggtgcagctggcggagtctggaggaggcctgatccagcctgggggtccctgagactctcctgtgcagcctctgggttcagcgttagtcacagctacttgatctgggtccgccaggctccgaggggaaggggctgggagtgcgtctcagttatttatagccgaataactaccaccttactacgcagtactccggtaggaaacgggccgtaatttcccttaatcctaccaaggacgaacaaattcccgaaggaaccctaccctctaatccttacgaaaatgaaaccnccctagacgacgcccgaggtacacgggtccgtgtattacgngtgcggacgggganacttaacgtaggttggtttaactttcggtaacttttaaccgttacccgttttacccgtaacggtcggggtacccttaacgggggtttcccctttcgggg

SEQ ID NO: 368748 - DNA, 548 bp, Homo sapiens
  misc_feature: GZ8MTXP02JMJKJ.25.37.D04.1.454.CMB.2.raw
  modified_base (203)..(203): a, c, t, g, unknown or other
  modified_base (261)..(261): a, c, t, g, unknown or other
  modified_base (289)..(289): a, c, t, g, unknown or other
  modified_base (310)..(310): a, c, t, g, unknown or other
  modified_base (363)..(363): a, c, t, g, unknown or other
  modified_base (372)..(372): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccaggggaaangccaccctctcctgcagggccagtcagagtgttatcaggtacttagcctggtaccaanagaaacctggccaggctcccaggctccncatctatgatgcatccaaagnggccagtggcactcccagccgtaggttcagtcggcaggtggggctgggacagngttcactcncacatcagcagtcgtggacgctagtaagtagtttgacttagtttacttactgtcagcagtcgtagcgtagttcggccgtacggggtactaggtttcggaccgtaggggacgaacggtcgtagggacgacgtacgaaacgtacgtagtcggtcgtacgacaccagttccgtagttcc

SEQ ID NO: 368749 - DNA, 612 bp, Homo sapiens
  misc_feature: GZ8MTXP02F7LIC.25.37.D04.1.454.CMB.2.raw
  modified_base (444)..(444): a, c, t, g, unknown or other
  modified_base (487)..(487): a, c, t, g, unknown or other
  modified_base (506)..(506): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctgggggtccctgagactctcctgtgcagcctctgggttcagcgttagtcacagctactgatcgtggtccgcaggctccgaggggagggctggagtgcgtctcagttattatagcgataactaccactactacgcagactcggtgaaggggcctattcccttatcctccaagagacaaacttccaaggaaccacctctattctacaaaatcgaaaccnccctagagacgccgaaggaccgacgggcccgtgtaacttacgnggtcgacgggcgggggaanagttaacgtagggttacgggtttaaattccggttaaatttaacccgttaacccgtttttacccgaacggttcgggggtaccctaacgggggtttcccccttcgggg

SEQ ID NO: 368750 - DNA, 560 bp, Homo sapiens
  misc_feature: GZ8MTXP02FUTTC.25.37.D04.1.454.CMB.2.raw
  modified_base (298)..(298): a, c, t, g, unknown or other
  modified_base (342)..(342): a, c, t, g, unknown or other
  modified_base (366)..(366): a, c, t, g, unknown or other
  modified_base (493)..(493): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgtttaaaaggtgtccagtgtgaggtgcagctggcggagtctggaggaggcctgatccagccgtgggggtccctgagactctcctgtgcagcctctgggttcagcgttagtcacagctacttgatctgggtccncaggctccgaggggaggggctgggagtgcgtctcagttatttanagccgataataccactactacgcngactcgtgaacgggccattcctatctccagagacaattccaaggaaccaccctctatcttacaaaatcgaaacgccctagacgacgcccgaaggacacggccgtgtattacgtgtgcggtcgggganacgtactaggtggttacttcgattaacttacctttccctacgtcggggtacctacgggttccctcgg

SEQ ID NO: 368751 - DNA, 595 bp, Homo sapiens
  misc_feature: GZ8MTXP02IZ7PD.25.37.D04.1.454.CMB.2.raw
  modified_base (255)..(255): a, c, t, g, unknown or other
  modified_base (292)..(292): a, c, t, g, unknown or other
  modified_base (316)..(316): a, c, t, g, unknown or other
  modified_base (325)..(325): a, c, t, g, unknown or other
  modified_base (359)..(359): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcgtggtttcgtgtagctgtttaaaggtgtcagtgtgaggtgcagctggcggagtctggaggaggcctgatccagcctggggggtccctgagactctcctgtgcagcctntgggttcagcgttagtcacagctacttgatctggccncaggctccgaggggagggctgggngtgcgtctntagttattatagacataactaccacctacacgcngcgtcgtagacgctacttcctatctacagagaactactcgaagacctacctactatactacaaagtacgaccgcccgtgaacggacgaccggacggtaccgacgggtcgtagttacttacgtggtcggcgggagggaggtacgttaacgttacggtttacggtttacgtttacgttactttaacgtttacctttacccgttaccggtacgggtaccggtaccggttaccggttcgg

SEQ ID NO: 368752 - DNA, 530 bp, Homo sapiens
  misc_feature: GZ8MTXP02I7A5P.25.37.D04.1.454.CMB.2.raw
  modified_base (467)..(467): a, c, t, g, unknown or other
  modified_base (479)..(479): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctggggggtccctgagactctcctgtgcagcctctgggttcagcgttagtcacagctacttgatctgggtccgccagggctccgagggaagggctggagtgcgtctcagttattatagcgataataccacctactacgcagactccggtgaacgggccgattccttatctccagagacaatccagacacctctatctcaaatgaaacgccctgacgagccgagacacggccgtgtattacngtgcgcgggganatacgtagtggttattcgattaactacttcctactcgggcacggttcctcg

SEQ ID NO: 368753 - DNA, 544 bp, Homo sapiens
  misc_feature: GZ8MTXP02GYIUH.25.37.D04.1.454.CMB.2.raw
  modified_base (203)..(203): a, c, t, g, unknown or other
  modified_base (364)..(364): a, c, t, g, unknown or other
  modified_base (379)..(379): a, c, t, g, unknown or other
  modified_base (404)..(404): a, c, t, g, unknown or other
  modified_base (519)..(519): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccaggggaaanagccacctctcctgcagggccagtcagagtgttatcaggtacttagcctggtaccaacagaaacctggccaggcctccgaggcctcctcatctatgatgcatccaagcggccagtggcatcccagcctaggttcaggtcggcaggtggggctggggacagngttcactctacaccntcagcagtcgtggacgctagaagtntttgacttagtttacttacgttgtcagcagtcgtaggctaggttcggtccgttacggggtactaggtttcggacgtaggggaccaggtcgtggagacgtacgaaacgacgttggngcgtacgaccgactactcgtcgttc

SEQ ID NO: 368754 - DNA, 625 bp, Homo sapiens
  misc_feature: GZ8MTXP02GELN7.25.37.D04.1.454.CMB.2.raw
  modified_base (467)..(467): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagcgttagtcacagctacttgatcgtgggtccgccaggcctccgaggggaggggctggagtgcgtctctagttattagtagcgtaataactaccacctactacgcacgtactccggtaggaaacgggcctatttccttatcctaccaagacgaactaattcccaaggaacctaccctctactcttacaaatcgaaaccnccctagacgacgaccgacggaccgacggtccgttagtattacgtggtcggcggacgggggaagtacttacggtaggttcgggtttaactttcggtaactttaaccgtttaccttttacccgtacggttcgggggtaccctacggtttccggtttcccg

SEQ ID NO: 368755 - DNA, 555 bp, Homo sapiens
  misc_feature: GZ8MTXP02JFA4H.25.37.D04.1.454.CMB.2.raw
  modified_base (483)..(483): a, c, t, g, unknown or other
  modified_base (496)..(496): a, c, t, g, unknown or other
tcagactgtacagtcacgaccggtgctcgatttagtagcatactgttgggtttgggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctggggggtccctgagactctcctgtgcagcctctgggttcagcgttagtcacagctacttgatctgggtccgccaggctccgaggggaggggctggagtgcgtctcagtttattatagccgataataccacctactacgcagactccggtgaacggggcctatttccttatctccagagacaattccaggaaccaccctctatcttacaaaatgaaaccgccctagagacgcccgaggaccacggccgtgtattacngtgcggcgggganatacgtagttgttattcgattaactctttccctacgtcggggcctacggggttccctgg

SEQ ID NO: 368756 - DNA, 654 bp, Homo sapiens
  misc_feature: GZ8MTXP02JNPT9.25.37.D04.1.454.CMB.2.raw
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcttgggttttccttgttgcttgttttaaaaggtgtccagtgtgaggtgcagctggcggagtctgggaggaggcctgatccagccgtgggggtcctgagactctcctgtgcagcctcgtgggttcagcgttagtcacagctacttgatcgtcgggtcccgccaggcctccggaggggaaggggctgggagtcgcgtctcgtaagtttattatagaccgtaataactacccacctactacgcacgactcggtaggaagggcctaatttccttaatcctaccaagaacgaactaacttacccgaaggaacccaccttctaactacttaacaaaatcgaaacctcccgtagaacgacgacccgaagtaaccgacgggtacccttagttaactttaccgtggtcgggacgggacgggataacgttacgttaggtttacgtttacgtttacgtaactttaacccgttaccctttacccgtacggtcggggtacccgttaccgggtttccctcgg

SEQ ID NO: 368757 - DNA, 710 bp, Homo sapiens
  misc_feature: GZ8MTXP02JPLNB.25.37.D04.1.454.CMB.2.raw
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgtttaaaaggtgtccagtgtgaggtgcagctggcggagtctggaggaggcctgatccagccgtgggggtccctgagactctcctgtgcagcctcgtgggttcagcgttagtcacagctacttgatcgtggtccgcaggcctccgaggggaacggggctggagtgcgtctcgtagttattatagaccgaataactacccaccttacgtaccgacacgacctccgggtagaaacggggtccgtaactttcccttaatccctacccaaggaacgaaactaaacttcccgaaacggtaaaccctacccctttactaacttacctttaaacaaaagttccggaaaacccgccccgttaggaaacgacgggaccccggaaaggaccgaccgggtaccggttagttaacgtttacgtgggtaggcccggggtacgggggaataacgttaaccgttagggtttacggtttaacgtttaccggtaactttaaccgtttaccgtttaccccgtacggttcgggggtccccttaacgggggtttccccttacgggg

SEQ ID NO: 368758 - DNA, 536 bp, Homo sapiens
  misc_feature: GZ8MTXP02I8RSO.25.37.D04.1.454.CMB.2.raw
  modified_base (366)..(366): a, c, t, g, unknown or other
  modified_base (477)..(477): a, c, t, g, unknown or other
  modified_base (483)..(483): a, c, t, g, unknown or other
  modified_base (519)..(519): a, c, t, g, unknown or other
tcagactgtacagtcacgaccggtgctcgatttagtagcatactgttgggtttgggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctgggggtccctgagactctcctgtgcagcctctgggttcagcgttagtcacagctacttgatctgggtccgccaggctccgaggggaaggggctgggagtgcgtctcagttattatagccgataataccactactacgcngactccgtgaagggccgattccttatctccagagacaattccaggaccaccctctatcttacgaaatgaaaccgccctgagagccgagacacggcgtgtatacgtgtgcgnggggancgtactagtgttattcgattaacgtacttcctacgngggcctagggtccctgg

SEQ ID NO: 368759 - DNA, 535 bp, Homo sapiens
  misc_feature: GZ8MTXP02F5ZDO.25.37.D04.1.454.CMB.2.raw
  modified_base (202)..(202): a, c, t, g, unknown or other
  modified_base (363)..(363): a, c, t, g, unknown or other
  modified_base (393)..(393): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccaggggaanagccaccctctcctgcagggccagtcagagtgttatcaggtacttagcctggtaccaacagaaacctggccaggctcccaggcctcctcatctatgatgcatccaagacggccactggcatccccagccaggttcagtggcaggtggggctggggacaggngttcactctacaccatcagcagtcgtgganccgtgaagtattttgcttagtttattactgtcagcagtcgtagctaggttggccgtcggggtactggtttcggcgtaggggaccgaaggcgtagggagacgtacgaaacgaacgtggtggctcggacaccacgttctgttcc

SEQ ID NO: 368760 - DNA, 663 bp, Homo sapiens
  misc_feature: GZ8MTXP02HDH9K.25.37.D04.1.454.CMB.2.raw
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctgtgggtcagcgttagtcacagctacttgatctgggtccgccaggcctccgaggggaaggggctgggagtgcgtctcagttatttatagcgaataaactaccacctactacgcagactccgtagaaagggcccgtaatttcccttaatcctacccaagacgaactaaattcccgaaaggaacccacccttactaatccttacgaaaaacttcgaaaccgcccttagaagacgaccccggaaggacccaacgggcccgttaggttaacttaaccgtggtggaccggacggggggtaataagttaaccgttaaggttgggtttaactttccggaaattttaacccgtttacttttacccccgtaggttcgggggaccccttaaaccgggggtttcccgttaccgggg

SEQ ID NO: 368761 - DNA, 661 bp, Homo sapiens
  misc_feature: GZ8MTXP02JIY8N.25.37.D04.1.454.CMB.2.raw
  modified_base (303)..(303): a, c, t, g, unknown or other
  modified_base (466)..(466): a, c, t, g, unknown or other
  modified_base (549)..(549): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcaggtcgttagtcacagctacttgatcgtgggtccncaggcctccgaggggaggggctggagtgcgtctacgtagtttatttagagacaataactacccacctactaaccgcagacctccggaggaacgggcctatttccctatcctccaagtacgaactaattcccgaaagtaaccctacccttactattaccgttanaaaacgtcgaaaccggtcccctaggaacgacgggaccccgtaagggaccgtaaccgggtccgttaagttaccttacggtcggngggcccgggagggggtaaatacgttacgttaagggttcggtttaacttcgtaactttaaccgttacccgttttcccgacgggtcgggggacccttacggggtttccccctgg

SEQ ID NO: 368762 - DNA, 578 bp, Homo sapiens
  misc_feature: GZ8MTXP02IS3K2.25.37.D04.1.454.CMB.2.raw
  modified_base (344)..(344): a, c, t, g, unknown or other
  modified_base (397)..(397): a, c, t, g, unknown or other
  modified_base (423)..(423): a, c, t, g, unknown or other
  modified_base (431)..(431): a, c, t, g, unknown or other
  modified_base (443)..(443): a, c, t, g, unknown or other
  modified_base (465)..(465): a, c, t, g, unknown or other
  modified_base (481)..(481): a, c, t, g, unknown or other
  modified_base (495)..(495): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagcgttagtcacagctacttgatcgtgggtcccgcaggcctccgagggagggctggagtgcgtctcagtttattanagcgtataactaccactactacgcagactccgtagaacggccgatttccttanctccagagacaattccagaccacctntatcttanaaatcgaaaccncctagacgaggcccgaggaacncggcgtagtattacgngtgcggtcgggganacgttaacgtaggttggtttaactttcgtaatttaaccttaccgtttcccgtaaggtcggggtacctacggggtttcccctgg

SEQ ID NO: 368763 - DNA, 618 bp, Homo sapiens
  misc_feature: GZ8MTXP02JLKVV.25.37.D04.1.454.CMB.2.raw
  modified_base (207)..(207): a, c, t, g, unknown or other
  modified_base (260)..(260): a, c, t, g, unknown or other
  modified_base (265)..(266): a, c, t, g, unknown or other
  modified_base (270)..(270): a, c, t, g, unknown or other
  modified_base (278)..(278): a, c, t, g, unknown or other
  modified_base (302)..(302): a, c, t, g, unknown or other
  modified_base (304)..(304): a, c, t, g, unknown or other
  modified_base (306)..(306): a, c, t, g, unknown or other
  modified_base (316)..(316): a, c, t, g, unknown or other
  modified_base (354)..(354): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcgtggtttcgtgtaggctgtttaaagtgtcagtgtgaggtgcagctggcgagtctggaggnggcctgatccagccgtgggggtccctgagctctcctgtgcagctctggttcgngtgtnnacanctactgtntcgtcgtcgcgcgcgcgaggaggngngngtgtcgtctntagttatagtagtacgtataactactactactacgacncgtacgtacgtacgacgtacgtacttacttactactacacgacgaactacgtacgacgtaacctacctactactactaactaaactacgtaaccgacgtacgacgacgacggaacggaacggaccggtacggtacgttacgttacgtacggtacggtacgggtacgggtaggtacgtacgttaacggttacgtttacgtttacgttaacgtttaacgttaccgttacccgttacggtacggtaccggtaccggttaccggtcgg

SEQ ID NO: 368764 - DNA, 540 bp, Homo sapiens
  misc_feature: GZ8MTXP02JU48Y.25.37.D04.1.454.CMB.2.raw
  modified_base (202)..(202): a, c, t, g, unknown or other
  modified_base (237)..(237): a, c, t, g, unknown or other
  modified_base (308)..(308): a, c, t, g, unknown or other
  modified_base (358)..(358): a, c, t, g, unknown or other
tcagactgtacagtcacgaccggtgctcgatttagtagcatactgttgggtttggggaggaactgctcagttaggacccagagggaaccatggaagccccagctcagcttctcttcctcctgctactctggctcccagatagcaccggagaagttgtgttgacacagtctccagacaccctgtctttgtctccaggggaaangccaccctctcctgcagggccagtcagagtgttancaggtacttagcctggtaccaacagaacctggccaggcctcccaggctcctcatctatgatgcatccaagnggccactggcatcccagccaggtcagtcggcaggtggggctggggacagngttcactctcaccatcagcagtctggacgcctgaagtatttgtactagtttattacttgtcagcagcgtagacgtagttcggccgttccgggggtacgtaggttttcggaccggtacggggaccgaaggcgtaggacggacgtacgaaacgacgtaggtggcgtcgacacgactcgtcgttc

SEQ ID NO: 368765 - DNA, 555 bp, Homo sapiens
  misc_feature: GZ8MTXP02IAXOO.25.37.D04.1.454.CMB.2.raw
  modified_base (340)..(340): a, c, t, g, unknown or other
  modified_base (365)..(365): a, c, t, g, unknown or other
  modified_base (420)..(420): a, c, t, g, unknown or other
  modified_base (438)..(438): a, c, t, g, unknown or other
  modified_base (492)..(492): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctggggggtccctgagactctcctgtgcagcctcgtggttcagcgttagtcacagctacttgatctggtccgcaggctccgaggggaagggctggagtgcgtctcagttattanagccgataactaccactactacgcngactccgagaacggccgtattccttatctccagagacattccaggaaccaccctntatcttcaaatcgaaacnccctgacgagcccgaggaccacggccgtgtacttacgtgtcggcggcggggganacgtacgtagttggttactttcgattaacttacttcctacgtggggcctaggggttccctcgg

SEQ ID NO: 368766 - DNA, 542 bp, Homo sapiens
  misc_feature: GZ8MTXP02GL3N0.25.37.D04.1.454.CMB.2.raw
  modified_base (203)..(203): a, c, t, g, unknown or other
  modified_base (261)..(261): a, c, t, g, unknown or other
  modified_base (290)..(290): a, c, t, g, unknown or other
  modified_base (309)..(309): a, c, t, g, unknown or other
  modified_base (359)..(359): a, c, t, g, unknown or other
  modified_base (378)..(378): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccaggggaaangccaccctctcctgcagggccagtcagagtgttatcaggtacttagcctggtaccaanagaaacctggccaggctcccaggctcctnatctatgatgcatccaagnggccatggcatcccagccaggttcaggtggcaggtggggctggggacagngttcactctacaccatcancagtctggagctagtaagtattttgcttaagtttattactgtacagtcagcgtagcgtagttcggccgtcggggtaactggtttacggccgtaggggaccaggcgtacgggaagacgtacgaaaacgtacgttaggcggctacgacaccgtatcgttcgtttcc

SEQ ID NO: 368767 - DNA, 629 bp, Homo sapiens
  misc_feature: GZ8MTXP02GJW8O.25.37.D04.1.454.CMB.2.raw
  modified_base (475)..(475): a, c, t, g, unknown or other
tcagactgtacagtcacgaccggtgctcgatttagtagcatactgttggggtttgggggggagaggagcccagcactgggattccgaggtgtttccattcggtgatcagcactgaacacagaggactcaccatggcgttttggctgagctgggttttccttgttgctgtttaaaggtgtccagtgtgaggtgcagctggcggagtctgggaggaggcctgatccagccgtggggggtccctgagactctcctgtgcagcctcgtgggttcagcgttagcacagctactgatcgtgggtccgcaggctccggaggggaaggggctgggagtgcgtctctagtttattagtagaccgataaactacccaacctactacgcagacctcgtaggaacgggcctaattccttatcctccgaagtacgaactaacttaccaacggaaccctaccctactactacttacaaaatcgaaaccncccgtagacgacggaccgacggaacacggtaccgtgtaattacgtggtcgcgggacggggtagtacgtaaacgttacggttaggtttaacttacgtaatttaaccttaaccgtttcccgtacgtccggggtaccgtacggggtttccctacggg

SEQ ID NO: 368768 - DNA, 575 bp, Homo sapiens
  misc_feature: GZ8MTXP02IF801.25.37.D04.1.454.CMB.2.raw
  modified_base (203)..(203): a, c, t, g, unknown or other
  modified_base (264)..(264): a, c, t, g, unknown or other
  modified_base (274)..(275): a, c, t, g, unknown or other
  modified_base (313)..(313): a, c, t, g, unknown or other
  modified_base (319)..(319): a, c, t, g, unknown or other
  modified_base (329)..(329): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcgtggtttcgtgtaggctgtttaaaaggtgtcagtgtgaggtgcagctggcggagtntggaggaggcctgatccagccgtggggggtccctgagctctcctgtgcagctctggttcgngtcgtgcacnnctactgtgtcgtcggtcgcgcgcgacggaggggagggnggtggngtgtcgtctntagttattagtagacgtataactacctaacctactacgacgacgtacgtacgtacggacggtaccgtacttacttactctacgacgacgactactacgacgaactacctactactactactaatacgacgctagagacgacgacgacgacgtcgtacgtagtagtgtgcggagggagtacgtacgttagttacgttacgttacgtacttaacgttacttacgtacgtcggtcggtacggttcgtcg

SEQ ID NO: 368769 - DNA, 514 bp, Homo sapiens
  misc_feature: GZ8MTXP02FJMDX.25.37.D04.1.454.CMB.2.raw
  modified_base (202)..(202): a, c, t, g, unknown or other
  modified_base (261)..(261): a, c, t, g, unknown or other
  modified_base (362)..(362): a, c, t, g, unknown or other
  modified_base (377)..(377): a, c, t, g, unknown or other
tcagactgtacagtcacgaccggtgctcgatttagtagcatactgttgggtttggggaggaactgctcagttaggacccagagggaaccatggaagccccagctcagcttctcttcctcctgctactctggctcccagatagcaccggagaagttgtgttgacacagtctccagacaccctgtctttgtctccaggggaaanagccaccctctcctgcagggccagtcagagtgttatcaggtacttagcctggtaccaanagaaacctggccaggctcccaggctcctcatctatgatgcatccaagacgggccacgtggcatcccagccaggttcagtcggcagtggggctggggacagngttcactctcaccancagcagtctggacgctgaagtattttgctagtttatactgtcagcagcgtagctagttggccgtcggggtactaggtttggccgaggggtaccaaggcgtggagtactacgaaacgactgtggctgcacagtctgtc

SEQ ID NO: 368770 - DNA, 522 bp, Homo sapiens
  misc_feature: GZ8MTXP02HS0M7.25.37.D04.1.454.CMB.2.raw
  modified_base (203)..(203): a, c, t, g, unknown or other
  modified_base (212)..(212): a, c, t, g, unknown or other
  modified_base (238)..(238): a, c, t, g, unknown or other
  modified_base (260)..(260): a, c, t, g, unknown or other
  modified_base (287)..(287): a, c, t, g, unknown or other
  modified_base (307)..(307): a, c, t, g, unknown or other
  modified_base (356)..(356): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccaggggaaangccaccctntcctgcagggccagtcagagtgttancaggtacttagcctggaccaanagaacctggccaggctccaggctcctnatctatgatgcatccaaagnggccatgtcatcccagccaggttcagtcggcaggtgggctggggacagngttcactctccacatcagcagtctgagcctgaagtattttgctagtttatactgtcagcagcgtagctagtcggccgtcggggtactaggtttcggaccgtaggggaccaaaggcgtacggagtacgtacgaaaacgtaacgtgtgctacgcacctatcctgttcc

SEQ ID NO: 368771 - DNA, 550 bp, Homo sapiens
  misc_feature: GZ8MTXP02JE7VD.25.37.D04.1.454.CMB.2.raw
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgtttaaaaggtgtccagtgtgaggtgcagctggcggagtctggaggaggcctgatccagcctggggggtccctgagactctcctgtgcagcctctgggttcagcgttagtcacagctacttgatctgggtccgccaggctccgaggggaaggggctggagtgcgtctcagttattatagccgataataccactactacgcagactccggtgaagggcccgtatttccctatctccagagacaattccagaaccacctctatcttcaaaatgaaacgccctgagagccgaggacacggccgtgtattactgtgcggcggggagatacgtagttggttattcgattaacgtactttcccgtacgtggggtcctacgggttccctcgg

SEQ ID NO: 368772 - DNA, 621 bp, Homo sapiens
  misc_feature: GZ8MTXP02IT7O1.25.37.D04.1.454.CMB.2.raw
  modified_base (251)..(251): a, c, t, g, unknown or other
  modified_base (253)..(253): a, c, t, g, unknown or other
  modified_base (261)..(261): a, c, t, g, unknown or other
  modified_base (266)..(266): a, c, t, g, unknown or other
  modified_base (269)..(270): a, c, t, g, unknown or other
  modified_base (273)..(273): a, c, t, g, unknown or other
  modified_base (275)..(276): a, c, t, g, unknown or other
  modified_base (303)..(303): a, c, t, g, unknown or other
  modified_base (308)..(308): a, c, t, g, unknown or other
  modified_base (318)..(318): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcgtggtttcgtgtaggctgtttaaagtgtcagtgtgaggtgcagctggcggagtctggaggaggcctgatccagccgtggggggtcctgacgctctcctgtgcncnctcgtgtngtgtncannctntnntcgtcggtcgcgcgcgcggagggaggngtggngtgtcgtctntagttattatagtacgtactaactacctacctactacgacacgtacgtcgtacggtacggtacgtacttcttactctacacgacactactacgacgacctacctactactactactaaactacgtaccgaccgtagacggacggaccgacggaccggacggtacggtacgttacgttacgtcggtcgggtacgggacgggtaggtacgtacgttacggttacggtttacgtttacgttacgtttaaccgtttaccgtttaccgttaccggttacgggtaccggttaccggtttaccggttcgg

SEQ ID NO: 368773 - DNA, 509 bp, Homo sapiens
  misc_feature: GZ8MTXP02FXY95.25.37.D04.1.454.CMB.2.raw
  modified_base (201)..(201): a, c, t, g, unknown or other
  modified_base (258)..(258): a, c, t, g, unknown or other
  modified_base (357)..(357): a, c, t, g, unknown or other
  modified_base (468)..(468): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctccagatagcaccggagaagttgtgttgacacagtctccagacaccctgtcttgtctccgaggggaangccacctctcctgcagggccagtcagagtgttatcaggtacttagcctggtaccaanagaaacctggccaggctccaggctcctcatctatgatgcatccaaggaggccagtggcatccccagccaggttcagtggcaggtggggctggggacagngttcactcacacatcagcagtctggagctagaagtatttgacttagtttatacttgtcagcagcgtagctagttggccgtcgggtatggtttgcgtagggacaggctgganagtacaaaacgactggaacggctacgacactatcgtgttac

SEQ ID NO: 368774 - DNA, 594 bp, Homo sapiens
  misc_feature: GZ8MTXP02G114V.25.37.D04.1.454.CMB.2.raw
  modified_base (495)..(495): a, c, t, g, unknown or other
  modified_base (510)..(510): a, c, t, g, unknown or other
tcagactgtacagtcacgaccggtgctcgatttagtagcatactgttgggtttggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagcgttagtcacagctacttgatctgggtccgccaggctccgaggggaaggggctgggagtgcgtctctagtttattatagcgtaataactaccacctactacgcagtacctcggtgaacgggcctatttccttatcctcaagagacaattcccaaggaccaccctctactacctacaaaatcgaaacgtccctagacgacgaccgaggacacggccgtgtaattacgngtcggcggcgggganactacgtaggttggttaactttcggtaactttaaccgttactttcccgtacggtcggggtaccctacggggtttccccttcggg

SEQ ID NO: 368775 - DNA, 540 bp, Homo sapiens
  misc_feature: GZ8MTXP02GAAAI.25.37.D04.1.454.CMB.2.raw
  modified_base (486)..(486): a, c, t, g, unknown or other
tcagactgtacagtcacgaccggtgctcgatttagtagcatactgttgggtttgggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctgggggtccctgagactctcctgtgcagcctctgggttcagcgttagtcacagctacttgatctgggtccgccaggctccgagggaagggctggagtgcgtctcagttatttatagcccgataataccacctactacgcagactccgtgaaggcctattcctatctccagagacattcccaggaccaccctctatctacaaatgaaacgccctgacgagcccgaggactacgggcctagtattactgtgacggcgggganactactagtcgttattcgattaactcttccctagtcgggccagggtttccctgg

SEQ ID NO: 368776 - DNA, 528 bp, Homo sapiens
  misc_feature: GZ8MTXP02JL7T6.25.37.D04.1.454.CMB.2.raw
  modified_base (202)..(202): a, c, t, g, unknown or other
  modified_base (260)..(260): a, c, t, g, unknown or other
  modified_base (308)..(308): a, c, t, g, unknown or other
  modified_base (355)..(355): a, c, t, g, unknown or other
  modified_base (357)..(357): a, c, t, g, unknown or other
  modified_base (386)..(386): a, c, t, g, unknown or other
  modified_base (396)..(396): a, c, t, g, unknown or other
  modified_base (427)..(427): a, c, t, g, unknown or other
tcagactgtacagtcacgaccggtgctcgatttagtagcatactgttgggtttggggaggaactgctcagttaggacccagagggaaccatggaagccccagctcagcttctcttcctcctgctactctggctcccagatagcaccggagaagttgtgttgacacagtctccagacaccctgtctttgtctccaggggaaanagccaccctctcctgcagggccagtcagagtgttatcaggtactagcctggtaccaanagaaacctggccaggctcccaggctcctcatctatgatgcatccaagnggccatggcatcccagccaggttcagtggcaggtggggctggggacngngttcactctcaccatcagcagtctggacnccgtgaagtnttttgctagttattactgtcagcagcgtagntagttggaccgtcggggtactcggtttggaccagggggtaccaggcgtaggacgacgtacgaaaacgacgttgaacggtctcggaccactactcgttatcc

SEQ ID NO: 368777 - DNA, 590 bp, Homo sapiens
  misc_feature: GZ8MTXP02JOGON.25.37.D04.1.454.CMB.2.raw
  modified_base (302)..(302): a, c, t, g, unknown or other
  modified_base (515)..(515): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgtttaaaggtgtccagtgtgaggtgcagctggcggagtcgtgggaggaggcctgatccagccgtgggggtccctgagactctcctgtgcagcctcgtgggttcagtcgttagcacagctacttgatcgtcgggtccnccgaggcctccggaggggaaggggctgggagtgcgtctcgtaagtttattatagccgaataactacccaacctactacgcacgctccggtaggaacggtcctatttccctatctaccagagacaattccgaagaccaccctctactcttacaaatcgaccgccctgacgacgaccgagaccgacggccgtgtattacgtgtgcggacgggganacgtaagtaggttagttactttacgagtttaaccttacctttcccgtacgtcggggtacctacgggttccctcgg

SEQ ID NO: 368778 - DNA, 536 bp, Homo sapiens
  misc_feature: GZ8MTXP02J1LZX.25.37.D04.1.454.CMB.2.raw
  modified_base (203)..(203): a, c, t, g, unknown or other
  modified_base (261)..(261): a, c, t, g, unknown or other
  modified_base (358)..(358): a, c, t, g, unknown or other
  modified_base (367)..(367): a, c, t, g, unknown or other
  modified_base (415)..(415): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccaggggaaangccaccctctcctgcagggccagtcagagtgttatcaggtacttagcctggtaccaanagaacctggccaggctcccaggctcctcatctatgatgcatccaagaggccatggcatcccagccaggttcaggtggcagtggggctggggacaggngttcactcncaccatcagcagtctggagcctgagtatttgctagtttattactgtcngtcagcgtagctagttcggccgtccggggtactaggtttggccgtagggggaccaaggcgtagggacgtaacgtacgaaaacgtaacgttcggtggtctcggactacccgattcctgttcc

SEQ ID NO: 368779 - DNA, 561 bp, Homo sapiens
  misc_feature: GZ8MTXP02FZCWM.25.37.D04.1.454.CMB.2.raw
  modified_base (364)..(364): a, c, t, g, unknown or other
  modified_base (493)..(493): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctggggggtccctgagactctcctgtgcagcctctgggttcagcgttagtcacagctacttgatcgtgggtccgcaggctccgagggaggggctggagtgcgtctcagttattatagcgataataccactactacgcngactccgtgaagggccgtattccttatctcagacgaacaattccagaaccaccctactatcttacaaatcgaaaccgccctgacgacgaccgaggacacggccgtagtattacgtgtgcggacgggganactacgtagtaggtttacttcgtaattaactactttacctacgtcgggtaccgtacgggttccctcgg

SEQ ID NO: 368780 - DNA, 572 bp, Homo sapiens
  misc_feature: GZ8MTXP02GC71A.25.37.D04.1.454.CMB.2.raw
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctggggggtccctgagactctcctgtgcagcctctgggttcagcgttagtcacagctacttgatctgggtccgccaggctccgaggggaggggctggagtgcgtctcagttatttatagcgataataccacctactacgcagactccgtgaagggccgattcctatctccagagacaattccaggaaccacctctatcttacaaatcgaaaccgccctagacgaggccgaggaccacgggccgtagtacttacgtggtggcggcgggggatattacgtagttggtttactttcggtatttaaccttactttcccgtacgtggggtccctaggggtttcccttcggg

SEQ ID NO: 368781 - DNA, 613 bp, Homo sapiens
  misc_feature: GZ8MTXP02FH9A5.25.37.D04.1.454.CMB.2.raw
  modified_base (292)..(292): a, c, t, g, unknown or other
  modified_base (339)..(339): a, c, t, g, unknown or other
tcagactgtacagtcacgaccggtgctcgatttagtagcatactgttgggtttgggggagaggagcccagcactgggattccgaggtgtttccattcggtgatcagcactgaacacagaggactcaccatggcgttttggctgagcgtggtttcgtgtagctgtttaaagtgtcagtgtgaggtgcagctggcggagtctggaggaggcctgatccagccgtggggggtccctgagactctcctgtgcagcctctgggttcagcgttagcacagctacttgatctgggtccnccaggctccgaggggaggggctgggagtgcgtctcagtttatttaanagctaataactaccacctacacgcacgactcgtaggacgctatttcctatctacagacaactactcccgaacgaacctaccctactactacttaacaaacgtcgaaaccgtccctaggacggacggaccggaacggaccgtaccggtcgttagtacttacgtggtcggacgggacggggaggtacgtacgttacggttacggtttacgtttacgttacgtttaaccgttacctttacccgttaccggtacgggtaccggtaccggttccggtcg

SEQ ID NO: 368782 - DNA, 654 bp, Homo sapiens
  misc_feature: GZ8MTXP02G8WE9.25.37.D04.1.454.CMB.2.raw
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagtcgttagtcacagctacttgatcgtcgggtcccgccgagggcctccgaggggaaggggctgggagtgcgtctcgagtttattatagccgtaataactaccacctactacgcagacctcggtagacgggccgtatttccttatcctccgaagacgaacaattacccgaaggaaccctaccctctactacttacgaaaatcgaaaccgccctaggacgacggccgaacggaccgaaccggggtcgttacgttaacttaccgtgggtcgacgggacgggggaagtacgttaacgttaggttggttttaaacgttcgttaaaactttcccgttaacgttttcccccgtacggttcgggggtacccttaacggggtttcccttaccggg

SEQ ID NO: 368783 - DNA, 528 bp, Homo sapiens
  misc_feature: GZ8MTXP02FKX3X.25.37.D04.1.454.CMB.2.raw
  modified_base (204)..(204): a, c, t, g, unknown or other
  modified_base (260)..(260): a, c, t, g, unknown or other
  modified_base (307)..(307): a, c, t, g, unknown or other
  modified_base (509)..(509): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccgaggggaaangccaccctctcctgcagggccagtcagagtgttatcaggtactgcctggtaccaanagaactggccaggctcccaggctcctcatctatgatgcatccaaagnggccagtggcatcccagccaggttcagtcggcaggtggggctggggacagcgttcactctacaccatcagcagtcgtggagcctagtaagtattttgactagtttattacgtgtctagcagtcgtagcgtagttcggccgtcggggtacgtaggtttgggaccgtacggggaccagcgtggagtacgtacgaaacgacgtgnggctcgcactatctgttcc

SEQ ID NO: 368784 - DNA, 552 bp, Homo sapiens
  misc_feature: GZ8MTXP02HC7JM.25.37.D04.1.454.CMB.2.raw
  modified_base (475)..(475): a, c, t, g, unknown or other
  modified_base (489)..(489): a, c, t, g, unknown or other
tcagactgtacagtcacgaccggtgctcgatttagtagcatactgttgggtttgggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctgggggtccctgagactctcctgtgcagcctctgggttcagcgttagtcacagctacttgatctggtccgccaggctccgaggggaaggggctggagtgcgtctcagttattatagccgataataccacctactacgcagactccgtgaagggccgattccttatcctccagagacaattccaggaaccaccctctatcttacaaaatgaaacgccctagagagccgaggaccacggccgtgtattacngtcgcggcgggganactacgagttggttacttcgaattaacgtactttcccgtacgtcgggcctacgggttccctgg

SEQ ID NO: 368785 - DNA, 647 bp, Homo sapiens
  misc_feature: GZ8MTXP02HPUNB.25.37.D04.1.454.CMB.2.raw
  modified_base (350)..(350): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcgtggtttcgtgtagctgtttaaagtgtcagtgtgaggtgcagctggcggagtctggaggaggcctgatccagccgtgggggtccctgagactctcctgtgcagcctcgtgggttcagtcgttagtcacagctacttgatcgtggggtcccgccagggcctaccgaggggaaggggtctgggagtgcgtctctagtttatttanaggcctaataaactaccctaacgtactaccgcacggtaaccttccggtaggaacggggtccctaatttcccttaactcctacccaaggtacgaaacctaactttacccgaaacggaaaccctaaccccttctaacttacctttaaccgaaaattccggaaaccgtccccttaggacgacggaccgaggaccacgggcgtgtacttacgtgcggccggaggggtagattacgtaggttaggttatttacgatttaaccgttactttccccgtagtcgggtccgtacgggtttcctcgg

SEQ ID NO: 368786 - DNA, 549 bp, Homo sapiens
  misc_feature: GZ8MTXP02IT8V2.25.37.D04.1.454.CMB.2.raw
  modified_base (204)..(204): a, c, t, g, unknown or other
  modified_base (293)..(293): a, c, t, g, unknown or other
  modified_base (412)..(412): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccgaggggaaanacgccaccctctcctgcagggccagtcagagtgttatcaggtacttagcctggtaccaacagaaacctggccaggctcccaggctcctnatctatgatgcatccgaaaggcgggccacgtggaccactcccagcctaggttcaggtcggcgaggtggggctgggacagtgttcactctacacatcagcagtgtggacgcgtagaagtntttgacttagtttattactgtacagcagtcgtagcgtaggttcggccggtcgggtatggtttacggacgagggtacaggcgtagggacgactacgaaacgtacgtaggtaagtcgtacgactacctagtctacgttc

SEQ ID NO: 368787 - DNA, 593 bp, Homo sapiens
  misc_feature: GZ8MTXP02F51TA.25.37.D04.1.454.CMB.2.raw
  modified_base (299)..(299): a, c, t, g, unknown or other
  modified_base (492)..(492): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagcgttagtcacagctacttgatctggtccncaggctccgaggggagggctggagtgcgtctctagttattatagcgataactaccacctactacgcagacctccgtagaaacgggcctaatttccttaatcctaccagacgaacaattcccaaggaaccaccctctaatcttacaaaatgaaaccgccctagacgacgccgagacacgggcctagtattacgnggtcgcggcgggggatacgtacgttaggttcgtttaattcgtaatttaaccttacctttacccgtacgtcgggggtaccctacgggggtttcccctacggg

SEQ ID NO: 368788 - DNA, 556 bp, Homo sapiens
  misc_feature: GZ8MTXP02JNAPH.25.37.D04.1.454.CMB.2.raw
  modified_base (485)..(485): a, c, t, g, unknown or other
  modified_base (499)..(499): a, c, t, g, unknown or other
tcagactgtacagtcacgaccggtgctcgatttagtagcatactgttgggtttgggggagaggagcccagcactgggattccgaggtgtttccattcggtgatcagcactgaacacagaggactcaccatggcgttttggctgagctgggttttccttgttgctgttttaaaggtgtccagtgtgaggtgcagctggcggagtctggaggaggcctgatccagccgtggggggtccctgagactctcctgtgcagcctctgggttcagcgttagtcacagctacttgatcgtgggtcccgccagggcctccgaggggaaggggctgggagtgcgtctcagttatttatagccgataataccacctactacgcagactccggtgaagggccatttccttatcctccagagaacattcccaagaccaccctctatcttacaaaatgaaacgccctagagacgccgaggacacgggccgtgtattacngtggcggcgggganactacgtagtggttattcgattaactactttacccagtcgggcctagggttccctgg

SEQ ID NO: 368789 - DNA, 588 bp, Homo sapiens
  misc_feature: GZ8MTXP02GCRQR.25.37.D04.1.454.CMB.2.raw
  modified_base (297)..(297): a, c, t, g, unknown or other
  modified_base (420)..(420): a, c, t, g, unknown or other
  modified_base (502)..(502): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctgggggtccctgagactctcctgtgcagcctctgggttcagcgttagtcacagctacttgatctggtccnccaggctccgagggaggggctggagtgcgtctcagttattatagccgataataccacctactacgcagactcgtagaacggccgattccttatctccagagacaattcccagaaccacccttnacttcttacaaatcgaaaccgccctagacgacgaccgaaggaccacgggcccgtagtacttacgtggtggcggcgggggaanacttaacgtaggttgggtttaactttccgtaatttaaccttacctttcccgtacgtcgggggccctacgggggtttccccttcggg

SEQ ID NO: 368790 - DNA, 698 bp, Homo sapiens
  misc_feature: GZ8MTXP02H4SZ5.25.37.D04.1.454.CMB.2.raw
  modified_base (308)..(308): a, c, t, g, unknown or other
  modified_base (602)..(602): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagtcttgggttttccttgttgcttagttttaaaaggtgtccagtgtgaggtgcagctggcggagtctggaggaggcctgatccagccgtgggggtccctgagactctcctgtgcagcccttcgtgggttcagcgttagtcacagctactgatcgtcggggtccnccgagggcctccgaagggggaaggggctggggagtcggccgttctataagtttattagagaccgaattaaactacccaactaacgtacgcagtaccgtccggtaggaaacgggtccctactttacccttaacgtccctaccaaaggtacaacctaaacttccccgaaaggtaaacccacccccttataacttcccgttaaacaaaaacgttccgaaacccgcccgttaggaacggacggaccgaaggacccttacggggccttaggttacttacgtgcggaccgggaggggtanaacttacgtaaggttggtttactttaccgaattttaacccgttaccgttacccccgtaaggtccggggacccgtttaacggggtttcccccgtcgg

SEQ ID NO: 368791 - DNA, 580 bp, Homo sapiens
  misc_feature: GZ8MTXP02FT81L.25.37.D04.1.454.CMB.2.raw
  modified_base (203)..(203): a, c, t, g, unknown or other
  modified_base (412)..(412): a, c, t, g, unknown or other
  modified_base (421)..(421): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccaggggaaanagccaccctctcctgcagggccagtcagagtgttatcaggtacttagcctggtaccaacagaaacctggccaggctcccaggcctcctcatctatgatgcatccaaaggacgggccacgtggccactccccgagcccagggtttcaggtcggcaggtggggctggggactagggcgttccactctaccaccatcaagcagtctgggacncctgaagtnttttgcttagtttattacgtgtcagtcagtcgtagcgtaggttcggccgttccgggggttactaggtttcggacccggtaggggtaaccaaggcgtagggacgtaactaccgaaaacgtacgttaggcggtcctacggcctaccgtattctcgtttccc

SEQ ID NO: 368792 - DNA, 614 bp, Homo sapiens
  misc_feature: GZ8MTXP02GBBPP.25.37.D04.1.454.CMB.2.raw
  modified_base (348)..(348): a, c, t, g, unknown or other
  modified_base (505)..(505): a, c, t, g, unknown or other
  modified_base (508)..(508): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctctgggttcagcgttagtcacagctacttgatcgtgggtccgccaggcctccgaggggaggggctgggagtgcgtctcgtagttattanagacgataactaccacctacacgcacgtactccgtaggaacgggcctatttccttatcctccaagacgactaaagttcccaaacggacctccctattactacttaacaaatcgaaacctcctagacgacgccgaacgacacggcgtagtacttacgnggngtacgggcggggaaatcgttaacggtaggttacggtttaacttccggtaatttaaccgttaacctttccccgtacgggtcgggtaaccgtcgggtttccccgtagg

SEQ ID NO: 368793 - DNA, 519 bp, Homo sapiens
  misc_feature: GZ8MTXP02F91RX.25.37.D04.1.454.CMB.2.raw
  modified_base (202)..(202): a, c, t, g, unknown or other
  modified_base (261)..(261): a, c, t, g, unknown or other
tcagactgtacagtcacgaccggtgctcgatttagtagcatactgttgggtttggggaggaactgctcagttaggacccagagggaaccatggaagccccagctcagcttctcttcctcctgctactctggctcccagatagcaccggagaagttgtgttgacacagtctccagacaccctgtctttgtctccaggggaaanagccaccctctcctgcagggccagtcagagtgttatcaggtacttagcctggtaccaanagaaacctggccaggctcccaggctcctcatctatgatgcatccaagagggccacgtggcatcccagccaggttcagtcggcaggtggggctggggacagtgttcactctcaccatcagcagtctggagcctgaagtatttgctagtttattactgtcagtcagcgtagcagttggccgtcggggtactggtttggcgacggggtaccgaagcgtggagagtacgaaacgacgtggtaagcgtcgcaccatctgttcc

SEQ ID NO: 368794 - DNA, 657 bp, Homo sapiens
  misc_feature: GZ8MTXP02I2SMR.25.37.D04.1.454.CMB.2.raw
  modified_base (303)..(303): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcttgggttttccttgttgcttgttttaaaaggtgtccagtgtgaggtgcagctggcggagtcgtgggaggaggcctgatccagccgtgggggtccctgagactctcctgtgcagcctcgtggttcagcgttagtcacagctacttgatctgggtccnccaggctccgaggggaaggggctgggagtgcgtctctagtttattagtagaccgaataactacccaccttactacgcagacctccggtaggaacgggcccgtatttcccttaatcctacccagaacgaactaaacttcccgaaaggaaccctaaccccttctaactaccttacaaaattacgaaacccgccccttagacgacggacccgaaggaccaccggggtccgttagttacttacgtggtcggcgggtacgggggataacgttacgttaggtttggtttaaactttcgtaaactttaaccttaaccttttcccgtacggtcggggacccttacggggttccccttacggg

SEQ ID NO: 368795 - DNA, 587 bp, Homo sapiens
  misc_feature: GZ8MTXP02HNXPP.25.37.D04.1.454.CMB.2.raw
  modified_base (366)..(366): a, c, t, g, unknown or other
  modified_base (501)..(501): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcttgggttttccttgttgctgttttaaaaggtgtccagtgtgaggtgcagctggcggagtctggaggaggcctgatccagccgtgggggtccctgagactctcctgtgcagcctctgggttcagcgttagtcacagctacttgatcgtggtccgcaggctccgaggggaaggctggagtgcgtctcagttattatagcgataactaccacctactaccgnagacctacgtgaacgggtcctattcccttatcctccaagacgacaattccaagaaccaccctctactacgttacaaatcgaaacgccctagacgacgcccgaaggaccacggtccgtagtattacgtggtgcggngggggacacgttacgtaggtagtttactttcgtaatttaaccgttactttccctacggtcggggtaccctacggggtttccctcgg

SEQ ID NO: 368796 - DNA, 560 bp, Homo sapiens
  misc_feature: GZ8MTXP02FYSOQ.25.37.D04.1.454.CMB.2.raw
  modified_base (300)..(300): a, c, t, g, unknown or other
  modified_base (493)..(493): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctctgggttcagcgttagtcacagctacttgatcgtgggtccnccaggctccgaggggaaggggctgggagtgcgtctcagttatttatagccgataactaccacctactacgcagactccgtagaacgggcctatttcctatctccagagacaattccagacaccctctatcttacaaatgaaacgccctgacgagccgaggacacggccgtgtattacgtgtcgcggcgggganacgtacgttagtgtttacttcgtaattaacttactttccctacgtcgggtacctacgggttcctcgg

SEQ ID NO: 368797 - DNA, 585 bp, Homo sapiens
  misc_feature: GZ8MTXP02I02JJ.25.37.D04.1.454.CMB.2.raw
  modified_base (423)..(423): a, c, t, g, unknown or other
  modified_base (446)..(446): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctgggggtcctgagctctcctgtgcagcctcgtggttcagcgttagtcacagctacttgatcgtgggtccgccaggctccgaggggaaggggctggagtgcgtctcagtttattatagccgtaatactaccacctactaccgcagacctccgtgaacgggccgattccttatcctccagagacaattccaagaaccncctctatcttacgaaatcgaacnccctgacagccgacgacgacggccgtagtcttacgtgtcgccggcgggaagacgtagttaggttcgggttaatttcggtaactttaacgttaccttttacccgtaacgtcggggtaccgtacgggtttcccgtttccgg

SEQ ID NO: 368798 - DNA, 599 bp, Homo sapiens
  misc_feature: GZ8MTXP02GMCY0.25.37.D04.1.454.CMB.2.raw
  modified_base (434)..(434): a, c, t, g, unknown or other
  modified_base (506)..(506): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctctgggttcagcgttagtcacagctacttgatcgtggtccgcaggctccgaggggaaggggctggagtgcgtctcagttatttatagccgaataactaccacctactaccgcagactccggtagaacgggccgtaatttcccttatcctccagagacaattccaggaaccaccctntatcttacgaaatcgaaacgccctgagacgccgaggacacggccgtgtacttacgtgtcgcggcgggggaanacgttaacgttaggttggtttaactttcggtaatttaaccttaccgttttaccctacggttcgggggtccctacggggtttccccgtttcggg

SEQ ID NO: 368799 - DNA, 578 bp, Homo sapiens
  misc_feature: GZ8MTXP02FF5G6.25.37.D04.1.454.CMB.2.raw
  modified_base (371)..(371): a, c, t, g, unknown or other
  modified_base (497)..(497): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctggggggtccctgagactctcctgtgcagcctctgggttcagcgttagcacagctacttgatcgtgggtccgccaggctccgaggggaaggggctgggagtgcgtctctagttatttatagcgtataactacacctactacgnacgacctccgtaggaacggggcctattcctatctccagagacatcccaggaaccaccctctatacttacaaaactgaaaccgccctagagacggacgacggaccgacggccgttagtattacgtgnggcggcggggagtactacgtagtagtttattcgtaattaaccgtactttccgacgtcggggtaccacgggtttccctacgg

SEQ ID NO: 368800 - DNA, 608 bp, Homo sapiens
  misc_feature: GZ8MTXP02I1LHM.25.37.D04.1.454.CMB.2.raw
  modified_base (297)..(297): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctgggggtccctgagactctcctgtgcagcctctgggttcagcgttagtcacagctacttgatctggtccncaggctccgagggagggctggagtgcgtctcagttattatagccgataataccactactacgcagactccgtgaacgggccgattccttatctccagagacaattccaaggaccaccctactatcttacgaaaatcgaaaccgcccctagaacgaggacccgaagggaccacgggccgtagtattacgtggtcgcggcgggggaatattaacgttaggttggtttaaacttttccggtaaattttaacccgttaccctttttaccccgtacggttcgggggtaccctaacgggggttttccccctttgggg

SEQ ID NO: 368801 - DNA, 653 bp, Homo sapiens
  misc_feature: GZ8MTXP02GSXDH.25.37.D04.1.454.CMB.2.raw
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcttgggttttccttgttgctgttttaaaaggtgtccagtgtgaggtgcagctggcggagtctggaggaggcctgatccagccgtgggggtccctgagactctcctgtgcagcctcgtgggttcagtcgttagtcacagctacttgatcgtggtccgccaggcctccgaggggaagggcgtggagtgcgtctctagttattatagccgtaataactaccaaccttactaccgacagacctccggtaggaacgggccgtactttccgttactcctccgaagacgaactaacttccgaacggtaacccacccttactacttaccttaacaaaattccgaaaccgtccctaggaacgacggacccgaaggaccgacgggtccgtagtaacttacgtgggtcggaccgggtacgggggataacgttacgtaggttagggtttaactttcgtaattaacccgtttactttacccgtacggtcgggggtaccctacgggggtttcccctacggg

SEQ ID NO: 368802 - DNA, 621 bp, Homo sapiens
  misc_feature: GZ8MTXP02G7Q4O.25.37.D04.1.454.CMB.2.raw
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcttgggttttccttgttgctgttttaaaaggtgtccagtgtgaggtgcagctggcggagtctgggaggaggcctgatccagccgtgggggtccctgagactctcctgtgcagcctgtgggttcagcgttagtcacagtctacttgatcgtggtccgccaggcctccgaggggaaggggctggagtgcgtctctagtttattatagccgtaataactaccactacacgacagactcgaggacggccgtattccttatcctacagacgacaactcacggaacccaccctctacttactactaaactacgaaccgccctagacgacggacccgaacggacgaccggtccgtagttacttacgtggtcggacggacgggggatacgttaacgttacggttaggtttacgtttacgtaatttaaccgttacctttaccccgttacggtccggggtacccgtacgggtttccccgttccgg

SEQ ID NO: 368803 - DNA, 622 bp, Homo sapiens
  misc_feature: GZ8MTXP02JX4R9.25.37.D04.1.454.CMB.2.raw
  modified_base (447)..(447): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagcgttagtcacagctacttgatctgggtccgcaggctccgaggggaaggggctgggagtgcgtctcagttattatagccgtataactaccacctactacgcacgactccggtaggaacgggccgtatttcccttaatcctcccaagacgaacaattcccgaaggaaccctaccccttntaacttcttacaaaagttcgaaacccgccctaggacgacggacccggaaggtaccgaccgggtccgttaggttacttaccgtggtacggccgggagggggatacgtacgttaggtcgttactttcgaattaaccgttacctttccgacggtcggggacctacggggttcctcggg

SEQ ID NO: 368804 - DNA, 639 bp, Homo sapiens
  misc_feature: GZ8MTXP02HMCKN.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctctgggttcagcgttagtcacagctacttgatcgtgggtccgccaggcctccgaggggaaggggctggagtgcgtctcagttattatagcgaataactaccactactacgcagacctccgtagaacgggcctattcccttaatcctccagtacgaactaaacttcccgaaggaaccctaccctctaactaccttaacaaaagttcgaaaccgccccttaggacgacggacccgaaggaccgaaccgggtccgtaggttaacttacgtggtcggacgggcgggggaataacgtacgttaggttgggtttaactttacggtaactttaaccttaacctttcccgtaacggttcgggggtccctacgggggtttcccctcggg

SEQ ID NO: 368805 - DNA, 613 bp, Homo sapiens
  misc_feature: GZ8MTXP02G5LVX.25.37.D04.1.454.CMB.2.raw
  modified_base (547)..(547): a, c, t, g, unknown or other
  modified_base (558)..(558): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttcttgttgctgttttaaaaggtgtccagtgtgaggtgcagctggcggagtctgggaggaggcctgactccaggccgtggggggtccctggagactctcctgtgcagcctcgtgggttcaggtcgttagtcacagctacttgatcgtcgggtccgccgaggccgtaccgaagggggaacggggcgtaggggagtggccgtctctaaggtttatttaagtagaccgtataactaccacctactacgcacgactcggacgaacgggcctatttcctatcctaccaagtagaaacctaattcccgaaaggaaacccctaccccttattaactacgtaaacaaacgtcggaaccacccgtaggaacgcgaccggtagacgaccggtctagtactcgngcgcgggaganactagtagtgttacttagtactaacgttcctaccgtaggccggtacgtcgtctcg

SEQ ID NO: 368806 - DNA, 656 bp, Homo sapiens
  misc_feature: GZ8MTXP02I6Y9S.25.37.D04.1.454.CMB.2.raw
  modified_base (303)..(303): a, c, t, g, unknown or other
  modified_base (557)..(557): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagtcgttagtcacagctacttgatcgtgggtcccncaggctccgaggggaggggctgggagtgcgtctctagtttatttatagaccgtaataaactacccaacctacgtaccgctacgaccttccggtagaacggggtcctactttcccttatccctcaagacgaacaattccgaaaggaacccaccctatactaccttacaaactcgaaacccgccctaggacgaggacccggaaggaccgaccgggtccgttaggttaacttaccgtgtcggacggggcgggggtanacgttacgttagggtttacgtttacgtttcgtaactttaacccgttaccttttacccgacggttcgggggtacccttaccgggggtttcccctttcggg

SEQ ID NO: 368807 - DNA, 565 bp, Homo sapiens
  misc_feature: GZ8MTXP02GD8AT.25.37.D04.1.454.CMB.2.raw
  modified_base (495)..(495): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggtttccttgttgctgttttaaaaggtgtccagtgtgaggtgcagctggcggagtctggaggaggcctgatccagccgtgggggtccctgagactctcctgtgcagcctcgtgggttcagcgttagtcacagctactgatctgggtccgccaggctccgagggaaggggctggagtgagtctctagttatttatagccgataactaccacctactacgcagactccgtgaacgggccgtatttcctatctccagagacaattccagaccacctctatctacaaatcgaaacgccctagagacgccgaaggacgacggtccgtagtacttacgtgtgcggcgggganacgtacgtagtcggttactttcgatttaacgtactttccctacgtcggggtaccgtacgggttccctcgg

SEQ ID NO: 368808 - DNA, 560 bp, Homo sapiens
  misc_feature: GZ8MTXP02H84RF.25.37.D04.1.454.CMB.2.raw
tcagactgtacagtcacgaccggtgctcgatttagtagcatactgttgggtttggggaggaactgctcagttaggacccagagggaaccatggaagccccagctcagcttctcttcctcctgctactctggctccagatagcaccggagaagttgtgttgacacagtctccagacaccctgtctttgctccagggaagagccaccctctcctgcagggccagtcagagtgttatcaggttacttagccctggtaaccaacagaaacctggccaggcctcccaggctcctcatctatgatgcatacccaaggaggccacgtggacactcccagcctaggttcaggtcggcaggtgggctggggacagtacgttccaactcgtaccaaccagtcagccagtcgtggacgtccagtaagtacttttagacttagtttatactgttcagctagcgtagctaggttcggccgtcggggtacttaggtttcggccgtaaggggaccaaggcgtaggacgacgtacgaaaacgtacgtgtaacggctacgacaccgtatcttcgtcc

SEQ ID NO: 368809 - DNA, 656 bp, Homo sapiens
  misc_feature: GZ8MTXP02J23NW.25.37.D04.1.454.CMB.2.raw
  modified_base (559)..(559): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcttgggttttccttgttgcttgttttaaaaaggtgtccagtgtgaggtgcagcgtggcggagtctggaggaggcctgatccaggccgtgggggtccctgagactctctgtgcagcctcgtgggttcagtcgttagtcacagtctacttgatcgtcgggtcccgccgagggcctaccggaggggaacggggctgggagtcggcgttctcgtaagtttattacgtagccgtaaactactacccaacctactacgcgacgacgtcccgagaacgggtcctatttcctatcctaccgaagaacgtacctaaacttacccgacggaaccctacccttactaacttccgttaacaaaacgtcgaaaccgcccagacgaccggtaccggacgaccgaccgggccgttagtaacttacggnggaggcgggagggatacgttacgttaggttcgttactttaccgtaactttaaccgttaccgttccgtacgggtcgggtaccgttccgggttcctcgg

SEQ ID NO: 368810 - DNA, 616 bp, Homo sapiens
  misc_feature: GZ8MTXP02HKDZI.25.37.D04.1.454.CMB.2.raw
  modified_base (403)..(403): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagcgttagtcacagctacttgatcgtcgggtccgccagggcctccgaggggaaggggctggagtgcgtctcagtttattatagccgaataatacccactactacgcagactcggtagacgggcctagttccttanctccaagtacgactaattccaaggtaaccacccttctaacttacttacaaaatcgaaacctcccgtagacgacggaccgaaggtaccgacgggtccgtaggtacttacgtggtcggcggacgggggatacgtacgttacggttaggtttactttcggtaatttaaccgttacgtttacccgtacggttcgggacctacggggtttccctcggg

SEQ ID NO: 368811 - DNA, 718 bp, Homo sapiens
  misc_feature: GZ8MTXP02JDKT1.25.37.D04.1.454.CMB.2.raw
  modified_base (439)..(439): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcttgggttttccttgttgcttagttttaaaaggtgtccagtgtgaggtgcagctggcggagtcgtggaggaggcctgatccgagccgtgggggtccctgagactctcctgtgcagcctcgtggttcagtcgttagtcacagtctacttgactcgtcgggtcccgccgagggcctaccggaaggggaaggggcgtagggaggtcggcgttctacgtaagtttatttaagtagaccgtaataaactacccaacctactacgcacgacctcgtacggaacggcctactttccttanccctaccaaggtacaactaacttcccgaaagaaccctccctactaattaccttaacgaaaactcgaaaccgtcccgtaggaaacggacggacccgaaacggaaccaccggggtacccgtagttaactttaaccgggtgggtaccggaccggggaagggtacttaaacgtttaacggttacggtttacgttttaacctttaccgtaacgttttaacccgttaacccgtttacccggtaccggggtccgggtaccccggtttaccggggtttcccctacgg

SEQ ID NO: 368812 - DNA, 587 bp, Homo sapiens
  misc_feature: GZ8MTXP02FWE7S.25.37.D04.1.454.CMB.2.raw
  modified_base (301)..(301): a, c, t, g, unknown or other
  modified_base (344)..(344): a, c, t, g, unknown or other
  modified_base (420)..(420): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctgggggtccctgagactctcctgtgcagcctcgtgggttcagcgttagtcacagctacttgatcgtgggtccnccaggctccgaggggaagggctggagtgcgtctcagttattanagccgataactaccactactacgcagctcgtgaacggccgtattccttatctcagagacaattccaagaccacctntatctacaaatcgaaccgccctagacgacgaccgaacggacacggtccgtagtactacgtgtcggcggacgggggatacgtacgttaggttaggtttactttcgtaactttaaccgttaccttttacccgtacggttcggggtaccttaccggggttccctttacgg

SEQ ID NO: 368813 - DNA, 544 bp, Homo sapiens
  misc_feature: GZ8MTXP02IGAT1.25.37.D04.1.454.CMB.2.raw
  modified_base (473)..(473): a, c, t, g, unknown or other
  modified_base (480)..(480): a, c, t, g, unknown or other
  modified_base (486)..(486): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctgggggtccctgagactctcctgtgcagcctctgggtcagcgttagtcacagctactgatctgggtccgccaggctccgaggggaaggggctggagtgcgtctcagttattagtagccgtaataactaccacctactacgcagacctccgtagaaggggccattccttatctccagacgacaattccagaaccacctctatctacaaatgaaacgcctgacgagccgagacacggccgtgtatacngtgcggngggganatacgtagtcggttattcgattaactacttcctacgtcgggcctacgggttccctcgg

SEQ ID NO: 368814 - DNA, 664 bp, Homo sapiens
  misc_feature: GZ8MTXP02JH3MP.25.37.D04.1.454.CMB.2.raw
  modified_base (305)..(305): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccaggccgtggggggtccctgagactctcctgtgcagcctcgtgggttcagtcgttagtcacagtctacttgatctgggtccnccagggctccgaggggagggctgggagtgcgtctcgtagtttattatagaccgtataaactaccctacctactaccgcagtacctccggtaggaaacggggccctatttcccgttaatcctacccaaaggacaaccgaatttcccgaaaggaacccacccttactactaccttactaaaatccgaaaccgccctagacgacggaccgaggaccacggccgtagtactacgtggtcggccgggaggggtagtaacgttaacgttaggtttagggtttaactttcggtaaactttaaccttaaaccgttttccccgtaaacggttccgggggccctttaacgggggtttcccctttacggg

SEQ ID NO: 368815 - DNA, 701 bp, Homo sapiens
  misc_feature: GZ8MTXP02I6J0N.25.37.D04.1.454.CMB.2.raw
  modified_base (299)..(299): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtggtcagcgttagtcacagctacttgatcgtgggtccnccgaggcctccgaaggggaaggggctgggagtgcgtctctagtttattagtagaccgtaataactacccacctaactacgacagactccggtagaaacgggccgtactttccttaatcctacccaagtaacgaactaaacgtttacccaaacgggtaaaccctaaccccttacttaacttaccctttaacaaaacgttacgaaacccgccccttagggaacgacgggacccgaaacgggaccgaaccgggtcccgttaaggtactttaaaccgtggtacggacggacgggggaacgtaagtaccgttaggttagggtttactttaccggtaactttaacccgtttaccgttttaccccgtaacggtccgggggtaccgtaccggggtttaccccctttcggg

SEQ ID NO: 368816 - DNA, 610 bp, Homo sapiens
  misc_feature: GZ8MTXP02GLSVE.25.37.D04.1.454.CMB.2.raw
  modified_base (297)..(297): a, c, t, g, unknown or other
  modified_base (457)..(457): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcgtgggttttcctgttgctgtttaaaaggtgtccagtgtgaggtgcagctggcggagtctggaggaggcctgatccagccgtggggggtccctgagactctcctgtgcagcctctgggttcagcgttagtcacagctactgatctgggccncagggctccgaggggaaggggctggagtgcgtctcagtttattatagccgtataataccacctaactacgcagactccgtggaaacgggcccgtatttccttatctccaagacgacaaattcccaaggaaccaccctactactcttacaaatcgaaaccnccctgagagaccgaggaccgacggccgtagtattacgtgtcggcggacgggggatagttacgtagttacggtttaagtttacccggtatttaaccttaccgttttaccccgtacggttcgggggacccttacgggggtttccccgtttccggg

SEQ ID NO: 368817 - DNA, 592 bp, Homo sapiens
  misc_feature: GZ8MTXP02JM58E.25.37.D04.1.454.CMB.2.raw
  modified_base (260)..(260): a, c, t, g, unknown or other
  modified_base (522)..(522): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctntgggttcagcgttagtcacagctacttgatctgggtccgccagggcctccgaggggaaggggctgggagtgcgtctcagtttatttagtagccgataaactaccaacctactaacgcagacctccggtagaaacgggccgtattcctaatctccgtagagacaattccagaaccaccctctatctaacgaaatgaaaccgccctagacgacggaccgaaggaccacggccgttgtagttacgtggtcgcgggacgggggtanacgtacgtaggttggttactttcgatttaacgttacttaccctacggtcgggccctacggttccctacgg

SEQ ID NO: 368818 - DNA, 556 bp, Homo sapiens
  misc_feature: GZ8MTXP02G24A1.25.37.D04.1.454.CMB.2.raw
  modified_base (203)..(203): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccaggggaaanagccaccctctcctgcagggccagtcagagtgttatcaggtacttagcctggtaccaacagaaacctggccaggcctcccaggctcctcatctatgatgcatccgaaaggcggccacgtggcactcccagccaggttcaggtcggcaggtggggctggggacaggtcgttcactcacaccatcagcagtctggacgcctagaacgtatttgacttagtttacttacgtgttacagcgtagtcgtagcgtaggttcggccggttcggggtaactggtttcggaccgaggggtaccaggcgtaggagactacgaaacgtacgtggtaacggctacgaccacgtactcgtcgttcc

SEQ ID NO: 368819 - DNA, 740 bp, Homo sapiens
  misc_feature: GZ8MTXP02JZ62V.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctgtgggttcagtcgttagtcacagctacttgactcgtcgggtcccgccagggcctccggaggggaaggggctgggagtggcgtctcagtttatttagtagccgaataactacccacctactacgcagacctccggtagaaacggggcctaatttcccttaatccctaccgaagagaacctaattacccgaaggaacccaccccttactacttactttacccgaaaagttcgaaacccgtcccgtagaacggaacggaccccggtaaagggaaccccgtaccggggtaccgtttaggttaaaacctttaccgttggggtcggaccggggaccggggggtaaagtaactttaaaccggtaaggttttacggggtttaatttttaacccggtaaactttttaaaccctttaccccggttttaccccgtaaacgggttccgggggtaacccccgtttaccgggggttttcccccttacccgggg

SEQ ID NO: 368820 - DNA, 706 bp, Homo sapiens
  misc_feature: GZ8MTXP02I4G5F.25.37.D04.1.454.CMB.2.raw
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgtttaaaggtgtccagtgtgaggtgcagctggcggagtctggaggaggcctgatccagccgtgggggtccctgagactctcctgtgcagcctcgtgggttcaggtcgttagtcacagctacttgatcgtgggtcccgccagggctccggaggggaaggggctgggagtgcgtctacgtagtttatttagtacgaccgtaaattaaactaaccctaaccgtactaccggacacggtaccgttacccggttaggaaacgggggtcccgtaactttccctttaactccttacccgaagaacgaaccgtaaactttcccgaaacggtaaaccctaccccttactaacttaccttaacgaaaacttaccggaaaccgtccccttaaggacgacgggacccgaacgggtaccgacgggtcccgtaggttacttacgtcggtggacggacgggggtataagttaacgtaggttacgtttaagtttccgtaatttaaccgttaccgtttcccgtacggtacgggggtccctacgggggtttcccctcgg

SEQ ID NO: 368821 - DNA, 562 bp, Homo sapiens
  misc_feature: GZ8MTXP02FF8TO.25.37.D04.1.454.CMB.2.raw
  modified_base (432)..(432): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgtgctgtttaaaaggtgtccagtgtgaggtgcagctggcggagtctggaggaggcctgatccagccgtgggggtccctgagactctcctgtgcagcctctgggttcagcgttagtcacagctacttgatcgtgggtccgccaggctccgaggggaggggctgggagtgcgtctctagttatttatagccgataataccactactacgcagactccgtgaagggccatttcctatctccagagacaattccagaccaccctctatctacaaatnaacgccctagagagccgagacacggccgtgtatacgtgtgcggacggggagacgtactaggttgtttacttccgtaatttaaccttacgtttacccctacggtcggggacccgtacggggttccctcggg

SEQ ID NO: 368822 - DNA, 573 bp, Homo sapiens
  misc_feature: GZ8MTXP02JXICJ.25.37.D04.1.454.CMB.2.raw
  modified_base (348)..(348): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctctgggttcagcgttagtcacagctacttgatcgtgggtcccgccaggctccgaggggaaggggctgggagtgcgtctcagttatttanagcgataataccacctactacgcagactccggtgaaggggcctattccttatctccagagacatccagaccaccctctatcttacaaatcgaaccgccctagagagaccgaggaccacggccgtgtacttacgtgtgcggacggggagacgtacgtaggtcgtttactttacgtatttaacttacctttacccgtacgtcggggtccgtacgggtttcccgtcgg

SEQ ID NO: 368823 - DNA, 541 bp, Homo sapiens
  misc_feature: GZ8MTXP02FX7RE.25.37.D04.1.454.CMB.2.raw
  modified_base (299)..(299): a, c, t, g, unknown or other
  modified_base (371)..(371): a, c, t, g, unknown or other
  modified_base (485)..(485): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctggggggtccctgagactctcctgtgcagcctctgggttcagcgttagtcacagctacttgatctgggtccnccaggctccgaggggaaggggctgggagtgcgtctcagttatttatagccgaataataccacctactacgcngactccgtgaagggccatttcctatctccagagacaattccagaacaccctctatcttcaaatgaaacgccctgagagccgaggacacggccgtgtattactgtgcgcgggganatactagtggttatttcgattaactactttccctactggggccacgggttcctcgg

SEQ ID NO: 368824 - DNA, 556 bp, Homo sapiens
  misc_feature: GZ8MTXP02HJURJ.25.37.D04.1.454.CMB.2.raw
  modified_base (204)..(204): a, c, t, g, unknown or other
  modified_base (239)..(239): a, c, t, g, unknown or other
  modified_base (262)..(262): a, c, t, g, unknown or other
  modified_base (291)..(291): a, c, t, g, unknown or other
  modified_base (361)..(361): a, c, t, g, unknown or other
  modified_base (363)..(363): a, c, t, g, unknown or other
  modified_base (372)..(372): a, c, t, g, unknown or other
  modified_base (377)..(377): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccgaggggaaangccaccctctcctgcagggccagtcagagtgttancaggtacttagcctggtaccaanagaacctggccaggctcccaggcctcctnatctatgatgcatccaagacggccactggcactcccagcctaggttcagtcggcaggtggggctgggacngngttcactcncaccntcagcagtcgtgacgctagaatgtttgacttagtttattactggtactagctagtcgtagcgtaggttcggccgttacggggtacttaggtttcggaccggaacgggggtaccaaaggtcgtaggagtacgtacgaaacgtaactggtaacggcttaggactagtaccagtttacgtcg

SEQ ID NO: 368825 - DNA, 752 bp, Homo sapiens
  misc_feature: GZ8MTXP02GISHK.25.37.D04.1.454.CMB.2.raw
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctctgggttcagcgttagtcacagctacttgatctgggtccgccaggctccgaggggaaggggctgggagtgcgtctcagtttatttatagccgtaataactaccacctactaccgcagaccgtccgtaggaacggggtcctagtttccttaatccctaccgaaaggactaacctaaagttcccgaaaaggtaaccctaacccccgttagtaaactccttaacgtaaaaaacgtcggtaaaaccgtcccccgttaggaaccggtaacggtacccggaaacggtaaccctaaacccgggggtccctttaaggtaaaccgttttaaccgggtacggggttaccgggtaccgggggtaaccgggggtaaattaaaccggttaaaaccggtttacgggtttacggttttaacgtttaccgtaaacgttttaaacccgtttaccgttttaaccccgtacgggtaccgggggtacccttaaccgggggtttcccctaggg

SEQ ID NO: 368826 - DNA, 603 bp, Homo sapiens
  misc_feature: GZ8MTXP02HFNSQ.25.37.D04.1.454.CMB.2.raw
  modified_base (369)..(369): a, c, t, g, unknown or other
  modified_base (399)..(399): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctctgggttcagcgttagtcacagctacttgatcgtggtccgccaggctccgagggaaggggctggagtgcgtctctagttattatagcgataactaccacctactacgcngacctcgtaggaacgggccgtattccttancctccagacgactaattcccgaagaaccaccctctatcttacaaatcgaaaccgccctagacgacggacccgaggaccacggccgtagtaacttacgtgacgcggacgggggatacgtagttacggttaggtttaactttcggaatttaaccttaccgtttacccgtacggttacggggcccgttacggggtttccccttcggg

SEQ ID NO: 368827 - DNA, 562 bp, Homo sapiens
  misc_feature: GZ8MTXP02H6VKP.25.37.D04.1.454.CMB.2.raw
  modified_base (282)..(282): a, c, t, g, unknown or other
  modified_base (386)..(386): a, c, t, g, unknown or other
  modified_base (412)..(412): a, c, t, g, unknown or other
  modified_base (435)..(435): a, c, t, g, unknown or other
  modified_base (439)..(439): a, c, t, g, unknown or other
  modified_base (455)..(455): a, c, t, g, unknown or other
  modified_base (462)..(462): a, c, t, g, unknown or other
  modified_base (488)..(488): a, c, t, g, unknown or other
  modified_base (560)..(560): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtcgtggaggaggcctgatccagccgtgggggtccctgagctctcctgtgcagccctcgtgggttcagtcgttagtcanagctactgatcgtcgggtccgccaggctccggaggggaaggggctagggacgtgcgttactctaagtttattagtagccgaataacctacccaccttacacgcngaccgtcgtaggacggcctatccttncctcagacactatccgaagaccncctnatctagaaatcgaacnctagacncgacgagtacacggtcagttactggngcggcggaggatactagtagttacgttacttctacttcgtaccttccgacggtcggaccgttacggttaccncg

SEQ ID NO: 368828 - DNA, 652 bp, Homo sapiens
  misc_feature: GZ8MTXP02G5TN3.25.37.D04.1.454.CMB.2.raw
  modified_base (281)..(281): a, c, t, g, unknown or other
  modified_base (345)..(345): a, c, t, g, unknown or other
  modified_base (440)..(440): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcaactggcggagtcgtggaggaggcctgatccagccgtgggggtccctgagctctcctgtgcagcctcgtgggttcagcgttagtcacngctactgatcgtggtccgcaggctccgaggggaggggctggagtgcgtctcgtagtttatttanagcgataataccacctactacgacacgcctccgtaggaacgggtcctatttcctatcctaccagacgaactaacttccaaggtaaccaccccttntaactcttacaaaacttcgaaaccgccctaggacgacgaccggaaggaccgaaccgggccgtaggttacttacgtgggtacggccggtacgggggataacgttacggttaggttagggtttaactttacggtaacttttaaccgttaaccgttttaccccgtaacggttcgggggtacccttaaccgggggtttcccctacgggtttccccg

SEQ ID NO: 368829 - DNA, 651 bp, Homo sapiens
  misc_feature: GZ8MTXP02H4BQF.25.37.D04.1.454.CMB.2.raw
  modified_base (303)..(303): a, c, t, g, unknown or other
  modified_base (350)..(350): a, c, t, g, unknown or other
  modified_base (461)..(461): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctgggcggagtcgtggaggaggcctgatgcaggccgtggggggtccctgagactctcctgtgcagcctctggggttcagcgttagtcacagctactgatctgggtccnccgaggctccgaggggaggggctggagtgcgtctcgtagttatttanagcgaataaactacctacctactacgcaacgactccggtagaacggggccgtatttcctatcctccagaacaacaattacccaaggaaacccaccctactattaccttaanaaacttacgaaaccgtcccgtagaacggacgaacccgaggaaccgtaacggccggttagtacgttaaccgtgggtacgccgggggtaccggggaagtaacgttaaccgttacggtagttttaacgtttacgtaatttaccgtttaacctttccccgttaagtccgggggtaccttaacggggtttccccg

SEQ ID NO: 368830 - DNA, 720 bp, Homo sapiens
  misc_feature: GZ8MTXP02I0PDZ.25.37.D04.1.454.CMB.2.raw
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctgggaggaggcctgatccagccgtggggggtccctgagactctcctgtgcacgcctcgtgggttcagtcgttagtcacacgctacttgactcgtcgggtcccgccgagggcctccggaggggaagggctgggagtgcgtctctagtttattatagccgtaataactacccacctactacgacagcctaccggaggaacggggtccctagtttcccttaactcccttaccaagtaacgaactaaacgttacccgaaaggtaacccctaccttactaacttacttaacggtaaaactccggaaaccgttcccctaaggacgggaccggacccggaaaggacccgtaacgggtcccggttagtttaattccgtaggtcggaccgggggaggggtagtaaacttacggttaacggtttcgggtttaaactttccggttaaactttaacccgtttacccgtttacccggttaacgggtccgggggtacccttaacccgggggttttccccgttaccggg

SEQ ID NO: 368831 - DNA, 645 bp, Homo sapiens
  misc_feature: GZ8MTXP02GY85M.25.37.D04.1.454.CMB.2.raw
  modified_base (297)..(297): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctggggggtccctgagactctcctgtgcagcctgtggttcagcgttagtcacagctactgatcgtggtccncaggctccgaggggagggctggagtgcgtctctagtttattagtagacgtaataactacccaccttactacgcacgacctccggtagaacgggccgtattccttatcctccaagtacgaactaacttccgaagaacctaccctctaactacttacgaaaatcgaaaccgcctagacgacgaccgaggaccgacggtccgtagtacttacgtgtacggcgggacgggggtaatacgttacggtaacggtttgggtttaactttcggtaaacttttaaccgttaacccgtttttacccgtaaacgggttccgggggtacccgttacgggggtttcccccgtttaccgggg

SEQ ID NO: 368832 - DNA, 611 bp, Homo sapiens
  misc_feature: GZ8MTXP02GLUUB.25.37.D04.1.454.CMB.2.raw
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagcgttagtcacagctacttgatctgggtccgccaggctccgaggggaaggggctggagtgcgtctcagttattatagccgataataccactacacgcacgactccgtagaacgggccgtattccttatctacccaagtaacgaactaattcccaaaggtaaccacccttctactacttacaaaagtcgaaacctcccgtagaacgacggaccgaacggaccgacggtccgttagtattacgtgtcgcggacggggatacgtacgtacgttaggtttacttacggaatttaaccgtacgtttaccctacggtcggggtaccctacggggtttccccttacggg

SEQ ID NO: 368833 - DNA, 601 bp, Homo sapiens
  misc_feature: GZ8MTXP02FT9FT.25.37.D04.1.454.CMB.2.raw
  modified_base (344)..(344): a, c, t, g, unknown or other
  modified_base (408)..(408): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagtcgttagtcacagctacttgatcgtggtccgcaggctccgaggggagggcgtggagtgcgtctctagttattanagcgaataactaccacctactacgcagacctccggtagaacggcctatttcctatcctacaganacaattccgaagacctacctctatactacaaatcgaaaccgccctagacgacggccgaaggaccgacggtccgttagtacttacgtgtacggcgggacggggagtactacgttaggttggtttaactttcggtaaactttaaccgttacctttaccgtacggttcggggacccttacgggggtttccctcggg

SEQ ID NO: 368834 - DNA, 599 bp, Homo sapiens
  misc_feature: GZ8MTXP02JPMI8.25.37.D04.1.454.CMB.2.raw
  modified_base (526)..(526): a, c, t, g, unknown or other
  modified_base (540)..(540): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagtcgttagtcacagctacttgatcgtcgggtccgccgaggcctccggaggggaacggggcgtgggagtcgcgtctcgtagtttattagtagccgaataactaccaacctactacgcagacctcggtagaacggctactttcctatcctaccaagacgactacttacccgaaggtaaccctaccctactaacttaccttaactaaaagtcgaaaccgccctagacgacggaccgagaccgacggcgtagtacttacgngtcgcgggaggganacgtacgtaggtcgttacttcgattaacgtactttccgagtcgggcctacggttcctcg

SEQ ID NO: 368835 - DNA, 561 bp, Homo sapiens
  misc_feature: GZ8MTXP02F8ZNU.25.37.D04.1.454.CMB.2.raw
  modified_base (277)..(277): a, c, t, g, unknown or other
  modified_base (493)..(493): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgtttaaaaggtgtccagtgtgaggtgcagctggcggagtctggaggaggcctgatccagcctgggggtccctgagactctcctgtgcagcctctgggttcagcgttagtcanagctacttgatctggtccgccaggctccgagggaggggctggagtgcgtctcgagttattatagcataataccactactacgcagactccgtgaagggccattccgtatctcagagacaattcaaggaccaccctctatacttcaaaatcgaaaccgccctagacgagtcccgaggtaccacgggtccgtagtattaccgtgtcgcggacgggganacgtatagtcggttacttccgtaattaaccgtactttcccgtacgtcggggcctacggggttcctcgg

SEQ ID NO: 368836 - DNA, 664 bp, Homo sapiens
  misc_feature: GZ8MTXP02I9FUE.25.37.D04.1.454.CMB.2.raw
  modified_base (558)..(558): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctctgggttcagcgttagtcacagctacttgatcgtgggtccgcaggctccgaggggaagggctggagtgcgtctcgagtttatttagtagccgtataaactacccaacctactacgcagacctccggtagaacgggccgtaatttcccttaatcctacccaaggaacgacaaactttcccgaaacggaaccctaacccctctaacttccttaccaaaatcgaaaccgcccctagaacgacggtacccgaaggaccacgggtccgtggtaacttaccgtggtcggaccgggacgggggaanacgttaacgtaggtttagggtttacttttacggaacttttaaccgttaaccctttttaccccgtacggttcgggggtaccccttaacgggggtttcccccttcggg

SEQ ID NO: 368837 - DNA, 602 bp, Homo sapiens
  misc_feature: GZ8MTXP02GF874.25.37.D04.1.454.CMB.2.raw
  modified_base (208)..(208): a, c, t, g, unknown or other
  modified_base (249)..(249): a, c, t, g, unknown or other
  modified_base (258)..(258): a, c, t, g, unknown or other
  modified_base (260)..(260): a, c, t, g, unknown or other
  modified_base (270)..(270): a, c, t, g, unknown or other
  modified_base (278)..(278): a, c, t, g, unknown or other
  modified_base (288)..(288): a, c, t, g, unknown or other
  modified_base (301)..(301): a, c, t, g, unknown or other
  modified_base (306)..(306): a, c, t, g, unknown or other
  modified_base (357)..(357): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcgtggtttcgtgtagctgtttaaaagtgtcagtgtgaggtgcagctggcggagtctggaggnggcctgatccagccgtgggggtccctgagactctctgtgcngctctggtngngtagtcacanctactgtntcgtcgcgcncgcgcgaggaggngtggngtcgtcgtctcgtagttattagtagacgtataactacctacctactacacncgacgtacgtacggacgtacgtacttacttactacacaagacgaactactacgacgacctacctactactactactaactacgaccgaccgtacgacgacgaccgacgacgacggtacgtacgttacgtacgtacgtacggtacggacgggtaggtacgtacgttacgttacgtttacgttaacgttacgttaaccgtttaccgtttaccgttaccggtacggtaccggtaccggttaccggtcg

SEQ ID NO: 368838 - DNA, 553 bp, Homo sapiens
  misc_feature: GZ8MTXP02ID0NP.25.37.D04.1.454.CMB.2.raw
  modified_base (343)..(343): a, c, t, g, unknown or other
  modified_base (492)..(492): a, c, t, g, unknown or other
  modified_base (498)..(498): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctctgggttcagcgttagtcacagctacttgatctgggtccgccaggctccgaggggaaggggctggagtgcgtctcagttattanagccgataactaccacctactacgcagactccgtagaagggcctaattccttatcctccaagagaacaattccaagaaccaccctctaactcttacaaaatcgaaacgccctagacgagccgaggacgacggccgtgtatactgtgcgngggganatacgtagtgttacttcgattaactctttaccacgtcgggcctacggttccctgg

SEQ ID NO: 368839 - DNA, 624 bp, Homo sapiens
  misc_feature: GZ8MTXP02IZCYA.25.37.D04.1.454.CMB.2.raw
  modified_base (441)..(441): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcaggtcgttagtcacagctactgatcgtcgggtcccgccaggctccgaaggggaaggggctggagtgcgtctctagttatttaagtagccgtaataactaccacctactacgcagacctccgtagaacggcctacttccttatcctcagacgactaattccaaagaccaccctntactacttacaaatcgaacgccctagacgacgaccgaacggtacacggtccgtagtattacgtggtacgccgggtaggggatagtaacggtagtttcgggttaaacttttcggaatttaaacccttaccgtttaccccgtaacggttccgggggtaccctaacgggggtttccccctaacggg

SEQ ID NO: 368840 - DNA, 652 bp, Homo sapiens
  misc_feature: GZ8MTXP02GHLAM.25.37.D04.1.454.CMB.2.raw
  modified_base (534)..(534): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctctgggttcagtcgttagtcacagctacttgatcgtgggtccgccaggctccgaggggagggctgggagtgcgtctctagtttattagtagacgtataactaccacctactacgcacgaccgtaccgtaggaacgggtcccgtaatttcccttagtcctaccgaagagaacctaattcccgaaaggaccctaccctactactccttaacaaatcggaaaccgccctaggagacggaccggaacggtaccgaacgggtccgttagtaactttacggnggtcggacgggtacgggaatacgttaacggttaggtttagtttaacgtttcgtaactttaacccgtttaccgtttcccggttacggtccgggggtaccgttacggggtttcccgtcgg

SEQ ID NO: 368841 - DNA, 661 bp, Homo sapiens
  misc_feature: GZ8MTXP02JUTCS.25.37.D04.1.454.CMB.2.raw
  modified_base (282)..(282): a, c, t, g, unknown or other
  modified_base (538)..(538): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagtcgttagtcacngctacttgatcgtcgggtcccgccgaggcctaccggaggggaacggggcgtgggagtgcgtctacgtagtttattagtagaccgtaataactaccacctactacgcacgacgtcggtaggaacggggcctactttccttatccctacgaagacgactaacttcccgaagaaccctacccttatacttcctaacaaagtcgaaaccgccgtagacgacggaccgaacggaccgacggtccgtagtacgtttaccggnggtcggacgggtacgggtatacgttacgttaggtttacgtttactttaccgttaactttaacccgtttacccgtttacccggtacggggttacccggggtaccgttaccgggtttcccgtcgg

SEQ ID NO: 368842 - DNA, 667 bp, Homo sapiens
  misc_feature: GZ8MTXP02H1FSF.25.37.D04.1.454.CMB.2.raw
  modified_base (204)..(204): a, c, t, g, unknown or other
  modified_base (294)..(294): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagaccaccctgtctttgctccgaggggaaanacgcccaccctctcctgcagggccagtcagtagtgttatcgaggtacttgcctggtaccaacagaaacctggccaggcctcccagctccnatctatgatgcatccgaaggacgggccacgtcggcctatcccccgagtccccgtaggttcaggtccggacgtaggggttcggggacgttaggggacctaaggtcgtttacccaacgtttccctaccgaaccctataccgaacgtcccgtaggttcgtacgggacgtcccgttagtaaagtttagttttgtacgttagttttacgttacgtcgttacgaagtcgttagccggtagtcggtagggttccgggtaccggttccgggggttacgttacgggtttaccgggccggttaacggggacccgaggtaccggtaggacgtaacgtacgaaacggaactgggtaacgcgtacgccacgtacttccgtagttcc

SEQ ID NO: 368843 - DNA, 765 bp, Homo sapiens
  misc_feature: GZ8MTXP02J29N6.25.37.D04.1.454.CMB.2.raw
  modified_base (281)..(281): a, c, t, g, unknown or other
  modified_base (373)..(373): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgtttaaaaggtgtccagtgtgaggtgcagctggcggagtctggaggaggcctgatccagccgtggggggtccctgagactctcctgtgcagcctcgtgggttcagcgttagtcacngctactgatcgtggtccgccaggctccgaggggaagggctggagtggcgtctctagtttattagtagccgaataactacccactactacgcncgacctcccggtagaaacgggggccctactttacccttactcctacccgaagtaacggtaaacctaaaccgtttcccgaaacgggtaaacccctaaccccctttacttaaaccgttacctttaaaccaaaacgttaccggaaaaccccgcccccgttaggaaaccggacgggaccccgggaaaggaacccggtttaaccccgggcccggttaaggtttaacgttaacccgtgggggttcggtacccgggggacggggggtaactaaacggttaaccgttaggggtttacggttaaacttttaccggtaaaccttttaacccgtttaaccccgtttaccccgttaacggttcccggggggaccctttaaccgggggtttccccgttcccgggg

SEQ ID NO: 368844 - DNA, 654 bp, Homo sapiens
  misc_feature: GZ8MTXP02FWT99.25.37.D04.1.454.CMB.2.raw
  modified_base (302)..(302): a, c, t, g, unknown or other
  modified_base (349)..(349): a, c, t, g, unknown or other
  modified_base (570)..(570): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgtttaaaaggtgtccagtgtgaggtgcagctggcggagtctggaggaggcctgatccagccgtggggggtccctgagactctcctgtgcagcctcgtgggttcagcgttagtcacagctacttgatcgtgggtcccncagggctccgaggggaagggcgtgggagtgcgtctctagttatttanagcgtataaactaccaacctactacgcagacctccgtaggaaacgggtcccgtaatttcccgttaatcctaccgaaagacgaaacctaaattcccgaaacggaaaccctaccccttactattaccttactaaaacgttcgaaacccgtccctaggacgaacgggccgaacgggaccgaccgggtccgttagtatttaccgtggtcggcgggcgggggaaanacgttacgttaggttcggtttaattcgtaacttaactttacctttacccgacggtttcgggggaccttacggggttcccttcgg

SEQ ID NO: 368845 - DNA, 636 bp, Homo sapiens
  misc_feature: GZ8MTXP02ISII9.25.37.D04.1.454.CMB.2.raw
  modified_base (260)..(260): a, c, t, g, unknown or other
  modified_base (267)..(267): a, c, t, g, unknown or other
  modified_base (410)..(410): a, c, t, g, unknown or other
  modified_base (544)..(544): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctntgggtcngcgtagtcacagctacttgatcgtgggtccgccgaggctaccgaggggaagggctggagtgcgtctctagtttattagtagccgtataaactacctaacctactacgcacgactaccgtaggaaacggccgtaatttccttanccgtacaaggacaacaaacttccaaacggtaaacctaccccttactaacttaccgtaactaaaacgttcgaaaacccgtcccgttaggaacgacggaccggaagtaccaccggggtccttaggtacttacgtgngaccgggagggagtatacgttaggttgttaacgtttctaacttaacgttaacctttccgtaacggtcgggccctacggggtttcccctcggg

SEQ ID NO: 368846 - DNA, 634 bp, Homo sapiens
  misc_feature: GZ8MTXP02HWL9W.25.37.D04.1.454.CMB.2.raw
  modified_base (342)..(342): a, c, t, g, unknown or other
  modified_base (390)..(390): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctggggttttccttgttgctgttttaaaaggtgtccagtgtgaggtgcagctgggcggagtctggaggaggcctgatccagccgtgggggtccctgagctctcctgtgcacgcctctgggttcagtcgttagtcacagctacttgatcgtcgggtccgccgacggccgtccggaggggaaggggcgtgggagtgngtccccccctgtagtttattatagacgataactaccacctactacgcncgactacgtagacgggtccgtactttccttactcctaccagaacgactaattacccgaacgaaccaccctactacttcttaacaaatacgaaccgtcctagagacgaccggacggaaccgaccggcgtgtacttacgtggtcgcgggcgggacgtacgtacgttaggttagtttacgtttacgtacgtttaaccttaccgtttacccgtacggtcgggtacccggtacggtttacccgttccgg

SEQ ID NO: 368847 - DNA, 623 bp, Homo sapiens
  misc_feature: GZ8MTXP02JQIMQ.25.37.D04.1.454.CMB.2.raw
  modified_base (336)..(336): a, c, t, g, unknown or other
  modified_base (348)..(348): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgcttgttttaaaaggtgtccagtgtgaggtgcagctggcggagtctgggaggaggcctgatccagccgtgggggtccctgagactctcctgtgcagcctcgtgggttcagcgttagcacagctactgatcgtgggtccgccaggcctccgaggggaaggggctgggagtgcgtntcagtttattanagccgataactaccacctactacgcagtacctcgtaggaagggtcccaatttcccttaagtcctaccaagacgaactaacttacccaaggaaacccaaccccttcttaactaccttaacaaaattccgaaaccgtcccctagacgacggaccgaacggaccgaacggtccgtagttacgttacgtgcggcggacggggtagaactacgtaggttaggttattacgtattaaccttacgttaccctacggtcgggacccttacgggttcccttcgg

SEQ ID NO: 368848 - DNA, 639 bp, Homo sapiens
  misc_feature: GZ8MTXP02F0FQ4.25.37.D04.1.454.CMB.2.raw
  modified_base (284)..(284): a, c, t, g, unknown or other
  modified_base (293)..(293): a, c, t, g, unknown or other
  modified_base (311)..(311): a, c, t, g, unknown or other
  modified_base (316)..(316): a, c, t, g, unknown or other
  modified_base (318)..(318): a, c, t, g, unknown or other
  modified_base (366)..(366): a, c, t, g, unknown or other
  modified_base (406)..(406): a, c, t, g, unknown or other
tcagactgtacagtcacgaccggtgctcgatttagtagcatactgttgggtttggggggaggaggagcccagcactgggattccgaggtgtttccattcggtgatcagcactgaacacagaggactcaccatggcgttttggctgagcgtggtttctgtagctgtttaaaagtgtcagtgtgaggtgcagctggcggagtctgggaggaggcctgatccagccgtgggggtcctgagctctcctgtgcagcctcgtgggttacagcgttagcacagctcttagntctggtccncaggcacgaggggacggngtggngngcgtctgtagttattagtagtacgtactaactactacctactacgacncgacgtacgtacgacgacgtacttacttactactacaganaactaactacgaacgacctacctactactactactaactacgaccgaccgacgacgaacggaaccgaaccggaccggaccggtaccgttacgttacgttacgtacggtacgggtacgggacgggtaacggtacgttacggttacggttacgtttacgtttaacgtttaacgttaaccgtttaccgtttaccgttaccggttaccgggtaccggttaccggttaccggttccgg

SEQ ID NO: 368849 - DNA, 690 bp, Homo sapiens
  misc_feature: GZ8MTXP02FOKVT.25.37.D04.1.454.CMB.2.raw
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcttgggttttccttgttgctgttttaaaaggtgtccagtgtgaggtgcagctggcggagtctgggaggaggcctgatccagccgtgggggtccctgagactctcctgtgcagcctcgtgggttcagcgttagcacagctacttgactcgtcgggtccgcaggctaccgaggggaggggctgggagtgccgtctcgtagttattatagccgtaataactaacccaccttaactacgactacgtacctccgggtaggaaaccgggtccgtaactttacccttactcctacccaaggaacgtaactaaactttcccgaaaggaaccctaaccccttcttaaacttaccttaacgaaaattccgaaaccgtccctaggaacgacgacccgaaggaccgacggtcccgttagttattaaccgtggtcgggaccggtcgggggaaattaagtacgtttagggttagtttaactttcgtaaaacttttaaccgttaacccttttcccgtaacggttcgggggtacccttacggggtttcccccttaacggg

SEQ ID NO: 368850 - DNA, 632 bp, Homo sapiens
  misc_feature: GZ8MTXP02GAE46.25.37.D04.1.454.CMB.2.raw
  modified_base (448)..(448): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctctgggttcagcgttagtcacagctacttgatcgtggtccgccaggctccgagggaaggggctgggagtgcgtctcagttattatagccgataataccacctactaccgcagactccggtgaacggccgtattccttatctccagagacattcccagaaccaccctctatcttacgaaaatcgaaaccncccgtagacgacggacccgacggaaccgaccgggtcccgttagtactttaacgtggttacggccgggagggggaataacgttaaccgttaggtttacggggtttaaacttttccggtaaatttaacctttacccgttttaccccgtaacggttcgggggacccgtacggggtttcccttccggg

SEQ ID NO: 368851 - DNA, 678 bp, Homo sapiens
  misc_feature: GZ8MTXP02GIAYQ.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgcttgttttaaaaggtgtccagtgtgaggtgcagctggcggagtcgtggaggaggcctgatccagccgtgggggtccctgagactctcctgtgcagcctcgtggttcagtcgttagtcacagtctactgatcgtgggtccgcgaggctaccggaggggaaggggctgggagtgcgtctctaagtttattagtagaccgtaataactacccactactacgcacgtacctcggaggacggtccgtatttaccttagtcccacgaaagacgaactaacttacccgaacggtaaacccctacccttactaacttaccttaaacaaaacgtcgaaacccgtcccgtaggaacgacgggacccgaacggaaccgacgggtaccgtagttattaccggtggtcggacgggtcggggaaatacgttaacgttaggttacggtttaactttcggtaaactttaacccgtttaccttttacccggtacgggttcggggtaaccctccggggtttcccttcccggg

SEQ ID NO: 368852 - DNA, 610 bp, Homo sapiens
  misc_feature: GZ8MTXP02G9T1N.25.37.D04.1.454.CMB.2.raw
  modified_base (517)..(517): a, c, t, g, unknown or other
tcagactgtacagtcacgaccggtgctcgatttagtagcatactgttgggtttggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagcgttagtcacagctacttgatcgtgggtccgccaggctccgaggggaaggggctggagtgcgtctctagtttattatagccgataactaccactactacgcagactccgtaggaacgggccgtattccttaatcctaccaggacactaacttccaagaacccaccctctactcttacaaaatcgaaaccgccctagacgacgaccgaggaccgacggtccgtgtacttacgtgtcggcggacggggganacgttacgtaggttagtttaactttcggtaactttaaccgttaccttttacccgtacggtcggggtacccgtacggggtttccccttacgggg

SEQ ID NO: 368853 - DNA, 606 bp, Homo sapiens
  misc_feature: GZ8MTXP02FQNCE.25.37.D04.1.454.CMB.2.raw
  modified_base (210)..(210): a, c, t, g, unknown or other
  modified_base (234)..(234): a, c, t, g, unknown or other
  modified_base (246)..(246): a, c, t, g, unknown or other
  modified_base (262)..(262): a, c, t, g, unknown or other
  modified_base (268)..(268): a, c, t, g, unknown or other
  modified_base (310)..(310): a, c, t, g, unknown or other
  modified_base (312)..(312): a, c, t, g, unknown or other
  modified_base (315)..(315): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcgtggtttcgtgtaggctgtttaaaagtgtcagtgtgaggtgcagctggcggatcgtggaggnggctgatccagccgtgggggtccngagtctctctgngcacgctcgtggtcgngtgtancacactctactgtgtcgtcggtcgcgcgcgacggagggaggngnggngtcgtcgtctatattattatagactactaactacctactactacgacgcgtacgtacgtacggtacgtcgtacttactactactacgacgacgtaactactacgaacgaacctacctactactactaactaacgtacgaccgacgagacgacgacgacgacgacgtacgtacgtacgtacgtcggtcggacggacgggtacgtacgttacgttacggttacgtttacgttacgttactttaaccgttaccgttaccgttacggtacggtaccggttaccggttaccgtccg

SEQ ID NO: 368854 - DNA, 562 bp, Homo sapiens
  misc_feature: GZ8MTXP02IP28F.25.37.D04.1.454.CMB.2.raw
  modified_base (422)..(422): a, c, t, g, unknown or other
  modified_base (474)..(474): a, c, t, g, unknown or other
  modified_base (487)..(487): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgtttaaaaggtgtccagtgtgaggtgcagctggcggagtctgggaggaggcctgatccatccgtgggggtccctgagactctcctgtgcagcctctggtcagcgttagtcacagctacttgatctggtccgcaggctccgagggagggctggagtgcgtctctagttattatagcgataactaccacctactacgcacgactccgtgaacgggccgtatttccttatcctcagagacaattccgaagaccctacctntactctacaaatcgaacgccctagacgagcccgagacacggctagtatacgngtgcggcgggganacgtacgtaggttgttactttcgtaatttaacgttacctttacccgtacgtcggggtcctacggggtttcctcgg

SEQ ID NO: 368855 - DNA, 524 bp, Homo sapiens
  misc_feature: GZ8MTXP02J3KF9.25.37.D04.1.454.CMB.2.raw
  modified_base (324)..(324): a, c, t, g, unknown or other
  modified_base (353)..(353): a, c, t, g, unknown or other
  modified_base (366)..(366): a, c, t, g, unknown or other
  modified_base (384)..(384): a, c, t, g, unknown or other
  modified_base (390)..(390): a, c, t, g, unknown or other
  modified_base (402)..(402): a, c, t, g, unknown or other
  modified_base (458)..(458): a, c, t, g, unknown or other
  modified_base (470)..(470): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctgggggtccctgagactctcctgtgcagcctctggttcagcgttagtcacagctacttgatctgggtccgccagggctccgaggggaagggctggngtgcgtctcagtttattatagcgataacnccactactacgcngactcgtgaggcatctanctcagnacatccagaacncctctatcttcaaatgaaacgccctgacgagccgaggactacgccgtgtattacgngtgcgcgggganatactagtgttatttcgattaactactttcccacgtcgggcctaggtccctcgg

SEQ ID NO: 368856 - DNA, 672 bp, Homo sapiens
  misc_feature: GZ8MTXP02IUA1Z.25.37.D04.1.454.CMB.2.raw
  modified_base (366)..(366): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaggtgtccagtgtgaggtgcagctggcggagtcgtggaggaggcctgatccagccgtggggggtccctgagactctcctgtgcacgccccgtgggttcagtcgttagtcacagctacttgatcgtgggtccccgccgaggcctaccggaagggggaacggggcgtgggagtcggccgtctctagtttatttanagcgtaataactacccacttactacgaccagccgtccgtaggaacggggtccctatttccttatcctaccgagacgactaaattcccgaaaggtaaccctaccccttataacttacttacaaaattcgaaacccgtcccgtagacgacgccggaacggaccgaccggtcgtagttaattccgtggtcggccgggtacggggataacgttcgttaaagggttgttttacgttacttaacgtttaccttaaccgttttacccgaacgggttcggggacccgtttacgggtttcccgtacgggttcccc

SEQ ID NO: 368857 - DNA, 644 bp, Homo sapiens
  misc_feature: GZ8MTXP02JVCUL.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctctgggttcagcgttagtcacagctacttgatcgtgggtccgcaggctccgaggggagggctgggagtgcgtctactagtttattagtagaccgtataactaccaacctactacgcacgacctcggtaggaacgggccgtaactttccttaactccgtaccaaagacgaacctaacttcccgaaaggtaaccctacccttacttaacttcctttaacaaaagttcgaaaccgtccctaggacgacggaccgacggaccgacgggtccgtagtattacgtgtcggcggaggggactaattccgtaaggttacgtttactttacggtaactttaaccgttacccgtttcccgtacgggtcggggtaccgttacgggtttcccgtcgg

SEQ ID NO: 368858 - DNA, 563 bp, Homo sapiens
  misc_feature: GZ8MTXP02FO07Y.25.37.D04.1.454.CMB.2.raw
  modified_base (361)..(361): a, c, t, g, unknown or other
  modified_base (388)..(388): a, c, t, g, unknown or other
  modified_base (423)..(423): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgtttaaagtgtccagtgtgagtgcagctggcggagtctggaggaggcctgatccagccgtgggggtccctgagactctcctgtgcagcctctgggttcagcgttagcacagctacttgatctgggtccgccaggctccgaggggaggggctggagtgcgtctctagttattatagcgataataccactactacgcngactccgtagaacgggcctattcctanctccagagacaattccaagaccacctctatactanaaatgaaccgccctgacgagccgaaggaccacgggcgtagtactacgtcgtggcgcgggggaatataacgtaggttgtttaactttgtacttaacgttaacctttcccgtacggtgggacccgtaggggtttcccctcgg

SEQ ID NO: 368859 - DNA, 733 bp, Homo sapiens
  misc_feature: GZ8MTXP02JLWXL.25.37.D04.1.454.CMB.2.raw
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgtttaaaggtgtccagtgtgaggtgcagctggcggagtcgtggaggaggcctgatccagccgtggggggtccctgagactctcctgtgcagcctctgggttcagcgttagtcacagctactgatcgtgggtcccgccaggcctccggaggggaaggggctgggagtgcgtctctagtttattatagcgaataaactacccaacctactaccgcacgtacctcccggtaggaaacggggtcccgtaatttcccttaatccctacccaagaacgaactaaacttcccgaaacggtaaaccctacccccttactaacttaccgttaacctaaaaagttccggaaaacccgtccccctaggaaacgaccgggacccggaaacggtaacccgaaccggggtcccggttagttaaccgtttaacgtcgggttacggccgggggaccgggggtaaagtaaacgttaaccgttaggggttcgggttttaaactttacggttaaactttaaccgtttaccccttttaccccgtaacggttcgggggtacccgttaacgggggtttccccctttcggg

SEQ ID NO: 368860 - DNA, 620 bp, Homo sapiens
  misc_feature: GZ8MTXP02JP9GV.25.37.D04.1.454.CMB.2.raw
  modified_base (539)..(539): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtctccagtgtgaggtgcagctggcggagtctggaggaggcctgatccagccgtgggggtccctgagactctcctgtgcagcctctggttcagcgttagtcacagctacttgatcgtcgggtccgccgaggcctaccgaggggaaggggctgggaggtgcgtctcgtagtttattagtagccgaataactacccacctactacgcacgacctcggtagaaacgggccgtatttccttatcctcccagtacgactaacgttcccaagaacccaccctactactccttaacaaaactcggaaaccgccctagacgacggaccgaggaccacgggtccgtagtacttacgtgtaggcggcggggganaacgttacgtagttcggtttatttcgaactttaacgttacctttacccgtacggtcgggtaccgtacggggtttccctcgg

SEQ ID NO: 368861 - DNA, 614 bp, Homo sapiens
  misc_feature: GZ8MTXP02F5U6U.25.37.D04.1.454.CMB.2.raw
  modified_base (484)..(484): a, c, t, g, unknown or other
  modified_base (521)..(521): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgctgttttaaaaggtgtccagtgtgaggtgcagctggcggagtcgtggaggaggcctgatccagccgtgggggtccctgagactctcctgtgcagcctcgtgggttcagtcgttagtcacagtctactgatcgtcgggtccgccgaggcctaccggaaggggaacgggcgtggagtggcgtctactagtttatttagtagaccgtaataactaaccacctacgtacgcacgactccgtaggaacggccgtactttccttatcctaccagagaactaacttccgaaacgaaccctacctatactactacaaaatcgaaacnccctagacgacgccgaagacgaccggcgtatatacgnggcgcgggcgggatacgttacgtaagttcggttacttcgtaattaaccgttactttacccgacggtcggggtaccgtacggtttcccgtacgg

SEQ ID NO: 368862 - DNA, 644 bp, Homo sapiens
  misc_feature: GZ8MTXP02HLLPE.25.37.D04.1.454.CMB.2.raw
  modified_base (479)..(479): a, c, t, g, unknown or other
  modified_base (543)..(543): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtcgtggaggaggcctgatccagccgtgggggtccctgagactctcctgtgcagcctcgtgggtcagcgttagtcacagctacttgatcgtcgggtcccgccagggcctccgaggggaaggggctgggagtgcgtctctagtttattagtagacgtataaactaccacctactacgcagtacctcggtgaaggtcgtacttccttatctccaagacgaacaacttcccgaaaggtaacccacccttatacttaccttacgaaaactcggaaaccncccttagacgacgacccgaggaccgacggtcgttagtacttacgtggtacggcggacggggganacgtttaacgttagggtttagtttaacgtttcggttaactttaaccgttaccctttaccgttacgggtcggggtaccccgtaacggggtttccccgtacgg

SEQ ID NO: 368863 - DNA, 750 bp, Homo sapiens
  misc_feature: GZ8MTXP02H13WU.25.37.D04.1.454.CMB.2.raw
  modified_base (264)..(264): a, c, t, g, unknown or other
  modified_base (288)..(288): a, c, t, g, unknown or other
  modified_base (638)..(638): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgcttgttttaaaaggtgtccagtgtgaggtgcagctggcggagtctgggaggaggcctgactccgagccggtgggggtccctggacgactctcctgtgcngcctgtggtcagtcgttagtcacngtctacttgactcgtcgggtccgccgacgggtccgtaccggaagggggaacggggtcgtagggtaggtcggtccgttctacgtaaagttttactttaagtacgtaccgtaaactaaacctacccaaccttaactaccgacctacgtacccgttccggtaacgggaacggggtacccttaactttacctttactccctaaccgaaagtaacgtaaacctaaacgttacccgaaacgtaaaccctaccctttaacttaacttaccttaaacgaaacgttaccgaaacccgtacccgttaggaaaccgacgggacccggaggacccgtaacggtccgttaagttacgttacgnggttacggcggacggggattaacgttacgttaggtttacggttactttaacgacttttaaccgttaccgtttacccgtacgggttcggacccggtttcggtttaccctcggg

SEQ ID NO: 368864 - DNA, 685 bp, Homo sapiens
  misc_feature: GZ8MTXP02GT5DY.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtcgtggaggaggcctgatccgaggccgtgggggtccctgacgactctcctgtgcacgcctgtggtcagtcgttagtcacagtctacttgacttcgtcgggtccgccgaggccgtaccggaggggaaggggcgtgggagtcggtcgtctacgtaagtttattagtacgaccgtaactaactaccctaacctacgtaccgacacgtacctacggtacggaaccgggtaccgtaactttacccttaactccctacgaaagaacgtaacctaaacgttacccgaaacggtaacccctaccttaacttacttacttaaacaaagtccgaaacccgtcctaggacgacggaccggaagaccgacggtcctagtattacgtgcggacggaggggtatacgttacgtaggttaggtttacttacgttaactttaaccgttccgtttacccgtacggtaccggggtaccttaccgggttcccgttacgg

SEQ ID NO: 368865 - DNA, 597 bp, Homo sapiens
  misc_feature: GZ8MTXP02FNH0U.25.37.D04.1.454.CMB.2.raw
  modified_base (368)..(368): a, c, t, g, unknown or other
  modified_base (450)..(450): a, c, t, g, unknown or other
  modified_base (507)..(507): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgtttaaaggtgtccagtgtgaggtgcagctggcggagtctggaggaggcctgatccagccgtgggggtccctgagactctcctgtgcagcctctgggttcagcgttagtcacagctacttgatctgggtccgccaggctccgaggggaaggggctggagtgcgtctctagttattatagccgataactaccacctactacgcngactccggtagagggccgattccttatcctcagacgacaacttccaacggaaccaccctctaatacttacaaatcgaaaccnccctagacgacgccgaggacacggtcccgtgtagttacctggtggacggcggggganacgttacgttaggttcggtttattcgtaactttaaccgtaccttttacccgtacggttcgggggacccgtacggggttcccgtttccggg

SEQ ID NO: 368866 - DNA, 681 bp, Homo sapiens
  misc_feature: GZ8MTXP02H4K26.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctgggcggagtcgtggaggaggcctgatccagccggtgggggtcctgagactctcctgtgcagcctgtggtcaggtcgttagtcacagctacttgattcgtcgggtccgccgaggccgtccggaggggaaggggctgggagtgcgttctactagtttattatagtaccgattaaactaaccctaacctactacgctacgtacctaccggtacggaacgggtccgtactttacctttactacctccaaggtaaccaactaaaccgttcccgaaaaggtaaaccccaccctttacgtaaacttccttaaacaaaacgttcgaaacccgtcccgtaggacgacgggacccgaaggaccgacgggttccgtagttagtacgtggtacggccggaggggtatacttaacgtaggtttcgtttactttcgaacttttaaccgtccttttaccggtacggtcggggtacccgttacgggtttccccgtacgg

SEQ ID NO: 368867 - DNA, 555 bp, Homo sapiens
  misc_feature: GZ8MTXP02HE4H3.25.37.D04.1.454.CMB.2.raw
  modified_base (334)..(334): a, c, t, g, unknown or other
  modified_base (397)..(397): a, c, t, g, unknown or other
  modified_base (405)..(405): a, c, t, g, unknown or other
  modified_base (422)..(422): a, c, t, g, unknown or other
  modified_base (465)..(465): a, c, t, g, unknown or other
  modified_base (475)..(475): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggtttcctgttgctgtttaaaggtgtccagtgtgaggtgcagctggcggagtctggaggaggcctgatccagccgtggggggtccctgagactctcctgtgcagcctgtgggttcagcgttagtcacagctacttgatcgtcgggtccgcagggcctccgaggggaagggctgggagtgcgttcncgtagtttattatagccgtaatactaccactactacgcagactcggtagaggcctatccttanctacaganacaattccagacctccntatctacaaatcgaaccgcctagacgagcgaagccaggccgtntaactcgtancggacggacgggtatactacgtagttcgttacttcgtactaacgttacgtccgtacggtccggacgttacggttcctcgg

SEQ ID NO: 368868 - DNA, 524 bp, Homo sapiens
  misc_feature: GZ8MTXP02HSXGN.25.37.D04.1.454.CMB.2.raw
  modified_base (203)..(203): a, c, t, g, unknown or other
  modified_base (261)..(261): a, c, t, g, unknown or other
  modified_base (290)..(290): a, c, t, g, unknown or other
  modified_base (355)..(355): a, c, t, g, unknown or other
  modified_base (363)..(363): a, c, t, g, unknown or other
  modified_base (392)..(392): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccaggggaaangccaccctctcctgcagggccagtcagagtgttatcaggtacttagcctggtaccaanagaaacctggccaggcctccaggctcctnatctatgatgcatccaagcggccatggcatcccagccaggtcagtcggcaggtgggctgggcagnttcactcncacatcagcagtctggacgtctgtaagtnttttgctagtttattactgtcagtcagtcgtagcgtagttcggccgttcgggtactaggtttcggcgtagggaccaaggcgtaggagactacgaaacgtactggtcggactggaccacgtacgtcttcgttc

SEQ ID NO: 368869 - DNA, 627 bp, Homo sapiens
  misc_feature: GZ8MTXP02JIGQI.25.37.D04.1.454.CMB.2.raw
  modified_base (540)..(540): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctgtgggttcagtcgttagtcacagctacttgatcgtgggtccgccaggctccgaggggaggggctggagtgcgtctcgagtttattatagaccgaataactacccaaccttactacgcagtacctccggtagaacggggtccgtatttcccttaatcctaccgaagtacgaactaacttacccgaaacggaacccacccttactacttaccttaacaaaacgtcgaaaccgtcccctagacgggacgaccgggagacccgacggtccgtagttcttaagnggtcggcggtgggatactacgtggtttacgttacttcgtattaaccttaccgtttccacggttcgggacccgttacggggtcctcgg

SEQ ID NO: 368870 - DNA, 697 bp, Homo sapiens
  misc_feature: GZ8MTXP02H8QCI.25.37.D04.1.454.CMB.2.raw
  modified_base (309)..(309): a, c, t, g, unknown or other
  modified_base (534)..(534): a, c, t, g, unknown or other
  modified_base (608)..(608): a, c, t, g, unknown or other
tcagactgtacagtcacgaccggtgctcgatttagtagcatactgttggggtttgggggggagaggagcccagcactgggattccgaggtgtttccattcggtgatcagcactgaacacagaggactcaccatggcgttttggctgagcgtgggttttccttgttgctgttttaaaaggtgtccagtgtgaggtgcagctggcggagtctgggaggaggcctgatccagccgtgggggtccctgacgactctcctgtagcagcctcgtgggtcagtcgttagtcacagctacttgatcgtcggggtccnccgagggtctaccggagggggaacggggtcgtaggggagttcggtcgttctacgttaagtttacttaagtacggtactaaacttaaacctaccctaacccttacgaccgactacgtaccgttacggtagggaaccggtccttactttcttactccgaacaggaactactaacgtaccgaaacgacccttacctactaatttaccgtaaataaagtaccgaaaccncccgttaaggaacgaccgggaccggtaacggaacccgtcggtaccgttagttacgtaccggtggacggacgggnggggtaatacgtttaggaacggtttgttactttacgaacttaacccgttaccgttcccgtaagggtccggtccgttacggttcctccgg

SEQ ID NO: 368871 - DNA, 574 bp, Homo sapiens
  misc_feature: GZ8MTXP02II6QQ.25.37.D04.1.454.CMB.2.raw
  modified_base (280)..(280): a, c, t, g, unknown or other
  modified_base (473)..(473): a, c, t, g, unknown or other
  modified_base (491)..(491): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctggggggtccctgagactctcctgtgcagcctctgggttcagcgttagtcacngctacttgatctgggtccgcaggctccgaggggaagggctggagtgcgtctcagttattatgcgataataccactacacgcagactccgtagacggtccgatttcctatcctcagagacattccagaccacctactatctacaaatcgaaacgccctgagacggaccgaggacacgggccgtagtacttacgnggtcgacgggacgggganacgttacgtaggttcggttaactttcgaaatttaacctacttttacccgacggtcggggtacccttacggggttcccttcggg

SEQ ID NO: 368872 - DNA, 659 bp, Homo sapiens
  misc_feature: GZ8MTXP02GATOF.25.37.D04.1.454.CMB.2.raw
  modified_base (301)..(301): a, c, t, g, unknown or other
  modified_base (344)..(344): a, c, t, g, unknown or other
tcagactgtacagtcacgaccggtgctcgatttagtagcatactgttgggtttggggtggagaggagcccagcactgggattccgaggtgtttccattcggtgatcagcactgaacacagaggactcaccatggcgttttggctgagctgggttttccttgttgctgttttaaaggtgtccagtgtgaggtgcagctggcggagtcgtggaggaggcctgatccagccgtggggggtccctgagactctcctgtgcagcctctgggttcagtcgttagtcacagctactgatctgggtccncaggctccgaggggagggctggagtgcgtctctagttatttanacgcgaataactaccactacacgcaagacctccgtagaacgggtccatttcccttaatcctaccagacgaactaagttcccaaggtaaccaccccttataacttcttaacgaaaacttcgaaaccgtcccctaggacgacgaccgaggaccacggtccgtgtaactacgttggtacgggacggtacgggggaataacgttaccgttaagggtttcggttttaacttttccggtaaaactttttaaccccgtttaaccgtttttcccccggtaaacggtttccggggggtaccccttaacgggggtttttcccccg

SEQ ID NO: 368873 - DNA, 693 bp, Homo sapiens
  misc_feature: GZ8MTXP02JPV9D.25.37.D04.1.454.CMB.2.raw
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtcgtggaggaggcctgatccgagccgtgggggtccctgagactctcctgtgcagcctcgtgggttcagtcgttagtcacagtctacttgactcgtcgggtcccgccgagggtcctaccggaggggaacggggcgtaggggagtcggcgttctacgtaagtttatttacgtagaccgtaattaaactacccaaccttaactaccgacacgtacctcggtaggaaacggggtccgtatttaccttacgtcctaccgagtaacgactaattacccgaacgtaacccacccttctactacttacgaaaatcgaaaccgcctagagacggaccgaggaccgacggtccgtatacgtacgtcgtggaccgggtaggggatacgttaacggttaggttacggttttacgttaccgtttaactttaacccgtttacccgtttacccccgtaaggggttcccggggtacccgttaccgggggtttcccctttccgggg

SEQ ID NO: 368874 - DNA, 639 bp, Homo sapiens
  misc_feature: GZ8MTXP02GT4L6.25.37.D04.1.454.CMB.2.raw
  modified_base (559)..(559): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctgtggttcagcgttagtcacagctacttgactcgtcgggtcccgccaggcctaccggaggggaacggggcgtgggagtgcgtctcgtagtttattagtagccgtaataactaccacctactacgacagacctccggtaggaacgggtccgtaactttccttaactccctaccaagaacgtaacctaaactttacccgaaaggtaaacccctaccctacttaacttaccttaacgaaaaattcgaaacccgtccctagaacgacgaccggaacgtacgaccggtccgtagttaacttacgnggtcgaccgggtggggatacgtagtagttcggttacttcgattaacgtacttccgtacgtcgggcctacgggttcctcgg

SEQ ID NO: 368875 - DNA, 602 bp, Homo sapiens
  misc_feature: GZ8MTXP02HJRF9.25.37.D04.1.454.CMB.2.raw
  modified_base (398)..(398): a, c, t, g, unknown or other
  modified_base (443)..(443): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctctgggttcagcgttagtcacagctacttgatcgtcgggtccgccaggctccgaggggaaggggctggagtgcgtctctagtttattatagccgataactaccacctactacgcagactcgtgacggccgtattccttanctcagagacaattccaagaccacctctatctacaaatcgaaaccncctagacgagccgagaccacggccgtagtacttacgtgtcggacggacgggggatacgttaacgttaggttaggtttactttacggtaactttaaccgttacccgttttacccgttaacggtcgggggtaccccgttacggggtttccccgttccgggg

SEQ ID NO: 368876 - DNA, 571 bp, Homo sapiens
  misc_feature: GZ8MTXP02FTTDF.25.37.D04.1.454.CMB.2.raw
  modified_base (203)..(203): a, c, t, g, unknown or other
  modified_base (360)..(360): a, c, t, g, unknown or other
  modified_base (376)..(376): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccaggggaaanagccaccctctcctgcagggccagtcagagtgttatcaggtacttagcctggtaccaacagaaacctggccaggcctccaggctcctcatctatgatgcatccaagaggccatggcatcccagccagttcagtcggcaggtggggctggggacaggngttcactctcacctancagactagtcgtaggacgtcgtagtaagttatttagtacttagtttacttacgtagtacagcgtaggtcgtagtacgtacggttccggtccggttacggggttacttggtttcggacggtaacgggaccgaggtcgtaggaacgacgtaacgaaacgtacgtggtaacgtcgtacgacctacctactcgtcgtcg

SEQ ID NO: 368877 - DNA, 612 bp, Homo sapiens
  misc_feature: GZ8MTXP02JR8QD.25.37.D04.1.454.CMB.2.raw
  modified_base (277)..(277): a, c, t, g, unknown or other
  modified_base (519)..(519): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgtttaaaggtgtccagtgtgaggtgcagctggcggagtctggaggaggcctgatccagccgtgggggtccctgagactctcctgtgcagcctctgggtcagcgttagtcacngctacttgatcgtcggtccgcgaggcctccgaggggaaggggcgtggagtgcgtctactagttattagtagcgtataataccactactacgacagacctcggtagaacggggcctactttcctatcctacccagaacgaactaaattcccgaaggaaccctaccctactaactaccttacgaaaatcggaaaccgtccctagacgacggacccgaggtaccgcggtaccgtgtactttacgngtcggcgggagggatacgtagttaggttacgttacttacgtactttaaccgttaccgttaccgtacggtcgggtacccgtccggttccctcgg

SEQ ID NO: 368878 - DNA, 721 bp, Homo sapiens
  misc_feature: GZ8MTXP02HBMQB.25.37.D04.1.454.CMB.2.raw
  modified_base (259)..(259): a, c, t, g, unknown or other
  modified_base (638)..(638): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcttgggttttccttgttgcttagttttaaaaggtgtccagtgtgaggtgcagcgtggcggagtcgtggaggaggcctgatccagccgtgggggtccctgagactctctgtgcngcctcgtggttcagtcgttagtcacagccttacttgagtcgtcggtcccgccgaggccgtaccggaaggggaagggcgtgggacggtgtccgttcgtacgtaaagtttatttaagtacgacccgtaacttaaacctaaccctaaccttacgaaccggcacgtccgttaccggtacggaaacggggtccctactttacccttatcccgtaaccagtaacgaacctaacttacccgaaacggtaacccctaaccccgttacttaacttaccttaaaccgtaaacgttacggaaaaccccgtcccgttaaggaaaccggacggacccggaacggaaccgtacgggtccgttaagtacgttacgtggtacgcgggacgggtanacgttacgtaggttcgtttaacgttcgtaactttaacgttaaccgttcccgttacggtcggtcccgttacgggtcccttacgg

SEQ ID NO: 368879 - DNA, 721 bp, Homo sapiens
  misc_feature: GZ8MTXP02GQZAQ.25.37.D04.1.454.CMB.2.raw
  modified_base (286)..(286): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcttgggttttccttgttgcttagttttaaaaggtgtccagtgtgaggtgcagctggcggagtcgtggaggaggcctgatccgagccgtgggggtcctgagactctcctgtgcagtcctcgtggttcagtcgttagtcacngtctacgttgattcgtcgggtcccgaccgacgggtccgtaccggaagggggaaggggtcgtggggtacgtcggtccgttcgttacgtaagtttaatttaagtagtaccgtaacttaaacctaaccctaacctaactaccgacacgtaaccgtccggtaggaaaccggggtcctaatttcccttaactccctaccgaaagaacgtaacctaaacgttacccgaaacggtaaacctaccccttattaactaccctttaagaaaagttccgaaacccgccgtagaacggacgtaccggaaacggtacccgacggtcgttagttacgttacgtggcggacgggtacggggtataacgttagtaaggtttgttaactttacggtactttaacccgttccgtttacccgtaggtcgggggtaaccctcgggtttccctcgg

SEQ ID NO: 368880 - DNA, 652 bp, Homo sapiens
  misc_feature: GZ8MTXP02G51Y6.25.37.D04.1.454.CMB.2.raw
  modified_base (309)..(309): a, c, t, g, unknown or other
  modified_base (363)..(363): a, c, t, g, unknown or other
  modified_base (420)..(420): a, c, t, g, unknown or other
  modified_base (444)..(444): a, c, t, g, unknown or other
  modified_base (454)..(454): a, c, t, g, unknown or other
  modified_base (482)..(482): a, c, t, g, unknown or other
tcagactgtacagtcacgaccggtgctcgatttagtagcatactgttggggtttgggggggagaggagcccagcactgggattccgaggtgtttccattcggtgatcagcactgaacacagaggactcaccatggcgttttggctgagcttgggttttccttgttgcttagttttaaaaggtgtccagtgtgaggtgcagctggcggagtctgggaggaggcctgatccagccgtgggggtccctgagactctcctgtgcagcctgtgggttcagtcgttacgtcacagtctactgatcgtcgggtccnccgaggctccggaaggggaagggctgggagtcgtcgtactctaagtttaattanagacgtaataactaaccactactacgcagactcgtagaacggtccgtattaccttancctacaagacaactaactccgaanaacccacctnttaatcttaacgaaaactcggtaaaccncctagaacgacgaccgaacgaccgtacggtacgttagttacttacgcgtacggacgggacgggtaatacgttaaacggttacgtttacggtttaactttacgttaaactttaaccgttacccgtttacccggtacgggtccgggtacccggttaccgggtttccctacgg

SEQ ID NO: 368881 - DNA, 712 bp, Homo sapiens
  misc_feature: GZ8MTXP02H3TNX.25.37.D04.1.454.CMB.2.raw
  modified_base (300)..(300): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctgggaggaggcctgatccagccgtgggggtccctgagactctcctgtgcagcctctgggttcagcgttagtcacagctacttgatctgggtccnccagggctccgagggagggctggagtgcgtatctagtttattatagccgaataacttacccgaaccttactaccgactacgacctaccgtagggaaacgggtcctactttcctttaagttccctaccaggacgaaccctaagtttacccccgaaagggttaaacccaaacccccgtttcttaacttaccctttaaaactaaaacggttccggaaacccggtacccgtaggaaccggaccgggacccgaagggaccgtaccggtccgttagttacttacggtgggtacggcggggtacggggaataacgtttacgtacggtttacggttacttttaccggtaaacttttaacccgttacccgtttacccggttacgggtccggggtaccgtttaccggggtttacccctcggg

SEQ ID NO: 368882 - DNA, 678 bp, Homo sapiens
  misc_feature: GZ8MTXP02I4YF8.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgcttagttttaaaaggtgtccagtgtgaggtgcagctgggcggagtcgtggaggaggcctgatccagccgtggggggtccctgagactctcctgtgcagcctctgggttcagtcgttagtcacagctaactgatcgtcgggtccgccacggctaccgaaggggaaggggctggagtcgcgtctacgtagtttatttaagtacgaccgtaattaaactaccaacccttactaaccgctacgacctaccggtaggaacggggccctaatttcccttatcctaccagacgaactaattacccaaggaacctaccctactacttactacaaaatcgaaaccgccctagacgacggacccggaaggaccacggtccgtagttaacttacgtgtacgcgggacgggggaatacgttaacgttaacggttgggtttaactttacggttaactttaaccgtttaaccctttacccgtacggttacgggggtacccgttaaccgggggtttccctttaccggg

SEQ ID NO: 368883 - DNA, 657 bp, Homo sapiens
  misc_feature: GZ8MTXP02FG34W.25.37.D04.1.454.CMB.2.raw
  modified_base (302)..(302): a, c, t, g, unknown or other
  modified_base (575)..(575): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctcgtgggttcagcgttagcacagctacttgatcgtgggtcccnccaggcctccgaggggaaggggctgggagtgcgtctctagttatttatagccgaataactaccacctactacgcagacctcggtaggaacggggccctaatttcccttaatccgttacccaagaacgaactaaacgtttacccgaacggaaaccctaccccttacttacttacctttacaaaacttcgaaaacccgtccctagaacggaacggacccggaacggaccgaccgggtccgttagttaacttaccgtggtcggcgggacggggganaacgttacgttaggttcggtttaacttcgtaacttaacgttacctttacccgacggtcggggaccgtacggttcccgtacgg

SEQ ID NO: 368884 - DNA, 722 bp, Homo sapiens
  misc_feature: GZ8MTXP02JH12H.25.37.D04.1.454.CMB.2.raw
  modified_base (289)..(289): a, c, t, g, unknown or other
  modified_base (313)..(313): a, c, t, g, unknown or other
  modified_base (316)..(316): a, c, t, g, unknown or other
  modified_base (340)..(340): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttggggttttccttgttgcttagttttaaaaggtgtccagtgtgaggtgcagcgtggcggagtcgtggaggagcctgactccaggccggtgggggtccctgacgactctcctgtgcagtcctgtggtcagtcgttagtcanagtctacgtgactcgtcggtcccncgnggtccgaccggaggggagggtcgnggagtcgcgttctcgtaagtttattagtacgacgtaactaaacctaccctaaccttacgacacacgtaccgtacggtacggaaaccggggtccttaactttccttactacctaccgaagtaacaacctaaacgttacccgaaacggtaaccctacccttacttaactaccttaaacgaaactaccggtaaccgaccccgtaggaacggccggtaacccggaaggtacccgaccggtccgttagttaacgttcgtggtaacggccgggggagggtataacgttaacggttagggtttacgtttacgtttaacgtaaccttttaaccgttacccgtttaccgtacggttccgggggtacccttaccgggggttacctttcccgg

SEQ ID NO: 368885 - DNA, 642 bp, Homo sapiens
  misc_feature: GZ8MTXP02JHZTN.25.37.D04.1.454.CMB.2.raw
  modified_base (302)..(302): a, c, t, g, unknown or other
tcagactgtacagtcacgaccggtgctcgatttagtagcatactgttgggtttggggggagaggagcccagcactgggattccgaggtgtttccattcggtgatcagcattgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtggttcagcgttagtcacagctacttgatcgtcgggtcccncgaggcctccgaggggagggctgggagtgcgtctctagtttattagtagccgtaataatacccactactacgcagcgtcgtagaacggcctatttcctatcctcagagaactacttcccgaagaacccacccttatacttcctaacgaaaagtcgaaaccgtccctagagacgaccggaaggaccacgggtccgttagtacgttacgtcggcggacggggaccgggggaataacgttaacggttaaggtttcgggtttaaactttccggtaactttaacccgtaaccgtttttccccaaaggggtccgggtacccgtttaccggggtcccgtttaccggg

SEQ ID NO: 368886 - DNA, 906 bp, Homo sapiens
  misc_feature: GZ8MTXP02HSQK3.25.37.D04.1.454.CMB.2.raw
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagcgtggcggtagtcgtgggaggacggcctgactccgacggtccgggtcgggggtcctaggacgtacctcctccgtgtcgcgacgtcctcggttcggtcacggtcgttacgtaccacgacgtcttacgttagtcgttcggtccgggtccccgccggacggtcccgtaccgggaagggggaacgggtcggtagggtaggtcggtccgttcgttacgttaagttttagttagtacgtaccgtaaaattaacctaacccctaaccttacgtacccggactaccggtaccgttaccggtaagggtaacccggggtaccttaccttttacctttaccgtacccttaaccgaaacggtaaactaaaccttaacccgttacccggaaaaccgtaaacccccttaccctttacgtttaaccttaacccgttaaaacctaaaacgttaccgggaaacccccttccggttaaacgggaaacggtaccccgggggaaccccggaaaccggggtaacccggtacccggggttaccggtttagtttaaaaccgttccggttaggggtacccgggacgggggtaaccgggggttaaataacgtttaacgggtttagggttttacggttttaactttacccggttaactttttaaccccgtttaccgttttacccggttacggggccggggttacccggtttacccgggggttttcctaaccccgggg

SEQ ID NO: 368887 - DNA, 672 bp, Homo sapiens
  misc_feature: GZ8MTXP02GOFLV.25.37.D04.1.454.CMB.2.raw
  modified_base (258)..(258): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgtttaaaaggtgtccagtgtgaggtgcagctggcggagtctggaggaggcctgatccggcgtcgggggtccggtcgagactctcctcgtggcncgcctcgtggttcgtgcgtgttacacagcgtacttagtagtcgtcgggtccggccgcggacgtccgaggggaaggggcgtggaggtgcgtcgtctagttatttagtagtacgactaactaccacctacctacgacacgcgtaccgtggaacggaccgtacttacttacttcacctagaacgtaactaacgttacccgaacggaaacctccccttactagttaccttacgaaaatacggtaacccacccgtgagacgacgacggacgacggtccgtagtacttacgtgtcggcgggcgggggaatattaaccggtaggttacgggtttactttacccggttaatttaaccctaacccgtttttcccgtaacggttcgggggtaccctaccgggggttttcccacggtttccccgg

SEQ ID NO: 368888 - DNA, 636 bp, Homo sapiens
  misc_feature: GZ8MTXP02HL8NX.25.37.D04.1.454.CMB.2.raw
  modified_base (527)..(527): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtcgtggaggaggcctgatccaggccgtggggggtccctgagactctcctgtgcagcctgtgggttcagcgttagtcacagctacttgactcgtggtccgcaggctccgaggggaaggggctggagtgtgtctcgtagtttattagtagaccgtaataactaccaccttactacgcacgacctcgtaggaacgggccgtactttccgttactcctaccaggacgaacaactttcccgaaaggtaacccacccttactattcctaacaaaattcgaaacctccctagacgacggaccgaggaccacggtccgtagtacttacgngtcggccggagggggactagtacgttacggtagggtttactttacgtaagtttaaccttaccgtttacccgtacggtcggggtacccgttacgggtttccccttcgggg

SEQ ID NO: 368889 - DNA, 782 bp, Homo sapiens
  misc_feature: GZ8MTXP02JEKRF.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgctgttttaaaaggtgtccagtgtgaggtgcagctggcggagtcgtgggaggaggcctgatccaggccgtgggggtccctgagctctcctgtgcagcctcgtgggtcagtcgtagtcacagctacttgacttcgtcggggtcccgccgacgggtccgtacccggaagggggaaacgggggtccgtaggggtaacggttcgggtccggtttacctacgttaagttttaagttttaacgtaacggtacccgtaaaacttaaactaaccccctaacccttaaccgtaaccgcacggtaccgtccggtaagggaaccgggtccgttaactttcccgttactccctacgaagtaacgaactaaacttcccgaaacggtaacccctacccttacttaactaccttaacaaaacgtcgaaaccgccctaggacgacggacccgaagggaacccgtacgggtcccgttaagtacttaccggtagggttacgggacggggtaccgggggaagtaacggtttaacgttagggtttacgtttaacgtttaccggtaatttaaccctttaccgttttcccgtaacggggttccggggtacccggtttaccggggttacccgtttcccggg

SEQ ID NO: 368890 - DNA, 581 bp, Homo sapiens
  misc_feature: GZ8MTXP02F2EQW.25.37.D04.1.454.CMB.2.raw
  modified_base (298)..(298): a, c, t, g, unknown or other
  modified_base (422)..(422): a, c, t, g, unknown or other
  modified_base (439)..(439): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctgggggtccctgagactctcctgtgcagcctctgggttcagcgttagtcacagctacttgatctgggtccnccaggctccgaggggaaggggctgggagtgcgtctctagttatttatagcgataactaccacctactacgcagactccgtgaacgggccgattcctatctccagagacaattccagaccacctntatctcaaatgaaaccnccctgagagccgaaggccacggccgtgtattacgtggtcgcggacgggggatacttaacgtaggttaggtttactttcggtaatttaaccgttaccttttccccgacgttcgggggtccctaacgggggtttccccttcggg

SEQ ID NO: 368891 - DNA, 559 bp, Homo sapiens
  misc_feature: GZ8MTXP02HPBC5.25.37.D04.1.454.CMB.2.raw
  modified_base (297)..(297): a, c, t, g, unknown or other
  modified_base (481)..(481): a, c, t, g, unknown or other
  modified_base (494)..(494): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctgggggtccctgagactctcctgtgcagcctctggttcagcgttagtcacagctacttgatctgggtccnccaggctccgaggggaaggggctgggagtgcgtctcagtttatttatagccgataataccacctactaccgcagactccgagaacgggccgaattcctatcctccagagaacattccaaggaaccaccctctaatcttacaaatgaaaccgcctgacgagccgaggacacgggctgtatactgngtacggcgggganatacgtagtcggttatttcgatttaactactttcccgacgtcggggcctacgggtttccctcggg

SEQ ID NO: 368892 - DNA, 667 bp, Homo sapiens
  misc_feature: GZ8MTXP02IS7U2.25.37.D04.1.454.CMB.2.raw
  modified_base (359)..(359): a, c, t, g, unknown or other
  modified_base (386)..(386): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccaggccgtgggggtccctgagactctcctgtgcagcctcgtgggttcagcgttagtcacagctacttgatcgtcgggtccgccgaggcctaccggaggggaacggggcgtgggaggtgcgtctcgtagtttattanagacgaataactaccacctactacgcngactccggtaggacgggccgtacttccttactcctaccaagtaacgaacctaacttacccgaacggtaaaccctaccccgtacttaacttccttaacaaaacttacgaaaccgccccgttaggaccggacggacccgaacggaccgaaccggtccgttagtacttacgtggtacggcggacgggggtatagttacgttaggttggtttaactttcggtaaactttaaccgttacctttacccgttacggtcggggtaccctacgggtttccccgtttccgg

SEQ ID NO: 368893 - DNA, 585 bp, Homo sapiens
  misc_feature: GZ8MTXP02FRIWH.25.37.D04.1.454.CMB.2.raw
  modified_base (440)..(440): a, c, t, g, unknown or other
  modified_base (460)..(460): a, c, t, g, unknown or other
  modified_base (501)..(501): a, c, t, g, unknown or other
  modified_base (515)..(515): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagcgttagtcacagctacttgatcgtgggtcccgccaggcctccgaggggaaggggctgggagtgcgtctctagttatttatagcgaataactaccacctactacgcacgactccgtagaacgggcctaattccttatcctccagacgactaattcccaaggacctaccctntatactacaaatcgaaaccnccctagacgagaccgagaccgacggccgttagtattaccgngtcgcggcgggganacttacgtagttggtttacttcgatttaacgttacctttccctacgtcggggcctacggggttcccctgg

SEQ ID NO: 368894 - DNA, 646 bp, Homo sapiens
  misc_feature: GZ8MTXP02I1D7Q.25.37.D04.1.454.CMB.2.raw
  modified_base (285)..(285): a, c, t, g, unknown or other
  modified_base (361)..(361): a, c, t, g, unknown or other
  modified_base (460)..(460): a, c, t, g, unknown or other
  modified_base (549)..(549): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgctgttttaaaaggtgtccagtgtgaggtgcagctggcggagtcgtgggaggaggcctgatccagccgtgggggtccctgagactctcctgtgcagcctgtgggttcagtcgttagtcacngctacttgatcgtcgggtccgccagggcctaccggaggggaacggggctgggagtggcgtctacgtagtttattanagaccgtaataactaccaacctactacgcagacctcggtaggacggcctatttccctatcctaccagacgaactaacttccaaacggaacccacccttntacttactacaaaacgtcgaaaccgccctagacgacggaccgaaggaccgtacggccgtagtacttacgtgtcggacgggacggggtanaacgttacgttaaggttcggtttaacttttccggaattttaaccgttacccgtttccgtaaacggtcgggtaccccgttacggggtttcccttcggg

SEQ ID NO: 368895 - DNA, 672 bp, Homo sapiens
  misc_feature: GZ8MTXP02IRRNB.25.37.D04.1.454.CMB.2.raw
  modified_base (204)..(204): a, c, t, g, unknown or other
  modified_base (240)..(240): a, c, t, g, unknown or other
  modified_base (263)..(263): a, c, t, g, unknown or other
  modified_base (295)..(295): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccgaggggaaancgccaccctctcctgcagggccagtcagagtgttancaggtacttagcctggtaccaanagaactggccaggctccgaggctctcatctangatgcatccgaaaggcggccacgtggaccactccccgagcctaggttcaggtcggcgaggtggggctggacagtcgttcactctaccaccatccgagcgtagtcgtggacgtccgtaggtaagttattttgacgtttaagtttacttacgttacgttacgagtacgtaggtaccggttaggaccgttagggttaccggggtcccgggtttaccgggggttaacgttacggggtttttacggggacccgggtaacgggggtaacccgtaaagggtccggttaaggggaaacggtaacgtaaaccggtaaaaaccggtacggttacggttcgggtaccgttacggacccgtacgtaaccgtttcgttacggtttacccg

SEQ ID NO: 368896 - DNA, 688 bp, Homo sapiens
  misc_feature: GZ8MTXP02G9M8F.25.37.D04.1.454.CMB.2.raw
  modified_base (204)..(204): a, c, t, g, unknown or other
  modified_base (292)..(292): a, c, t, g, unknown or other
  modified_base (299)..(299): a, c, t, g, unknown or other
  modified_base (415)..(415): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccgaggggaaancgccaccctctctgcagggccagtcagagtgttatcaggtactagcctggtaaccaacaagaacctggaccaggcctcccagcctccncatctangatgcactaccgaaggacggccagtggacactcccagtcccgtaggtcaggtcgcgaggtcggggcagggactagtcgttcgaacctcgtaccaccatccgagaccgtagttccgnggaacgtcccgtaaggtaaagttacgttttagaccgtttaagtttaccgttacgttcgtacgtacggacgtaacggtcgttaacgggtcgtacggggttccggtaccccggggtttaccgggttacggttaacgggttttccgggaccgggtaaaacggggtacccgtaaagggttccggtaagggaaacgttaccgtaaaaccggtaaaacgtaccggtttgggaacgggtcttaacggaccctaaacccttggttacccttacggtttccc

SEQ ID NO: 368897 - DNA, 630 bp, Homo sapiens
  misc_feature: GZ8MTXP02IU96X.25.37.D04.1.454.CMB.2.raw
  modified_base (542)..(542): a, c, t, g, unknown or other
  modified_base (557)..(557): a, c, t, g, unknown or other
tcagactgtacagtcacgaccggtgctcgatttagtagcatactgttgggtttggggagaggagcccagcactgggattccgaggtgtttccattcggtgatcagcactgaacacagaggactcaccatggcgttttggctgagctgggttttccttgttgctgttttaaaaggtgtccagtgtgaggtgcagctgggcggagtctggaggaggcctgatccagccgtggggggtccctgacgacttctcctgtgcagccctctggggttcagtcgttagtcacagctacttgatcgtgggtccgccagggcctccgaggggaaggggctgggagtggcgttctcgtaagtttatttaataggccgtaattaactaccccaaccttaacctaccggcagtaccttccggtaggaacggggcccgtaatttccgttatcctcaagagacaacttccgaaggaacccacccttactaactacttacaaaacttcgaaaccgccctagacgacggacccgaggacacgggtccgtgtacttacgngtcgcggcggggganagtacgtagttcgtttatttccgtatttaacttactttacccgtacgtcgggtacctacggggtttccctcgg

SEQ ID NO: 368898 - DNA, 617 bp, Homo sapiens
  misc_feature: GZ8MTXP02F7944.25.37.D04.1.454.CMB.2.raw
  modified_base (285)..(285): a, c, t, g, unknown or other
  modified_base (516)..(516): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtcgtggaggaggcctgatccagccgtggggggtccctgagactctcctgtgcagcctcgtggttcaggtcgttagtcacngcttacttgatcgtgggtcccgccgaggcctcgaggggaaggggcgtgggagtgcgtctctagttatttatgaccgaataactaccacctactacacagactcgtaggaacggccgtatttccttatcctccgaagacgaactaattacccgaacgaacctacccttactactcttacaaaatcgaaaccgcctagagacgccgaaggacgacggccgttgtaacttacgnggtcggcgggacggggatacgtattaggttgtttaacgttcgtaaactttaaccttaccgtttcccgtaggtccggggtcctaacgggtttccccgtacgg

SEQ ID NO: 368899 - DNA, 777 bp, Homo sapiens
  misc_feature: GZ8MTXP02JFME7.25.37.D04.1.454.CMB.2.raw
  modified_base (203)..(203): a, c, t, g, unknown or other
  modified_base (239)..(239): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtcttgtctccgaggggaaancgccaccctctcctgcagggccagtcagagtgttancaggtacttagcctaggtaccaacgagaaacctggccaggcctcccgaggcctcctcatctatgatgacataccgaaggcggccagtcggactacgtccccgagccgtaaggttcaaggtccggacgtaggggtcggggcgtacggggaactacggtacggttccaacgttcccttaccgaacccgtaagtttccgggaacggttaccgggtacccgttaacgggtaaacccgttaggaaaccgtagtttacggccgttaacggaacccttaaacgtaaactttacgtttaaaccgtaccggttaaacaaaaccggtaggtaacggttaacgggacgtaaccccgttaccctaaccttaccgtaaccgtttaacccgggttttacggaaccccggggtaaacgggggttaaaccccgaaaagggtccggttaaacgggggaaactaaacccgttaaaccggaaaaccgtaacggtttcgggaacgggttaccttaccgggaaaccctaccgttaactttccggtacgttttaaccccg

SEQ ID NO: 368900 - DNA, 611 bp, Homo sapiens
  misc_feature: GZ8MTXP02H3YRK.25.37.D04.1.454.CMB.2.raw
  modified_base (371)..(371): a, c, t, g, unknown or other
  modified_base (377)..(377): a, c, t, g, unknown or other
  modified_base (392)..(392): a, c, t, g, unknown or other
  modified_base (401)..(401): a, c, t, g, unknown or other
  modified_base (422)..(422): a, c, t, g, unknown or other
  modified_base (434)..(434): a, c, t, g, unknown or other
  modified_base (608)..(608): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctcgtgggttcagtcgttagtcacagctacttgatcgtgggtccgccaggctcgaggggaggggctggagtgcgtctcagtttattatagccgataactaccactactacgcngctcgngaaggccatccttancctacaganacaattcccaagacccacctntaagtccttaanaaacgtcgacctccgtagacggacgaccgaggaccgtacggtcgtagttacgtacgtgtacggaccgggtacggggtataacgttacggttaggtttacgtttactttaccgtaacttttaacccgttaccgtttacccgtacgggtccggggtacctttaccggggtttcccncgg

SEQ ID NO: 368901 - DNA, 656 bp, Homo sapiens
  misc_feature: GZ8MTXP02JN16C.25.37.D04.1.454.CMB.2.raw
  modified_base (203)..(203): a, c, t, g, unknown or other
  modified_base (304)..(304): a, c, t, g, unknown or other
  modified_base (419)..(419): a, c, t, g, unknown or other
  modified_base (426)..(426): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagaccaccctgtctttgctccgaggggaancgcccaccctctcctgcgagggccagtcagagtgttatcgaggtacttgcctaggtaaccaacaagaaacctggaccaggcctccgagcctcctcatctangatcgacactccgaaggcggaccacgtcggaccacgtccccgaggtacccgtaggttcgaggtccggacgtaggggtcggggctaggggacagtcgttcctactccgtacacgtncgagacngttcgaggacgtcgtaagtaattcgttttacgcgttaagtttacttacgttgtcaagcgtaggacttacggcgttacgggttccggaccccgggttacgggggttaacttacgggggtttccggaccggtaacgggggacctaggtcccggaaagggactaaacggtaacgaaaaccggttgtcggtaacggtacgtacggacccaacggttacttcgtcgtttaacccg

SEQ ID NO: 368902 - DNA, 591 bp, Homo sapiens
  misc_feature: GZ8MTXP02FYL4P.25.37.D04.1.454.CMB.2.raw
  modified_base (208)..(208): a, c, t, g, unknown or other
  modified_base (250)..(250): a, c, t, g, unknown or other
  modified_base (263)..(263): a, c, t, g, unknown or other
  modified_base (315)..(315): a, c, t, g, unknown or other
  modified_base (318)..(318): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcgtggtttcgtgtagctgtttaaaagtgtcagtgtgaggtgcagctggcggagtctggaggnggcctgatccagccgtgggggtccctgagactctcctgtgcncgctcgtggtcgngtcgtagtcacacgctactgtcgtcgtcggccgcgcgcgacggaggaggcgnggngtccccgtcgtctagtagttattagtagtacgtaactaactaacctacctacgtacacgcgacgtcggtacggacgtactacttacttactctacagacgaactactacgacgacctacctactactactaactaacgtacgaccgacgacgacgacgacgacgacgacgtacgtacgtagtacgtcgtcgacggacggacgtacgtacgttacgttacgttacgttacgttacttaacgttacgttacgtacggtcggtcgtacggtcgtcg

SEQ ID NO: 368903 - DNA, 595 bp, Homo sapiens
  misc_feature: GZ8MTXP02GHHZT.25.37.D04.1.454.CMB.2.raw
  modified_base (282)..(282): a, c, t, g, unknown or other
  modified_base (304)..(304): a, c, t, g, unknown or other
  modified_base (346)..(346): a, c, t, g, unknown or other
  modified_base (513)..(513): a, c, t, g, unknown or other
  modified_base (528)..(528): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagcgttagtcacngctacttgatcgtgggtccgcnggctccgaggggaagggctgggagtgcgtctctagttattanagaccgataactaccacctactacgcagactcgtagacggccgtattcctatcctcaagacgaactaacttacccgaaggaaccctaccctacttactaccttaccaaaagttcggaaaccgtccctagagaacggccgaagggacgacggtccgtagtacttacgngtcgcggcggggtanacgtacgtagttgttacttcgtaattccgttaactttccgtacggtcggtacctacgggttcctcgg

SEQ ID NO: 368904 - DNA, 671 bp, Homo sapiens
  misc_feature: GZ8MTXP02I3FMO.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgtcttagttttaaaaggtgtccagtgtgaggtgcagcgtggcggagtcgtgggaggaggcctgatccagccgtgggggtcctgagctctcctgtgcacgcctgtggtcagtcgtagtcacagctactgactcgtcggtccgcgaggcgtccggaggggagggcgtgggagtcggtcgtctacgtagtttattatacgtaccgtaataactacccaaccttaacgtaccgacacgtaccgtccggtacggacggtccttaacttccttactccgtacgaagaacgtaactaaacgttacccgaaacggtaaccctaacccttacttaaaccttccttaaacaaaacgtccgaaaccgtcccgtagaacgacggaccggacggaccgacggtccgtagttacgttagtcggtacggcgggacgggtgtaacgtagttaggtttcgttaacttcgttaacttaaccgtttccttaccgtacggtccggggtacctcgggtttccttccgg

SEQ ID NO: 368905 - DNA, 611 bp, Homo sapiens
  misc_feature: GZ8MTXP02ISGW9.25.37.D04.1.454.CMB.2.raw
  modified_base (204)..(204): a, c, t, g, unknown or other
  modified_base (240)..(240): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccagggggaaangccaccctctcctgcagggccagtcagagttgttancaggttacttagcctggtaccaacagaaacctggccaggctccaggctcctcatctatgatgcatccaaggacggccagtggcatcccagcctaggttcagtcggcaggtcggggctggggacagtgttcactccgacaccatccaagcagtcgtggacgcgtagtaacgttagtttgtacgttagtttattacgttgtacgtagtacgtagtacgtaggtacgtacggttcggtaccggttaccgggggttaacgttcgggtttttacggggaccggtaacggggtaccgtaaggtcgttagggaaacgtacgtacgaaaacgtacgtagtcggtacgtacgacgtaccgtacgttcggttcgtttaccg

SEQ ID NO: 368906 - DNA, 591 bp, Homo sapiens
  misc_feature: GZ8MTXP02FWJNJ.25.37.D04.1.454.CMB.2.raw
  modified_base (344)..(344): a, c, t, g, unknown or other
  modified_base (504)..(504): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagcctgggggtccctgagactctcctgtgcagcctctgggttcagcgttagtcacagctacttgatctgggtccgccagggctccgagggaaggggctgggagtgcgtctcagttatttanagcgataactaccacctactacgcagactccgtagaacggccgtatttcctatctaccagtacgaacaattcccgaaggaaccctacccttactactaccttacaaaatcgaaaccgccctaggacgacgccgagacacggccgtagtataccgtggtcncggcggggaagacttacgtaggttacgttattcggtaattaaccgttacctttcccgtacgtcggggtacctacgggtttcccctgg

SEQ ID NO: 368907 - DNA, 651 bp, Homo sapiens
  misc_feature: GZ8MTXP02JL2OD.25.37.D04.1.454.CMB.2.raw
  modified_base (556)..(556): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagtcgttagtcacagctacttgatcgtcggggtcccgccagggcctccggaaggggaacggggcgtgggagtcgcgtctcgtagtttattatagccgtaataactacccacctactacgacacgtacctcggtaggaacgggccgtactttcctactcctaccaagacgaactaacttcccgaacggaaccctaccctacttactaccttaacgaaactcgaaaccgccctagacgacgaccgaggaccacggtccgtagttactacgtgtcggccggtagggggtanaacgttacgttaaggttacgggtttaactttcgtaactttaaccttaaccgttttcccgtacggtcgggtacccgttacgggtttcccttccggg

SEQ ID NO: 368908 - DNA, 679 bp, Homo sapiens
  misc_feature: GZ8MTXP02IEXF7.25.37.D04.1.454.CMB.2.raw
  modified_base (305)..(305): a, c, t, g, unknown or other
  modified_base (613)..(613): a, c, t, g, unknown or other
tcagactgtacagtcacgaccggtgctcgatttagtagcatactgttgggtttggggagaggagcccagcactgggattccgaggtgtttccattcggtgatcagcactgaacacagaggactcaccatggcgttttggctgagtcttgggttttccttgttgcttagttttaaaaggtgtccagtgtgaggtgcagctggcggagtcgtgggaggaggcctgatccgaggccgtgggggtccctgagctctcctgtgcagcctgtggtcagtcgttagtcacagtctactgactcgtcggtccncgacggcgtaccggaggggaaggggcgtgggagtcggtcgttacgtacgttaagtttattagtacgaccgtaaactaacctaccccaaccttaacgtaccgacacggtaccgttacggtacggtaaccgggtcccttactttccttaacgtcctaaccgaagtaacgaacctaaacgttacccaaacgtacccctaccttactaacttaccgttaacaaaacgtcgaaccgtaccgtagacgacggccgaaggaccgtaccggtacgttagttacgtacgtgggacgccgggagggtatattaacggngtttacgttacgtttcaactttaaccgttaccttaccggtcggtcgggtccgtaccggtttccgcg

SEQ ID NO: 368909 - DNA, 745 bp, Homo sapiens
  misc_feature: GZ8MTXP02FMO71.25.37.D04.1.454.CMB.2.raw
  modified_base (313)..(313): a, c, t, g, unknown or other
  modified_base (628)..(628): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgcttagttttaaaaggtgtccagtgtgaggtgcagctggcggagtcgtggaggaggcctgatccgaggccgtgggggtcctgagactctcctgtgcagtcctcgtgggttcagcgttagcacagtctacttgactcgtcgggtccgccgnggccgtaccggaggggaaggggcgtgggagtcgtccgtctacgttaagtttatttaagtacgtaccgtaaattaacctaacccaacctacgtacgacacgtaccttccggtaaggaaccgggtcccgttaactttaccctttataccctaccgaaaggttaacaaccttaaacttacccgaaacggtaaacccctacccttacttaacgttaccttaaacgaaaacgtccgaaacccgtcccgtaaggaacgacgggacccgaacggaaccgtaaccgggtccgttagttaacttacgtcgggacggaccggggnggggaaattacgttaaccggttaggtttagggtttaactttacgttaactttaacccgtttaacccgtttcccgtacggttccgggggtaaccgtaccggggtttccctttaccggg

SEQ ID NO: 368910 - DNA, 622 bp, Homo sapiens
  misc_feature: GZ8MTXP02JGU5Z.25.37.D04.1.454.CMB.2.raw
  modified_base (201)..(201): a, c, t, g, unknown or other
  modified_base (209)..(209): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccagggaangccacctntcctgcagggccagtcagagtgtatcaggtacttagcctggtaccaacagaaacctggccaggctccaggctcctcatctatgatgcatccaagcggccagtggcactcccagcctaggtcagtcggcaggtcgggctggggacagcgttcactctcaccatcagcagtcgtaggacgctagtaagttacgtttagacttagtttactttaacgttgttaccgtaggtacgtacggtacgttaaggccgtaggtttcggggtcccggttaccgggggttaacgttacgggtttttcgggacccgggtaacgggggtaaccgaacgggtacggttagggaaacggtaacgtaaccgtaaaaccggtacgtacggtcggacgttcggaccgtacctacgttccgttacggtttcc

SEQ ID NO: 368911 - DNA, 687 bp, Homo sapiens
  misc_feature: GZ8MTXP02G8TB4.25.37.D04.1.454.CMB.2.raw
  modified_base (277)..(277): a, c, t, g, unknown or other
  modified_base (311)..(311): a, c, t, g, unknown or other
  modified_base (511)..(511): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgtcttagttttaaaaggtgtccagtgtgaggtgcagcgtggcggagtcgtgggaggaggcctgactccgacggtcccggtcggggggtccctggacgtacctctcctgtcgcncgtccttcgttcgggttcagtcgttacgtcaacngtcttactgactcgtcggtcccgcgacggcgtaccggaggggagggcgtaggagtcggcgttctcgtagtttattagtagaccgtaataacctaacccgacctacctacgcgtacgaccgtcggtacggaacgggtcctactttaccttacgtcctaccgaaggtaacaactaaccgttaccgaacgaccctaacccttntaaactcttaacaaaagtccgaaacccgccgtaggacgacggacgtaaccgacgtaccgggtcttagtactggtgcgggaccggaggataacgttggtaaacgtttgttacgttacgtaacctttaaccgttccgtttacccgtagggtccggtaccgttacgggttcccttccgg

SEQ ID NO: 368912 - DNA, 641 bp, Homo sapiens
  misc_feature: GZ8MTXP02IIZUN.25.37.D04.1.454.CMB.2.raw
  modified_base (353)..(353): a, c, t, g, unknown or other
  modified_base (409)..(409): a, c, t, g, unknown or other
  modified_base (463)..(463): a, c, t, g, unknown or other
  modified_base (523)..(523): a, c, t, g, unknown or other
  modified_base (540)..(540): a, c, t, g, unknown or other
tcagactgtacagtcacgaccggtgctcgatttagtagcatactgttgggtttggggggagaggagcccagcactgggattccgaggtgtttacattcggtgatcagcactgaacacagaggactcaccatggcgttttggctgagctgggttttccttgttgctgttttaaaaggtgtccagtgtgaggtgcagctggcggagtctgggaggaggcctgatccaggccgtggggggtccctgagactctcctgtgcagcctcgtggggttcagtcgttagtcacagctacttgatcgtgggtccgccaggctccgaggggaagggcgtggagtgcgttctctagttatttangccgaatactaccacctactacgcagacctcgtaggaacggtccgtattccgttanctaccagaagactaacttacccgaaggaaaccctacccttataacttaccttanaaaacttcggaaaccgtcccgtagacgagacccgtaggaccacggccgtgttacttacgnggtcgccgggagggganacttacggtaaagttgggttttaaactttcgtaatttaaccgttaccttttacccccgttaggtaccggggtacccgttacgggggtttacccccttcggg

SEQ ID NO: 368913 - DNA, 671 bp, Homo sapiens
  misc_feature: GZ8MTXP02I2FCM.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctcgtgggttcagtcgttagtcacagctactgatcgtgggtccgcaggcctaccgaggggaaggggctgggagtgcgtctcgtagtttattatagaccgtaataactaccacctactacgacacgtacctccgtaggaacgggtcctatttcccttactcctacccgaagtaaacgacctaaattacccgaaacggtaaaccctaaccccttacttaactacctttaacaaaacgtcgtaaaacccgccctaaggacgaccggtaccgaaaggaccgaccggggtaccgtagttaacttacgtgtacgggccgggtagggggataacgtacgttaagggttcgtttacgtttacgaatttaaccgttacctttcccgttaacggcgggttaccgtaccggttcccgttacgg

SEQ ID NO: 368914 - DNA, 629 bp, Homo sapiens
  misc_feature: GZ8MTXP02IHMDN.25.37.D04.1.454.CMB.2.raw
  modified_base (356)..(356): a, c, t, g, unknown or other
  modified_base (422)..(422): a, c, t, g, unknown or other
  modified_base (528)..(528): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaagtgtccagtgtgaggtgcagctggcggagtctggaggaggcctgatccgagccgtgggggtcctgagactctctgtgcagcctgtgggttcagcgttagtcacagtctacttgactcgtcgggtccgccagggtcctaccgaaggggaaggacgtgggagtggtcgtctctaagttatttanagtaccgaataaactacccaacctactacgacacgaccttcggagaacgggccgtactacctttanccctacaagaacgacaacttcccgaaggaaacctaccctactagtccttaacgaaaatcgtaaaccgcctagacgacggcgaagactacggcttagtacttaacgnggacggcggacgggtatacgttaggttacgtttacgttacttacgttaacttaaccgtttaccgttacggtaccgggtaccggtcgttaccgttccgtacg

SEQ ID NO: 368915 - DNA, 718 bp, Homo sapiens
  misc_feature: GZ8MTXP02F3FEE.25.37.D04.1.454.CMB.2.raw
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagcgttagtcacagctactgatcgtggtccgccaggctccgaggggagggctgggagtgcgtctcgagttattatagccgataactaccacctactacgcagactccggtagaaacggggcctaatttccttaatcctaccaagtaacgaactaaattcccgaaggaacccacccttactaacttaccttacaaaaacttcggaaaacccgccccgttagaacggaacggacccggaaacgggaccgaaccggggtcccggttagttaaacgtttaccgtgggttcgggaccgggtaccggggggtaaataacgttaaaccggttaacggggtttagggtttttaaacgtttccggtttaaactttaacccgtttaaccccgtttttacccccgttaaacgggttcggggggtacccccgttaacgggggttttcccccctttaccgggg

SEQ ID NO: 368916 - DNA, 768 bp, Homo sapiens
  misc_feature: GZ8MTXP02IMJ1C.25.37.D04.1.454.CMB.2.raw
  modified_base (366)..(366): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgtctgttttaaaaggtgtccagtgtgaggtgcagctgggcggagtcgtgggaggaggcctgatccagccgtgggggtccctgagctctctgtgcagcctcgtggttcagtcgttagtcacagctacttgatcgtcgggtcccgccgaggcctaccggaggggaacggggcgtgggaggtcgacgtctcgtaagtttatttanagtaccgtaaataaacctacctaacctactacgacacgtaccgtccggtaggaaccggggtcccttaacgtttccctttaaactcccttacccgaaaggtaactaaacctaaacgtttacccccgaaaacggggtaaacccttaacccccttacgttaaaccttacctttaaacccgaaaattccgggaaaaccccgttccccgtaggggaaaccggacccgggaacccggacggaaacccggtaccgggtacccggttagttaacttacggtcgggtcggacggggacgggggtaaatacgttaacggttaagggtttacggtttaactttcgtaactttaaccgtttaaccctttcccggtacggttccgggggtaccgttaccgggtttcccgtccggg

SEQ ID NO: 368917 - DNA, 654 bp, Homo sapiens
  misc_feature: GZ8MTXP02G9VK8.25.37.D04.1.454.CMB.2.raw
  modified_base (480)..(480): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgcttagttttaaaaggtgtccagtgtgaggtgcagctggcggagtctggaggagcctgatccagccgtgggggtccctgagactctccgtgtgcacgtccttcgtaggggttcaggtcgttagtcacagtctacttgatcgtgggtcccgcagggcctccggaggggaacgggcgtggagtcgcgtctcgtatttattagagaccgtaataactacccacctacctacgacacgccgttaccgaggaacggtcccgtatttcccttataccctaccaaggaaataaccctaattacccgaaagtaacccacccttntaacttcgtaaccaaagttcgaaaccgtccctaggacgacgggacccgaagacgtaccggtcgttatacgtcgtgacggcggacggggatacttagtaggttgtttaacttccggtaaacttttaactaacccgtttcccgtaaggtccgggggaccttaccgggttcctccgg

SEQ ID NO: 368918 - DNA, 714 bp, Homo sapiens
  misc_feature: GZ8MTXP02FTFOF.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgcttagttttaaaaggtgtccagtgtgaggtgcagctggcggagtcgtgggaggaggcctgactccaggccgtgggggtccctgagactctcctgtgcacgtcctcgtgggttcagtcgttagtcacagtctacttgactcgtcggtcccgccgaggcctccggaaggggaagggctgggagtcgcgtctcgtaagtttattagagcgtaataactaccacctactacgcacgacctcggtaggaaccgggccttatttccgttatcctacccgaagaacgtaaacctaacgttacccgaaaacggaaccctaacccttactaacttacctaactaaaacgtccggaaaccgtcccgtaggaacgacggaccgaaggaccgacggtccgtttagtacttacgtggtcgacgggacgggggtaatacgttaaacggttggttacggtttaactttcggttaactttaaacccgttttacccgttttaccccggtaacggggttcccgggggttaaacccgttaccgggggttttccccgtttaacccgggg

SEQ ID NO: 368919 - DNA, 719 bp, Homo sapiens
  misc_feature: GZ8MTXP02GC4D2.25.37.D04.1.454.CMB.2.raw
  modified_base (305)..(305): a, c, t, g, unknown or other
  modified_base (605)..(605): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtatccagtgtgaggtgcagctggcggagtctggaggaggcctgatccaggccgtggggggtccctggagactctctgtgcagcctgtgggttcagtcgttagtcacagctacttgatcgtcgggtccnccgaggcctaccgaggggagggctggagtgcgtctctagtttattatagcgtaataacgtaccacctactaccgcacgacgtccgtaggaacgggcctagtttcccttaatcctacccgaaagacgaaacctaattacccgaaacggtaaaccctaccccgttacttaaactcctttaacgaaaaacgttccgaaaccggtccccgttagaacggaaccggtacccgggaaaggaacccgtaccggggtacgttacgttaagttaccgtgggttaccggggacggggtacgggggtaaanaacgtttaacggttaaggtttacgggttttaactttcgggttaaaactttaacccgtttaccctttacccgtaccgggttcgggggtacccctaacgggggtttcccttacggg

SEQ ID NO: 368920 - DNA, 735 bp, Homo sapiens
  misc_feature: GZ8MTXP02JKB7T.25.37.D04.1.454.CMB.2.raw
tcagactgtacagtcacgaccggtgctcgatttagtagcatactgttgggtttgggggggagaggagcccagcactgggattcagaggtgtttccattcggtgatcagcactgaacacagaggactcaccatggcgttttggctgagcttgggttttccttgttgctgttttaaaaggtgtccagtgtgaggtgcagctggcggagtctggaggagctgatccagccgtgggggtccctgagactctctgtgcagcctcgtgggttcagcgttagtcacagctactgatcgtgggtccacgtaggcctccggaaggggaaggggctgggagtgcgtctacgtaagtttattatacgacgaattaaactacccactaacgtacgcaagtacctccggtaaggaaccggggtcctaatttccttaactccctacccaaaggaactaactaaacgttaccaaccgggaaaacctacccccttataacttaccccggtttaaaactaaaaccgtaacggaaaccgtaccgaaggaacggaaccgaaccggaacgtaaccggtaccgggtacgttaacgttaacgttacgtacggtcgggaacggggaggggtaaacgttaaacggttaacgttaacgggttaacggttttaacgtttaaccgttaacgtttaacccgtttaccgtttaaccccggtacggggttacccggggtaacccggtttaacccgggtttacccg

SEQ ID NO: 368921 - DNA, 666 bp, Homo sapiens
  misc_feature: GZ8MTXP02GPATN.25.37.D04.1.454.CMB.2.raw
  modified_base (267)..(267): a, c, t, g, unknown or other
tcagactgtacagtcacgaccggtgctcgatttagtagcatactgttgggtttggggggagagggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtcctgagactctcctgtgcagcctcgtggtcngcgttagtcacagctacttgatcgtggtccgccaggtctaccgaggggaacggggctgggacgtgcgtctcgtagtttattagtagccgtataactactaacctactacgacagaccgtacgtaggaacggtaccgtatttaccgttatccctacagagaacacttcccgaagaacccacctacgtacttacgtacaaatcgaaaccgcccgtagacgcgacgacgacaccgggtctacggtacttacgtacgtcggacgggaccgggggataaccgtaacggtttacggtagggtttaaacgtttccggtaaacgtttaaccctttaaccgtttttaccctaccggggtttaccggggtacccggtttaaaccgggggtttcccctttaacccggggg

SEQ ID NO: 368922 - DNA, 773 bp, Homo sapiens
  misc_feature: GZ8MTXP02GHG8T.25.37.D04.1.454.CMB.2.raw
  modified_base (644)..(644): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggttgagtcttgggtttttccttgttgcttagttttaaaaggtgtccagtgtgaggtgcagctgggcggagtcgtgggaggaggcctgactccgacggccggttcggggggtccctggacgtacctcctcctgtcgcacgtccttcgttgggttcaggtcgttagtcacacgtcttacttgtactccggtcgggtcccgccgacggtccgtaccgggaaggggggacggggtcgtaggggaggttcggtccgttcgttacgtttaagttttaaagtttagtacggtacgtaaactttaaacctaacccctaaccttaacctacgacctaacgtaccgtccgtagggaaccggggtaccctaactttccttaatccctaccgaagtaaccgaactaaacttcccgaaaacgtaccctacccttctaactacgttaaacaaacgtccgaaacccgcccgagaacgccggacgaacggacccgtacggtccgttagtaattccgggngggtacggcgggtacgggtattaacgttacggttaggtttacgtttacgttacgttaacctttaaccgtttcccgtttaccggtcggggttacccgggtaccggtttaccgggtttccgtacggtaccc

SEQ ID NO: 368923 - DNA, 728 bp, Homo sapiens
  misc_feature: GZ8MTXP02JA10R.25.37.D04.1.454.CMB.2.raw
  modified_base (606)..(606): a, c, t, g, unknown or other
  modified_base (620)..(620): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgcttagttttaaaaggtgtccagtgtgaggtgcagcgtggcggagtcgtggaggaggcctgactccgaggccggtgggggtccctgacgtactctccgtgtgcacgtcctcgtagggttcagtcgttagtacacgagtactacgttacgtactcggtcgggtccccgaccgacgggtaccgtaccgggaacgggggtaacggggtcgtagggtaacggttccggtcgttaccttacgttaagtttaacgttaagtacgacgtaaactaaacctacccgtaacctacgtaccgactacggtacctaccggtaggaaccggtccgtaactttccttactcctaccgaagactaactaacttccgaaaccgtaccctaccctatactacgtaactaaacgcgaaacccgttccgagacgaccggaaccgacggtaccaccgggtntagttattaccggnggacggacggacggtatacgttaaggttcgtttacgttaacttaccgttaaacctttaaccgtttaccgttaccggtacgggtccggtaccgtttaccgggttcctcg

SEQ ID NO: 368924 - DNA, 728 bp, Homo sapiens
  misc_feature: GZ8MTXP02HU808.25.37.D04.1.454.CMB.2.raw
  modified_base (310)..(310): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgtcttgttttaaaaggtgtccagtgtgaggtgcagctggcggagtcgtgggaggaggcctgactccgagccgtgggggtccctgagactctcctgtgcagcctcgtgggttcagtcgttagtcacagctactgactcgtcggtccnccgacggccgtaccggaggggaaggggcgtagggagtcggcgtctacgtaagtttattaagtagaccgtaataaacctacctaacctaacgtaccgacgtacggtaccgtacggtacggaaaccggggtaccctacgtttacctttacgccttaaccgaagtaccgaaacttaaacgttacccgaaacgggtaaacccctaccccttacttaacttaccttaaacgaaaacgttccgaacccgtaccccgtaaggaaccgaccgggacccgaaacggaaccgtaccgggtaccgttagttaacttacgtggtacggcgggtaaggggactaacgttacgttaggttacgtttactttacgtactttaaccgttacctttaccgacgggttccggtacccgtacgggtttccctccggg

SEQ ID NO: 368925 - DNA, 587 bp, Homo sapiens
  misc_feature: GZ8MTXP02I8NTV.25.37.D04.1.454.CMB.2.raw
  modified_base (255)..(255): a, c, t, g, unknown or other
  modified_base (302)..(302): a, c, t, g, unknown or other
  modified_base (349)..(349): a, c, t, g, unknown or other
  modified_base (446)..(446): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtncagcctcgtggttcagcgttagtcacagctacttgatctcgggtccncaggcctcgaggggaagggctggagtgcgtctcgtaagtttattaanagaccgaataactacccaacctactaacgcagtaccttccggaggaacgggcctattcctatccgccaagactacaattcccgaaagacccaccctntatacttacaaaagtcgaaacgccctggaacgacggacgaacggacttacgggaccttagtaattcgtgagcggacgggagactatagtacgttacgttagtataacttacttacctacgtcggtcgtacggtcgttccgg

SEQ ID NO: 368926 - DNA, 715 bp, Homo sapiens
  misc_feature: GZ8MTXP02G3MDF.25.37.D04.1.454.CMB.2.raw
  modified_base (203)..(203): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgtctccgaggggaanagccacctctcctgcagggccagtcaggagttgttatcgagtacttacgcctacggtaaccaacgaacgaaccgtggaccacggccctacccgacggtcctccctacacttctagtgtatcgactaactaccggaaggaccgggacccaggtacggcctaaccgtcccgagtacccggtaggtacgaggtcgggaccgtaggggttcggggcgtagggacgtagtaccgtttcaccgttccaccacctatcgacgctacgttcgacggacgtacctaggtaaacgtttcgtttaagtacgtttaagttttacttacgttacgtaccgtaagtacggtagtacccgggtaagtccgttacggggttacccgggtcccgggtttaacggggttactttacgggggtttccggaccgggggtaaacggggtaccgtagggtcggtacggggaaataaacggttaaccgaaacggtacgttggtcggtactcgacgtactcgtttcgtctttaccg

SEQ ID NO: 368927 - DNA, 703 bp, Homo sapiens
  misc_feature: GZ8MTXP02GCWAG.25.37.D04.1.454.CMB.2.raw
  modified_base (284)..(284): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgcttgttttaaaaggtgtccagtgtgaggtgcagctggcggagtcgtggaggaggcctgatccagccgtgggggtcctgagactctcctgtgcacgcctcgtggttcagcgttagtcacngtctacttgactcgtcgggtccgaccgaggtcctaccggaaggggaaggggtcgtaggggtaggtcggtccgtcgttacgttaagtttaagtttagtagaccgtaaaattaaaccgtaaccctaaccttaacgtaaccgacgtacgaccgtaccggtaggaaacgggtccgtaactttaccttactacctaccgtaaaggaactaaactaaacttacccgaaacggaaccctaaccctacttaacttacttaacaaagttaccgaaaccgcccttaagacggaacgccgaacggacgacggtccgtagtactacgtgtcgaccgggtagggataacgtagttaacgttacgtttaacgttcgtaaacgtttaaccttaccgtttaccgtacggtcggtaccgtacgggttccgtaccgg

SEQ ID NO: 368928 - DNA, 687 bp, Homo sapiens
  misc_feature: GZ8MTXP02J29XW.25.37.D04.1.454.CMB.2.raw
  modified_base (327)..(327): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccaggccgtggggggtccctgacgactctcctgtgcagcctcgtgggttcagtcgttagtcacagctactgattcgtgggtccgccagggctccgaggggagggcnggagtgcgttctgagtttattataggccaataactacccaacgtactaccgcagaccttcccggtagacggggcctatttaccttatcctaccagacgtactaaacgttcccaaggtaacccaccccttactaacttacgttactaaaacgtacgaaaccggcccgtaggacgacggaccggtaaacgggacccgtaaccggggcccgttaggttaacgtttaccgtacggggtcgggaccgggacgggggtaatacgttaacggttacggttacgtttaacgtttaccgttaactttaacccgttacccgtttaccccgtacggttaccggggtacccgttaccgggtttccccgtcgg

SEQ ID NO: 368929 - DNA, 663 bp, Homo sapiens
  misc_feature: GZ8MTXP02FJQ0L.25.37.D04.1.454.CMB.2.raw
  modified_base (301)..(301): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagcgttagtcacagctacttgatctgggtccnccaggcctccgaggggaagggctggagtgcgtctctagttatttatagccgaataataccacctaactacgcagacctccgtaggaacgggcccgtaatttcccttaatcctacccgaagaacgtaaactaacttacccgaaaggaaaccccacccttacttaactaccgtttaaccaaaaagttcgaaaaccgtccccgtagaacgacggacccgaacggaccacgggtccgttagtaacttaaccgttggcgacgggcgggggaatacgtaacgttaggttggtttaactttcggtaatttaacccgttaccttttacccgaacggtcgggggtaccctacgggggtttccccttacggg

SEQ ID NO: 368930 - DNA, 659 bp, Homo sapiens
  misc_feature: GZ8MTXP02GT8WS.25.37.D04.1.454.CMB.2.raw
  modified_base (418)..(418): a, c, t, g, unknown or other
  modified_base (547)..(547): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagtcgttagtcacagctacttgactcgtgggtccgccgaggctccgaggggaaggggctgggaggtgcgtctacgtagtttatttagtagaccgtaataactaacctacctaactacgacacgacgtccgtgaacgggcctattccttanccttaccagaacgaactacttaccgaacggaacctaccccttacttaactacctttaacaaaacgttcggaaaacccgccccgttagacggacgccggaaggacccgacggtccgttagtactttacgnggtcggacgggtacgggatacgttacggttaggtttacgtttaactttcgttaactttaaccgttaccgtttaccgtacgggtccgggtaccggttccgggtttaccgtcgg

SEQ ID NO: 368931 - DNA, 603 bp, Homo sapiens
  misc_feature: GZ8MTXP02JZH4C.25.37.D04.1.454.CMB.2.raw
  modified_base (256)..(256): a, c, t, g, unknown or other
  modified_base (436)..(436): a, c, t, g, unknown or other
  modified_base (515)..(515): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcttgggttttccttgttgcttgttttaaaaggtgtccagtgtgaggtgcagctggcggagtctggaggaggcctgatccagccgtgggggtccctgagctctcctgtgcngcctcgtgggttcagtcgttagtcacagctacttgatcgtgggtccgccaggctccgaggggaggggctggagtgcgtctcagtttattagtagccgtaataactacccacctactacgcacgacctcccggtagaacggggcctatttccttatcctacagagacaattcccagaaccnccctactatcttacaaatcgaacgccctagagacgccgagaccgacggtccgtagtattacgtggtgcggacggggganacgttacgtaggttacggttatttaccggtaatttaaccgttaccttttcccgtacggttcggggtcccgtacggggtttccctcggg

SEQ ID NO: 368932 - DNA, 735 bp, Homo sapiens
  misc_feature: GZ8MTXP02GY9L2.25.37.D04.1.454.CMB.2.raw
  modified_base (275)..(275): a, c, t, g, unknown or other
  modified_base (299)..(299): a, c, t, g, unknown or other
  modified_base (302)..(302): a, c, t, g, unknown or other
tcagactgtacagtcacgaccggtgctcgatttagtagcatactgttgggtttgggggagaggagcccagcactgggattccgaggtgtttccattcggtgatcagcactgaacacagaggactcaccatggcgttttggctgagctgggttttccttgttgcttgttttaaaaggtgtccagtgtgaggtgcagctggcggagtctggaggagcctgatccagccgtgggggtcctgagactctcctgtgcacgcctcgtggttcagtcgttancacagtctattgatcgtcggtccncgnggcctaccggaggggaggggcgtggacgtggcgtctacgtagtttaattagtagaccgtaataactaccgactacgtacgacacgtactaccggtaggaacgggtaccgttactttaccgttaactcccgtaacgaaaggaactaaacctaaacttacccgaaacggaaaccctacccttacttaacctactttaaccaaaagttacgaaaaccccggtcccgtaaggaacgggaccgggtacccggaaaacgggacccgtacggggtaacccgttagttaacttaccggtgggccgggacgggtacgggggtaataaacggtttacgttaagggtttacgggtttaaactttaccggttaaatttaaccccgttaaccgtttcccgttacggggtccggggtaacccgttcggggtttccccctttaacggg

SEQ ID NO: 368933 - DNA, 643 bp, Homo sapiens
  misc_feature: GZ8MTXP02FMEEZ.25.37.D04.1.454.CMB.2.raw
  modified_base (306)..(306): a, c, t, g, unknown or other
  modified_base (384)..(384): a, c, t, g, unknown or other
  modified_base (413)..(413): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgcttgttttaaaaggtgtccagtgtgaggtgcagctggcggagtcgtgggaggaggcctgatccaggccgtggggggtccctgagactctcctgtgcagcctctgggttcagcgttagtcacagctacttgatcgtgggtcccnccaggcctccgaggggtaaggggctgggagtgccgtctctagtttattatagccgtaataactaccacctactacgcngactccgtagaacgggcctagttccttanctccaagacgtacaattccaagaccaccctctatcttacaaatcgaaacctccctagacggacgacccgtaaggaccgaccggtccgtaggtattaacggtggtcgggaccggacgggggtataacgttaccgttaaggtttacgggtttaaactttcggtaaacttaacctttaaccgtttcccgttaacgggtcgggggtaccctaacgggggttttccccgtacggg

SEQ ID NO: 368934 - DNA, 610 bp, Homo sapiens
  misc_feature: GZ8MTXP02FK8SS.25.37.D04.1.454.CMB.2.raw
  modified_base (349)..(349): a, c, t, g, unknown or other
  modified_base (405)..(405): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgctgttttaaaaggtgtccagtgtgaggtgcagctggcggagtcgtggaggaggcctgatccagccgtgggggtccctgagactctcctgtgcagcctctggggttcagcgttagcacagcttactgatcgtgggtccgcaggctccgaggggaaggggctgggagtgcgtctctagttatttanagcgataacaccactacacgcagcctcgtgaaacggcctattcctatcctccaganaactattcccgaagaacccacctctatacttacaaaatcgaaaccgccctggacgacggaccgacgggaccacgggtccgtagttacgtacgtggtcggacgggtacgggggaatacgtacgttaaggttgggtttaacttcggtaactttaaccgttacctttacccgtacggtcgggggtaccctacgggggtttccctcggg

SEQ ID NO: 368935 - DNA, 626 bp, Homo sapiens
  misc_feature: GZ8MTXP02HXKR5.25.37.D04.1.454.CMB.2.raw
  modified_base (342)..(342): a, c, t, g, unknown or other
  modified_base (378)..(378): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtcgtggaggaggcctgatccagccgtgggggtccctgagactctcctgtgcacgcctcgtgggttcaggtcgttagcacagtctactgacgtcgtcgggtccgccgaggcctcggaggggaggctggagtgcgtctntagtttatatagactataactaccactactacgacncgtacgtcggagacgggtaccgtactttcctatcctacagacgaactaacgttcccgaacgaacctcccttactaacttacctaacaaagtccgaaccgcccgtagacgacggaccgacggacgaccggtccgtattacgtacgtgcggcgggacgggtaatacgtacgttaaggttcggtttaacttacgttaactttaaccgtcccgttttaccgacggtcgggtaccgttacgggttcccgtcgg

SEQ ID NO: 368936 - DNA, 734 bp, Homo sapiens
  misc_feature: GZ8MTXP02FQ98E.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcacgtcctcgtgggttcagtcgttagtcacagctacttgagtcgtcgggtccgccaggccgtaccggaggggaacggggcgtgggaggtgccgtcgtctagtttatttaacgtagaccgtataaacctaccctaacctactaacgcacgaccgttccggtaggaacggtccgttaactttccctttactcctaccgaagaacgaaactaaacttacccgaacggaaaccctaaccccttacttacttaccttaacaaaacgttacgaaaccgcccctaggaacggaacgaccggaacggaacccgaacgggtacccggttaggttaacgttacgtagggtacggaccgggtaccgggggaagtaacgttacggttaaggtttacggttttactttacgttaactttaaccgtttacccgttttacccccgttacggttaccgggggtacccgttaaccggggtttcccgtttaacccggg

SEQ ID NO: 368937 - DNA, 693 bp, Homo sapiens
  misc_feature: GZ8MTXP02I26KA.25.37.D04.1.454.CMB.2.raw
  modified_base (209)..(209): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagaccacccttgtctttgtcctaccgaaggggaaancgcccacccttctcctgcagggccagtcagtagttgttatcgaggttactagcctaggaaccaacagaaacctggccaggctcccgagcctctcagtctatgatgactataccgaaaggtccggcctacgtggaccacctccccgagtcctagggttcaggtccgggacgtaggggtcggggacgttaggggacctagggtcgtttccacttcctacccgacctatcgagcctacggttccgtaggacgtaccgttagtaaagtttcgttttacgtcgttttaaagtttacttacgttacgttacgaggttccgagtaccggtgtaccgtaggttcgggtccggttacggggtaacgttcgggtttcggaccggtacggggtaaccaggtcggtacggtaaacggaacttaaaccgaaaacggttaccgttaggggaaccgtcgttaccggaaccctactacggttacctttcggtttaacccg

SEQ ID NO: 368938 - DNA, 722 bp, Homo sapiens
  misc_feature: GZ8MTXP02JRAZ8.25.37.D04.1.454.CMB.2.raw
  modified_base (271)..(271): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggtcgttttggctgagcttgggttttccttgttgtcttagttttaaaaggtgtccagtgtgaggtgcagcgtggcggagtcgtgggaggaggcctgactccgaggccggtcgggggtccctgacgactctccgtgtcgcncgcctgtggtcagtcgttagcacacgtcttacgttgtacgtcgtcggtccgccgacggtccgtaccggaggggaggggtcgtgggagtcggtccgtctcgttaagtttaattagtacgaccgtaactaaactaccctacctacacgacgtcgtaccgtcggtacggaccgggtccgttaactttcccttaactccgtaccgaaagaaccgtaactaaaccgttacccgaaagtaccccctaacccttacttaacttaccttaacgaaaacgtccgtaaacccggtcccgtaggaacggaccggaaccgggacgaaccgtccgggtacgttagttaacgttcgtcgggacgggacggggtagggtactagttacggttaggtttacgttacgtttactaactttaaccgttacctttccggacggtccggggtccttaccggggttcctcgg

SEQ ID NO: 368939 - DNA, 638 bp, Homo sapiens
  misc_feature: GZ8MTXP02FE9N9.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgcttgttttaaaaggtgtccagtgtgaggtgcagctggcggagtctggaggaggcctgatccagccgtgggggtccctgagactctcctgtgcagcctctgggttcagcgttagcacagctacttgatcgtggggtcccgccagggcctccgaggggaaggggctgggagtgcgtctctagttatttatagaccgtataacaccacctacacgcagacctccgtagaacgggcctatttccctatcctaccagaacgacaattcccgaagaaccaccctactataccgttacaaaatcgaaaccgtcccctaggaacgacggccggaacggtaccgaccgggtcccgttgtaactttacgtggtacggcgggtacgggggaataacttacggttaaggttgggttttaacttacgtaatttaacccgtaccttttacccgacggtcgggggtaccctacgggggtttccctacgg

SEQ ID NO: 368940 - DNA, 663 bp, Homo sapiens
  misc_feature: GZ8MTXP02GA2R3.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttggggttttccttgttgcttagttttaaaaggtgtccagtgtgaggtgcagctggcggagtcgtgggaggaggcctgatccagccgtgggggtccctgagactctcctgtgcagtcctcgtgggttcagtcgttagtcacagctacttgatcgtcggtccgcaggctccggaggggaagggctggagtgcgtcttacgtagttattagagaccgtaataactacccaacctactaaccgcacgacgtaccgagggaaacggccgtactttccttatcctaccagaacacaattaccaacgaacctacctctaactacgttacaaaagtcgaaaccgcctagagacgaccgaagcgacgtccggtattacgttacgtggtcggacgggacggggtaataacgttacgttaaagggttacgttttaagtttccgttaaactttaacccgttttaacccgtttacccggttaacgggtccggggttaacccgttcggggttccccgtttaaccgggg

SEQ ID NO: 368941 - DNA, 691 bp, Homo sapiens
  misc_feature: GZ8MTXP02FURAE.25.37.D04.1.454.CMB.2.raw
  modified_base (257)..(257): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccaatgtgaggtgcaactggtggagtcgtgggggaggcttggtacagccaggcccggtccctgacactctcctgcacngcttcccggactctacctttggtgagcatgctatcgacctgggtcccgcaggcctccgagggtaggtctgtagtggtctttgggttcagttagaagcgaacgtctagtggggtcgggacaaacgacaaacgttcgcccgtacgtactaaagggtaaaacgcaaggtactttacgacgtacccttactaccgaaaaggagtaagttaacggtaaactttaaacccgaaaaaacgtccaaacgttcccgtacccttacttaccgtcgacctaacgagtagacgacacgtaccgtaggaacgaacgacggaacgtaccgtacgtacggtacccgttagtttaactttaaccgtttcgtttaaccttttaacttaaccgtttacggttaaggtaacggtaacggttttacggtttaacggttttaatttttaaaaccg

SEQ ID NO: 368942 - DNA, 651 bp, Homo sapiens
  misc_feature: GZ8MTXP02FWXFI.25.37.D04.1.454.CMB.2.raw
  modified_base (559)..(559): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgcttagttttaaaaggtgtccagtgtgaggtgcagctggcggagtcgtggaggaggcctgatccaggccgtcgggggtccctgagactctcctgtgcagcctcgtggttcagtcgttagtcacagtctacttgactcgtcgggtccccgccgacggcctaccggaggggaaggggcgtggggagtcgccgttctcgtagtttattagtagaccgtaataactaaccacctactacgacacgtacctcggtaggaacgggccgttatttacccgttactcctaccgaagacgtaaactacgttacccaacggaccctaccctacgttatacctacaaactcgaacctcccgtagacgaacggaccgaacggaccgacgggtccgttagtaattcgngtacgggcggtacggggatagtacgttaggttacgttattccgtaatttaaccgtcctttccgtacgtcggggccttacgggttcccttcgg

SEQ ID NO: 368943 - DNA, 598 bp, Homo sapiens
  misc_feature: GZ8MTXP02HYDUD.25.37.D04.1.454.CMB.2.raw
  modified_base (281)..(281): a, c, t, g, unknown or other
  modified_base (512)..(512): a, c, t, g, unknown or other
  modified_base (519)..(519): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctctgggttcagcgttagtcacngtctacttgatcgtggtccgccagggctccgaggggaaggggctaggggagtgtcgtctcgtagtttatttatagccgataactaccactactacgcagactcgtagaaggggccactttcctatccgtccaagacgtacaacttcccaggaacctaccctctatacttacaaatcgaaaccggccctagacgacgccgaacgacgacggccgtgtaattcgagtcgcggnggggganacgtacgtagtggttaactttcggaacttaacttaccttacccgttacggtacggggtcctacggggtttccccgtcgg

SEQ ID NO: 368944 - DNA, 748 bp, Homo sapiens
  misc_feature: GZ8MTXP02HUX23.25.37.D04.1.454.CMB.2.raw
  modified_base (207)..(207): a, c, t, g, unknown or other
  modified_base (219)..(219): a, c, t, g, unknown or other
  modified_base (322)..(322): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgttctttgtctccgaagggggaaanacgccacccttntcctgcgagggccagtcagagttgttatcgaggtacttagccgtaggtaaccaacacgaaacctggaccacggcctccgaggcccttccactatctagtgtangtacctatacccgaaaggaccgggcctaaccggttcggacctaaccgtcccgaaggtccccgttaacgggttccgaaggtcccggtccgggtaaggggtttcgggggacgtttacggggaaccgtaaggttaccggttacctaaacccttccgtaaccttacccagttacccaggtaccgttacgtccgtggggaaactccggttaaagttacgttattttcggtacttaggttttaactcgtcgttacaggcttaagcggtacgtacgtggttccggccggtttaccggggtagtttaccgggtttcgggaaccggttaacggggaccgttaaacggtggttaaaccggaagttaccgaaacggtaaaccgttacgtgggttaacgcggtacgtacctaacggtactttcggtaacttttccccg

SEQ ID NO: 368945 - DNA, 616 bp, Homo sapiens
  misc_feature: GZ8MTXP02IKIU0.25.37.D04.1.454.CMB.2.raw
  modified_base (481)..(481): a, c, t, g, unknown or other
  modified_base (516)..(516): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgcttagttttaaaaggtgtccagtgtgaggtgcagcgtggcggagtcgtgggaggaggcctgatccagccgtgggggtccctgagctctcctgtcgcacgcctcgtgggtcagtcgttagtcacagtctacgtgacttcgtcgggtcccgcgacgggctaccggaaggggaacggggccggtagcgcgtctactagtttattagagcgtaactaaactaccacctactacgcagctcgtagacggcctactttcctaatctaccaagacgaaactaactcgaacgaacctcctatacgtactacaaattcggaaccncctagacgacgacggacgacgtacgcgtgtactgnggtcgacggacggtatacgttcgtaaggttcgtttacttacgttaacttaccgttaaccgttccgtacgggtcggtccggttacggttccgtacgtcccg

SEQ ID NO: 368946 - DNA, 776 bp, Homo sapiens
  misc_feature: GZ8MTXP02JZFWD.25.37.D04.1.454.CMB.2.raw
  modified_base (257)..(257): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgcttgttttaaaaggtgtccagtgtgaggtgcagctggcggagtcgtggaggaggcctgatccgagccgtgggggtccctgagactctctgtgcngcctcgtggttcagtcgttagtcacgagtctacttgactcgtcgggtcccgccacgggtcctaccggaagggggaacggggtcgtaggggacgtcggtcgtctacgtaaggtttatttacgtacgaccgtaataaacctacccaaccttacgtacgaccaggtaccctaccgggtaggaaaccggggtcccgtaactttacccttcgtacccgttacccaaaggaaccgtaaacctaaacgtttacccgaaacggtaacccctaaccccttacttaattacccttaacgaaacgttacgaaacccgcccgtaaggacgaacgggacccggaacgaccggaccggtacccgttagttaaccgttcgtcgggtcggacccggggagggggtaaacctaggtttaaaccgttacgggtttaaggtttaacgttttacccggtaacttttaacccgtttaccgtttaacccccgtacggttacccgggggtaccctttaacgggggttccccctttaccgggg

SEQ ID NO: 368947 - DNA, 629 bp, Homo sapiens
  misc_feature: GZ8MTXP02GSP9B.25.37.D04.1.454.CMB.2.raw
  modified_base (256)..(256): a, c, t, g, unknown or other
  modified_base (309)..(309): a, c, t, g, unknown or other
  modified_base (396)..(396): a, c, t, g, unknown or other
  modified_base (438)..(438): a, c, t, g, unknown or other
  modified_base (532)..(532): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaagtgtccagtgtgaggtgcagctggcggagtcgtggaggaggcctgatccagccgtcgggggtcctgagactctcctgtgcngtcctcgtgggttcagtcgttagtcacagtctattgagtcgtggtcccgccgnggccgtaccggaaggggtaaggggcgtagggagtggtcgtctcgtagtttattactagccgtaataactacctacctaactacgacncgacctcgtaggacggccgtattccttaatcctacaaggtanaactaacttcccgaaaggacctaccctactaacttctaacaaattcgaaaccgtcccagacgcgaccgacgaccgtacggcgtagttattacgnggtacgcggaggggataagtcgttaagttcgggttattaacgtactttaacttacctttccgttacggcgggggtaccttacggggttacctccggg

SEQ ID NO: 368948 - DNA, 721 bp, Homo sapiens
  misc_feature: GZ8MTXP02FQKF1.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgctagttttaaaaggtgtccagtgtgaggtgcagctggcggagtctggaggaggcctgatccagccgtgggggtccctgagactctcctgtcgcacgcctcgtgggttcagcgttagtcacagtctacttgatcgtcgggtcccgaccgaggcctaccggaagggggtaaggggctgggagtgtccgtctacgtagtttatttagtagaccgtaataactaccacctaactaccgctagacctcggtagaacgggtcctatttcctatcctacaagactaactacttacccgaacggaaccctacctactaacttccttaacgaaaacttccggaaaccgtcccgtagaacggacgacccgggaacggaccgtacgggtccgttagtaacgtttaccgtgggtacggcgggacgggggaaagttaccgttaacggtttaacggtttgggttttaaactttacggttaaaccgttttaacccgtttaaacccgttttccccggtaaacggggtttcccggggtacccggtttacccgggggtttaccccttcccgggg

SEQ ID NO: 368949 - DNA, 654 bp, Homo sapiens
  misc_feature: GZ8MTXP02I9BLF.25.37.D04.1.454.CMB.2.raw
  modified_base (281)..(281): a, c, t, g, unknown or other
  modified_base (308)..(308): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgtttaaaaggtgtccagtgtgaggtgcagctggcggagtctggaggagcctgatccagccgtgggggtcctgagactctcctgtgcagcctcgtgggttcaggtcgtagtcaacngtctacttgatccgtgggtcccaccgngggcctccggaggggaaaggggcgtaggggagtcggtccgtcttcgtaaaggttttattaagtacgacgtaaataaacctaccaccttaactaccgcacgtacctaccggtaggaaccggggtccgtaactttacccttactaccgttacccgaagtacaacgtaaacttacccgacggaaaccctcccctacttaactacctacgtaaacttcgaaccgcccgtagacggacgaccggagaccgacggccgtagtactacgtgacggtcggtacggggatacctagtagttcggttattacgtattaaccgttacttacctacggcggtacgtcggtccgtacgg

SEQ ID NO: 368950 - DNA, 633 bp, Homo sapiens
  misc_feature: GZ8MTXP02I9SHP.25.37.D04.1.454.CMB.2.raw
  modified_base (297)..(297): a, c, t, g, unknown or other
  modified_base (317)..(317): a, c, t, g, unknown or other
  modified_base (432)..(432): a, c, t, g, unknown or other
  modified_base (525)..(525): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgcttagttttaaaaggtgtccagtgtgaggtgcagctggcggagtcgtggaggaggcctgatccgaggtcccggtggggggtccctggacgtacctctcctgtcgcagcctcgtgggttccagtcgttagtcanagctactgatcgtcggtccncaggctccgaggggaaggctggacgtgcgtctcgtagttattagagccgtaataactaccaacctactacggctacgacctccgagaacgggctacttccgtatcaccaggaacnctaactccgaacgaccctacctactactacttaacgaaacgtcgaaccgtccgagacgacgaccggacgtaaccgacggtcgtagttatacgngacggacgggacgggatacgtacgttaggttacggtttacttacgttaacttaaccgtttaccgtttacccgtacggggttccggtacccggttacggttcccgtcgg

SEQ ID NO: 368951 - DNA, 598 bp, Homo sapiens
  misc_feature: GZ8MTXP02F6VC2.25.37.D04.1.454.CMB.2.raw
  modified_base (504)..(504): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctcgtggggttcagtcgttagtcacagctacttgatcgtcgggtccgcgaggcctaccggaggggaacggggctgggagtgcgtctcgtagtttattatagccgtataactaccacctactacgcacgacctcggtagacgggcctattccttatcctacagacaactattccgaagacctacctctactcttacaaatcgaaaccgccctagacgacgccgaggacacggtcgtagtacttcgngtcggcgggacggggatacgttacgtagttcggttacttcgtaacttaacgttcctttaccgtacggtcggggtacctacggggttccctacgg

SEQ ID NO: 368952 - DNA, 729 bp, Homo sapiens
  misc_feature: GZ8MTXP02IZMZX.25.37.D04.1.454.CMB.2.raw
  modified_base (291)..(291): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagtcttgggttttccttgttgcttagttttaaaaggtgtccagtgtgaggtgcagctggcggagtcgtggaggaggcctgatccgaggccgtcgggggtcctgacgactctctgtcgcagtcctcgtgggtcagtcgttagtcacngtcttactgactcgtcggtccgcaggcctacggaggggaacgggcgtagggagtgccgttctacgtagtttattagtacgacgtaataacctaccctaacctactaccggacacgtaccgttaccggtagggaaaccgggtcccgttaatttcccttaactcccgtaccgaaagtaacgtaaccttaacgttacccgaaacggtaacccctacccttacttaactacttaaactaaaacgtcggtaaaacccgtcccgtaagacggaaccggaccggaaacgggtaccaccggggtacttacggttaacttacggtcggtacggggaccgggagggggaactaacgttacggttaggttacggtttactttaccgtaactttaaccttacccgttaccgttacgggtaccggggtaccgttacggggtttccctacgg

SEQ ID NO: 368953 - DNA, 656 bp, Homo sapiens
  misc_feature: GZ8MTXP02G78E6.25.37.D04.1.454.CMB.2.raw
  modified_base (272)..(272): a, c, t, g, unknown or other
  modified_base (362)..(362): a, c, t, g, unknown or other
  modified_base (427)..(427): a, c, t, g, unknown or other
  modified_base (509)..(509): a, c, t, g, unknown or other
  modified_base (571)..(571): a, c, t, g, unknown or other
  modified_base (588)..(588): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggtcgttttggctgagtcgttgggttttccttgttgtcttagttttaaaaggtgtcagtgtgaggtgcagcgtggcggtagtcgtggacggaggcctgactccgagtccggtcgggggtccctggacgtactctcctgtncagtcctgtggttcagtcgttacgtcacagtctacgttgactcggtcggtccgcgacggccgtaccggaaggggtaacggggcgtagggngtcgtccgttactacgtaagtttattaagtacgaacgttaactaacctaccctacctactaccgngtaccgtccgtcggtacggaacggtctactttacctactcctaccgaagacaactaaacgtaccgaacgtaacccctacctntaaacttctaaacaaactcgaaacgtcctagacgacgacgacgacgacgtctaggtatacgngtacggcggacgggtanacgtagttggttacgttacttctaacgttccttcgttaccgtacggtcggtaccgtacggttctaccg

SEQ ID NO: 368954 - DNA, 752 bp, Homo sapiens
  misc_feature: GZ8MTXP02GPAZZ.25.37.D04.1.454.CMB.2.raw
  modified_base (296)..(296): a, c, t, g, unknown or other
  modified_base (474)..(474): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagcttgggttttccttgttgtcttagttttaaaaggtgtccagtgtgaggtgcagcgtggcggagtcgtggaggaggcctgactccaggccggtgggggtccctgacgtactctcctgtgcacgtcctgtgggttcaggtcgttagcaacngcttactgtactcgtcgggtcccgccgacggccgtaccggaggggaacggggtcgtaggggtagtcgtcgtcctacgttaagtttaatttagtacgtaccgtaaattaacctacctaacctaacgtaaccgactacgaccgtcggtacgggaaaccgggtcctactttaccgtttacncccgtacaaaggtaacaacctaaagttccccaaaaggaccccttaccttacgtaacttaccgttaacaaacgtacgaaaccgtcccgtaagacgggacgaccggaaacggaccgtacgggtccgtttagttattaccgggtgtacggcggggtaaacgggagttacttaaacggttaggtttacggtttaactttacggttaactttaaaccgtttacccgttttaccccggagggttacccgggggtacctttaaccgggggtttcccctttcgggg

SEQ ID NO: 368955 - DNA, 750 bp, Homo sapiens
  misc_feature: GZ8MTXP02GDS90.25.37.D04.1.454.CMB.2.raw
  modified_base (545)..(545): a, c, t, g, unknown or other
tcagactgtacagtcacgaccggtgctcgatttagtagcatactgttgggtttggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtcgtggaggaggcctgatccagccgtgggggtcctgagctctctgtgcagcctcgtgggttccagtcgttagcactagcttattgagttccgtcggggtcccgccgaagggtccgttacccggaagggggtaacggggtctaggggtaacggtggtccgttcttcgttaaaggtttatttaacgtaggacctaattaaacctaacccaacccttacgtaccggacacgtaaccgtccgggttaggaaacggggtccctacgtttacctaacgtcctaccgaaagaacgtaacctaaacgttacccgaaacgtaacccttaccctacttaacttacccgttaanaaaacgtcggaaaccgtacccgtgaacggaccggccgggaaaacgacccggtaccgggtacccgttagttagtttacccggaggtacggtaccgggggaccggggtaagttaacgtaaccgttaggttacgggtttacttaggtaaccttaacctttaccgttttacccgagggtccgggtaccctacggggtttcccgtaccgg

SEQ ID NO: 368956 - DNA, 728 bp, Homo sapiens
  misc_feature: GZ8MTXP02GDAM0.25.37.D04.1.454.CMB.2.raw
  modified_base (206)..(206): a, c, t, g, unknown or other
  modified_base (312)..(312): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagtttgtgttgacacagtctccagaccaccctgtctttgtctccgaaggggaanagccaccctctcctgcagggccagtcagagtgttatcgaggttacttagcctaggtaccaacgacgaaacctggccaggcctacccgaggcctcctcactcgtaangatgctagtaccaaggacggccacgtcggacactccccgagaccgtaggttaccaggtccggggactaggggtggggacctggggaacctaggtacgttccaacgtttcaccaacctataccgagaccgtaggttcccgtaggggtaccgccggttagtaaacgttagtttttcgacgtttaaggtttttaaacttcgttagttaccgagttaccgtaggtacgtaacggtcgttaacgggtttccgggtcccggtttaccgggggttaacgtttacgggttttccggggaaccggttaaaccgggggaacccgtaaggtacggttacggtaaacgaaacgtttaaaccggaaaacggtaacgtgggtaaccgggtctacggtacccaaccgttagttcccgttaggttttacccc

SEQ ID NO: 368957 - DNA, 711 bp, Homo sapiens
  misc_feature: GZ8MTXP02FJTXL.25.37.D04.1.454.CMB.2.raw
  modified_base (265)..(265): a, c, t, g, unknown or other
  modified_base (280)..(280): a, c, t, g, unknown or other
  modified_base (290)..(290): a, c, t, g, unknown or other
  modified_base (293)..(293): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctccagatagcaccggagaagttgtgttgacacagtctccagacaccctgttctttgtctccgaaggggaaagagcccaccctctcctgcagggccagtcagagtgttatcaggtacttagcctggtaaccanaagaactggccagcncagaggctcnatnatgatgcactccgaaggacggccacgtgggaccacgtccccaagccgtacggggtttacagggttacgggccggtaggggtcgggggtacgttacgggggactacgggtacgttccaaccgtttcctacaccctagtcgaacgacgtacggttcgtacgggagtaccgttaagacgtttaagtttttggtacttaagtttttaaacgttacgtttggtaaccgtaggtcaacgggttacgggttaacgacccggttaaggggtttcccggggtacccgggttacccgggggttaagtttacgggttttacgggggacccgggttaaacggggaaccgtaagggtaccggtaagggaacggtaacgtaaacggaaaacgtacggtaacggtacggtacgcggaccttacgcgttctacg

SEQ ID NO: 368958 - DNA, 687 bp, Homo sapiens
  misc_feature: GZ8MTXP02GKDAF.25.37.D04.1.454.CMB.2.raw
  modified_base (266)..(266): a, c, t, g, unknown or other
  modified_base (291)..(291): a, c, t, g, unknown or other
  modified_base (308)..(308): a, c, t, g, unknown or other
  modified_base (336)..(336): a, c, t, g, unknown or other
  modified_base (451)..(451): a, c, t, g, unknown or other
tcagactgtacagtcacgaccggtgctcgatttagtagcatactgttggggtttgggggggagaggagcccagcactgggattccgaggtgtttccattcggtgatcagcactgaacacagaggactcaccatggcgttttggctgagcttgggttttccttgttgcttagttttaaaaggtgtccagtgtgaggtgcagctggcggagtcgtgggaggaggcctgactccaggccgtggggggtccctgacgactctcctgtgcngtcctgtgggttcagcgttagcacngctatgatcgtggtccncaggctcgaggggaggctggagtgcgtntctagttattatagaccgtataactaccacctacgtacgcacgtactccggtagacgggtcctactttccttatcctacgaagtacgtaacaacttccgaacgaaccctaccctnttaacgtacttaactaaaactcggaacccgtacccgtagacgaacggccccggaaagggaccccttacgggccgttagttaacgtacgttgggacggcggggacgggggtaaataccttaacgggttaggtttacggttttaaactttccggaaactttttaacccgtttaacccgttttccccgtaaacggtccgggggttacccgtttaacgggggtttccccctttaacgggg

SEQ ID NO: 368959 - DNA, 854 bp, Homo sapiens
  misc_feature: GZ8MTXP02IWCI1.25.37.D04.1.454.CMB.2.raw
  modified_base (397)..(397): a, c, t, g, unknown or other
  modified_base (577)..(577): a, c, t, g, unknown or other
tcagactgtacagtcacgaccggtgctcgatttagtagcatactgttgggtttggggagaggagcccagcactgggattccgaggtgtttccattcggtgatcagcactgaacacagaggactcaccatggtcgttttggctgagcttgggttttccttgttgtcttagttttaaaaggtgtcagtgtgaggtgcagcgtgggcggagtcgtagggagggaggcctgactcccgacggtccggttcgggggggttccctggaacgtcccttccgttcccgttggttcgcgacgtcccgttcggttcggggttacctaggtcgttagtcacgagtctacttgacgtcggtccggggtcccgcgaacgggccgtaccggaaggggaacggggtcgtggnggtcggtccgttcttacgttaaggttttatttaagtacgtaacgttaacttaaaacctacccctaaacctacttaaccgacctacggtaccgtaccggttaacggggaaacccgggtccttactttactttactcccgtacgaaacgacgtaactaacgttaaccgaacgttaaaccccncctttaacttaacctattaaccgaaacgttaaccgaacccgtacgttaagaccggtacgaccggaaccgggacgtaccgggtccgtttaaaggtaccgttttagggcgggttaccgggaacgggggtaacggggttaaacgtacggtttaaaccggttaggggttttaccgttttaacgtttaccgttttaaaactttaacccgtttaacccggttttaacccggttaccgggggtccgggttaacccgtttaccgggtttaccccgggtttacccg

SEQ ID NO: 368960 - DNA, 658 bp, Homo sapiens
  misc_feature: GZ8MTXP02JRLMY.25.37.D04.1.454.CMB.2.raw
  modified_base (462)..(462): a, c, t, g, unknown or other
  modified_base (476)..(476): a, c, t, g, unknown or other
  modified_base (507)..(507): a, c, t, g, unknown or other
  modified_base (571)..(571): a, c, t, g, unknown or other
  modified_base (656)..(656): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtcgtggaggaggcctgactccaggccgtggggggtccctggacgtacctctcctgtgcacgcctgtgggttacaggtcgttagtcactagcttacttgattccgtcgggtcccgaccgagggtcccgtaccggaaggggaaggggtccgtggggtacgtcggtccgttctcgttaaggtttattacgtaggacctaataacgtaccctaaccgtactaacgcacgtccgtcggtaggacggccgttacttccttacncctaccgaaagtanactaaccttaccgaaacgacccctacccttntaacctcgttaacaaaagtccaaaccgcctagacggcgacgacgtcacgggtctataattcggngcggacgggagtatacgtagttagttacgttacttacgtaacttccgttacccgtccggtacggtccgggtaccgttcggttccncg

SEQ ID NO: 368961 - DNA, 803 bp, Homo sapiens
  misc_feature: GZ8MTXP02HUCHA.25.37.D04.1.454.CMB.2.raw
  modified_base (360)..(360): a, c, t, g, unknown or other
  modified_base (376)..(376): a, c, t, g, unknown or other
  modified_base (403)..(403): a, c, t, g, unknown or other
  modified_base (406)..(406): a, c, t, g, unknown or other
  modified_base (442)..(442): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgcttgttttaaaaggtgtccagtgtgaggtgcagctggcggagtcgtggaggaggcctgatccgagccggtgggggtccctgagactctcctgtcgcacgtcctcgtggttcaggtcgttagtcacaggtctacgttagacttcgtcggggtccaccgacgggtccgtaccggaggggagggacgtgggagtgcgtntcgtaagtttacttanacgaccgataaacctaccactacgtanacncggtctaccggtagaccggggtcctacttccttacncgtacgtaagcgaaactaaccgtaccgaaacgtaaccctacccttataaccttacttaaaccggaaataaccggtaccggtaacccgttacggaaacgggaccggttaccgggaaacggtacccggaccggggttaaccgtttacggttaaaccgtttacgggtcgggttaccggggtaccggggaaccggggggttaattaaacggtttaacccggtttacggggttttaaccgggtttttaacctttaacggtttaaccgtttttaaaccccgtttacccggttttaaacccccgttacgggggtttcccgggggttaaaccccggttacccggggttttttaccccggtaccccgggg

SEQ ID NO: 368962 - DNA, 762 bp, Homo sapiens
  misc_feature: GZ8MTXP02ITVHH.25.37.D04.1.454.CMB.2.raw
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctgggcggagtcgtggaggaggcctgatccagccgtgggggtccctgagactctcctgtgcagcctgtggtcagtcgttagcacagctacttgatcgtcgggtccgccgaggtccgtccgaaggggacggggctaggggagtcgcgttctcgtaagttttactttatacggtaccgtaataaacgtacccaccttaacgtacccgacacggtaccgttacccggtagggtaaaaccggggtcccgttaatttccccgtttaaatcccgttacccgaaaggtaaccgtaaccaaagtttacccgaaagtaaccctaaccccttcttaaccttaccgttaccaaaacgttaccggaaacccgcccgttagggaacgacgggaccccggaagggtacccaacggggtccgtagttaacgttacgtcggtacgggtaccgggtagggggaaatagtttaaaccgggttaggtttacgggttttaaactttaccggttaaacgttttaaccttaccgttttacccccgtaggggttccggggacccgtttacggggttcccctttacgggg

SEQ ID NO: 368963 - DNA, 565 bp, Homo sapiens
  misc_feature: GZ8MTXP02G7JFP.25.37.D04.1.454.CMB.2.raw
  modified_base (409)..(409): a, c, t, g, unknown or other
  modified_base (434)..(434): a, c, t, g, unknown or other
  modified_base (453)..(453): a, c, t, g, unknown or other
  modified_base (488)..(488): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcttgggttttccttgttgctgttttaaaaggtgtccagtgtgaggtgcagctggcggagtcgtgggaggaggcctgatccagtccgtgggggtccctgacgactctcctgtgcagcctgtggttcagtcgttgtcacagtctactgatcgtcggtccgcgaggcctaccggaggggaacgggcgtggagtgcgtctcgtagtttatagtagaccgtataaactaccacctactacgcacgactcgtagacgggtcattcctanctcagacatactaccagaccacctntacgtctaacaatcgaacncctagacgacgacgagacgacgcgtatatacgtgngcggagggatactacgtaagttcgttaattcgtaattaaccgttacgttcctacggcggtcctcggggttactccgg

SEQ ID NO: 368964 - DNA, 555 bp, Homo sapiens
  misc_feature: GZ8MTXP02FY1SM.25.37.D04.1.454.CMB.2.raw
  modified_base (410)..(410): a, c, t, g, unknown or other
  modified_base (430)..(430): a, c, t, g, unknown or other
  modified_base (437)..(437): a, c, t, g, unknown or other
  modified_base (452)..(452): a, c, t, g, unknown or other
  modified_base (478)..(478): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtgggggtccctgagactctcctgtgcagcctcgtgggttcagtcgttagtcacagctacttgatcgtcggtccgcaggctacgaggggagggcgtggagtcgcgtctacgtagtttattatagccgtaataactaccaacctactacgcagcctacgtgaacgcgtattcctatctcaganactaatccgagacctacctntatctanaactgacctccaganacggccaagcacggtctagtatacgngtgacggtgggatactacggtagttggttacttcatttaaccgtcctttcgtacggcggtccgtacggtttcctcgg

SEQ ID NO: 368965 - DNA, 744 bp, Homo sapiens
  misc_feature: GZ8MTXP02GUW3B.25.37.D04.1.454.CMB.2.raw
  modified_base (271)..(271): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggtcgttttggctgagcttgggttttccttgttgtcttgttttaaaaggtgtccagtgtgaggtgcagcgtggcggagtcgtgggaggaggcctgactccgaggccggtcggggggtccctgacgtacttctcctgtgcncgtcctcgtgggttcaggtcgttacgtacacgacgtctacttgactcgtcgggtccaccgacgggccgtaccggaaggggaaggggcgtgggagtcgccgttcgtacgtagtttattagtagaccgtaaataactacccactacgtacgacacgtacctcggtacggaacggcccgttactttaccttactcctacaaaggtaacgtaacctaacgttacccgaaacgaacccctaaccccttacgtaaactttaccttaaaccgtaaaacttcccggaaaccgtcccgtaagggaacgaccgggacccgaaacggaccgtaaccggtcgttagtacttacgtgggtacgggacgggtacggggaattaaccggttagttggtttacggtttaactttaccggtttaatttaaccgtttacccgtttccgtaaccgggtcggggtacccgtttacgggtttcccgtttaccgg

SEQ ID NO: 368966 - DNA, 755 bp, Homo sapiens
  misc_feature: GZ8MTXP02FSBYW.25.37.D04.1.454.CMB.2.raw
  modified_base (349)..(349): a, c, t, g, unknown or other
tcagactgtacagtcacgaccggtgctcgatttagtagcatactgttggggtttgggggggagaggagcccagcactgggattccgaggtgtttccattcggtgatcagcactgaacacagaggactcaccatggtcgttttggctgagtcgttgggttttccttgttgtcttagttttaaaaggtgtccagtgtgaggtgcagcgtgggcggtagtcgtagggaggaggcctgactcccgacggtccggttcggggggtccctaggacgtaccttcctccgtggtcgcacgtcctcggttgggttcacggtcgttagcactagtcctattgacgttcgtcgggtcccnccgaggcctacggaggggaaggggctgggagtggcgttctacgttaagtttatttaagtacggtaccgtaaattaaaccctaaccctaaccttaaccgaaccgacgtacggtacctcccgggtaaggacggggtacccttaacgtttcccttaatcccgtacccgaaagtaaccgtaaactaacgttacccgaaacggtacccctaacccgtaacttacttaccttacaaaacgtccgaaaccgcccgtagacgaacgccggaacgacgtccggactttagtacttcggaggtcggacgggacggggtaatacgttacgttaggttacgtttaactacgtttaaacttaacgttacccgtttacccgtacggtacccgggtacgttaccgggttacccgtttccgg

SEQ ID NO: 368967 - DNA, 636 bp, Homo sapiens
  misc_feature: GZ8MTXP02HM1TM.25.37.D04.1.454.CMB.2.raw
  modified_base (201)..(201): a, c, t, g, unknown or other
  modified_base (209)..(209): a, c, t, g, unknown or other
  modified_base (235)..(235): a, c, t, g, unknown or other
  modified_base (260)..(260): a, c, t, g, unknown or other
  modified_base (375)..(375): a, c, t, g, unknown or other
  modified_base (396)..(396): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctggctcccagatagcaccggagaagttgtgttgacacagtctccagacaccctgtctttgctccgagggaangccacctntcctgcagggccagtcagagtgttancaggttacttagccttggtaccaanagaacctggccaggctccaggctcctcatcctatcgatgacataccaaggacggccacgtggccaactcccgagacctaggttccgaggtcggacaggggtcggggctggggacngtacgtccactctacgactanccaagctagtctaggagtctgaaagttgtttgcttagtttattctagggttactgacgtagtacggttacgtagtagggtttccggggtacccggttaccgggggttacgttaacgggttttcggggaccggtaacgggggtaaccccgttaaagggcggttaccgggaaaggtacgtaacgtaaaccgtaagtcgggtaacgacgtaacgccggaaacttcggttacctttaggttccc

SEQ ID NO: 368968 - DNA, 575 bp, Homo sapiens
  misc_feature: GZ8MTXP02IQJV1.25.37.D04.1.454.CMB.2.raw
  modified_base (215)..(215): a, c, t, g, unknown or other
  modified_base (306)..(306): a, c, t, g, unknown or other
  modified_base (404)..(404): a, c, t, g, unknown or other
  modified_base (409)..(409): a, c, t, g, unknown or other
  modified_base (425)..(425): a, c, t, g, unknown or other
  modified_base (442)..(442): a, c, t, g, unknown or other
  modified_base (462)..(462): a, c, t, g, unknown or other
  modified_base (480)..(480): a, c, t, g, unknown or other
  modified_base (495)..(495): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagcttgggttttccttgttgctgttttaaaaggtgtccagtgtgaggtgcagctggcggagtcgtggaggnggcctgatccagccgtggggggtccctgacgactctcctgtgcagcctcgtgggttcagcgttagtcacagctacttgatcgtcgggtccncgaggctccgaggggaacgggctggagtgcgtctcgtagtttattagtagccgtaataactaccgtactactacgcagctcgagacgcctatctatcncaganacatcaagacctactnatctagaaatcgaaccncctgagacgacgaagtaccncggtcgtagtacttacgntacggcggagggganagttaacgtagttgtttaactttcgtaactttaaccgttacctttaccgtaacggtcgggacctttacgggttcccctgg

SEQ ID NO: 368969 - DNA, 768 bp, Homo sapiens
  misc_feature: GZ8MTXP02ITS4X.25.37.D04.1.454.CMB.2.raw
  modified_base (242)..(242): a, c, t, g, unknown or other
  modified_base (755)..(755): a, c, t, g, unknown or other
tcagactgtacagtcacgaccggtgctcgatttagtagcatactgttgggtttgggggaggaactgctcagttaggacccagagggaaccatggaagccccagctcagcttctcttcctcctgctactctgctcccagatagcaccggagaagttgtgttgacacagtctccagacaccctgttctttgtctccgaggggaaagcgccaccctctcctgcagggccagtcagagttgttacncgtaggttacttagcctaggtaaccaacgaacgaacgtcggacgacgcccaccgacggtcctacctactactacgtagtaggtactacgtactaaccgtaaacggaaacggggtaacccgggtaccctaacggggttaccggaaccctaaccgtaccccggtaaccgtaccgggtttaacggtacggttacgggccggtaccggggtagggggttcggggttacgggaacgggaaagtacggttacgttcctaccctttacaccctaaccgttacacgaacgtacgtacgtcggtacgggacgtacgttaagttaaagtttcgttacgtacttttaagttactacttagccgtaagtacgtacggtacagggttaccggttcggttacccggggtacggtttaccggggttaaagtttcgggttaccggggaaacgggccggttaaaacgcgggttacgaaggttaaacgaacgtttaaacggaaaacgtcggttggaacgtcacgaaccctnttcgtacttcttc

SEQ ID NO: 368970 - DNA, 683 bp, Homo sapiens
  misc_feature: GZ8MTXP02I424E.25.37.D04.1.454.CMB.2.raw
  modified_base (288)..(288): a, c, t, g, unknown or other
  modified_base (387)..(387): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagtctggggttttccttgttgtctgttttaaaaggtgtccagtgtgaggtgcagctggcggagtctgggaggaggcctgatccgagccgtgggggtccctgagactctcctgtcgcagcctcgtggttcagtcgttagtcacngctacttgatcgtcggtccgccgaggcctccgaggggaaggggcgtgggagtcggcgttctctagtttattagtagccgtaataactaccactactacncagacctcgtaggacgggccgtatttcccttaatcctaccgagaacgtaacctaattcccgaaacggtaacccaccccttataacgttacctaactaaaaacgtcgtaaacccgcccgttagaaacggtaccggacccggaacggaaccgacccggggtcccgttaagttaacgttaccgtaggtcggacggggacggggaaagtacgtacggtagtttacgggtttacttacgtaactttaaccttaccgtttacccgtacggtcgggggtacccgttacggtttcccgtaccgg

SEQ ID NO: 368971 - DNA, 810 bp, Homo sapiens
  misc_feature: GZ8MTXP02JA6EC.25.37.D04.1.454.CMB.2.raw
tcagactgtacagtcacgaccggtgctcgatttagtagcatactgttgggtttggggggagaggagcccagcactgggattccgaggtgtttccattcggtgatcagcactgaacacagaggactcaccatggtcgttttggctgagcttgggttttccttgttgctaggttttaaaaggtgtccagtgtgaggtgcagctggcggagtcgtggaggaggcctgactccgacggccggtcgggggtccctagacgacctcctccgtgtcgactacgtcccgtcgttcggggtcagtcggttacgtcgaacacgtccttacgttgacttcgtcgggtcccgccgaggctaccggacggggacggcggtcggtaggagtcggtcgttctacgttagtttaagtttatacgtacgtaacttaaactacccctaaccgtacctaaccgcgtaacgtaacccggttcggtaacgggtaaccggggtaccgtacttttacccgtactccgtaaccgtaggtaaacgtaaacttaaccgttacccggaaaccggttaaccctacccctttacttaactttacccgtttaaaacgaaacttaccgggtaacccgtaccgttaacggacgggtaaaccgaccggtaacggaaccggaccgggttaaccgttgttaaacgttcgcggggttacgggaccggggtaagggtacgtaaacgttacggtttaaggttccgtttttaacgttcgttaacctttaacccgtttaccgtttaacccggtcggtttaccggggtaccgttaccgggggttttacccg

SEQ ID NO: 368972 - DNA, 733 bp, Homo sapiens
  misc_feature: GZ8MTXP02H4IVS.25.37.D04.1.454.CMB.2.raw
  modified_base (265)..(265): a, c, t, g, unknown or other
  modified_base (630)..(630): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttgctgagtcttgggttttccttgttgcttagttttaaaaggtgtccagtgtgaggtgcagcgtggcggagtcgtgggaggaggcctgactccgaggccgtgggggtccctgacgctctcctgtgcncgcctgtcggtcaggtcgttacgtacacagtcttactgactccggtcgggtcccgccgagggtccgtaccggaaggggggtaacggggtcgtggggacggttcggtccgttcgttacttaaggttttaatttaagtacgtaaccgtaaacttaaacctaaccctaacccctaacgtaaccgaccgtacgtacccgttaccgggtacgggaaaccgggtcccttacttacctttacgccctaccgaaaggactaactaaaccgttcccgaaaacggtaaccccttacctactaactttccgtaaataaacgtacgaacccgtccgtagaacgcggaccgaaacgtccggacgtcgttatacgtcgnggtcgacggggaggtatgtaacgttacgttagttacttacgttaactttaaccgttacccgttaaccggtcggacgggttcccgttacggtttacccctcggg

SEQ ID NO: 368973 - DNA, 648 bp, Homo sapiens
  misc_feature: GZ8MTXP02JHZTC.25.37.D04.1.454.CMB.2.raw
  modified_base (428)..(428): a, c, t, g, unknown or other
  modified_base (477)..(477): a, c, t, g, unknown or other
  modified_base (520)..(520): a, c, t, g, unknown or other
tcagactgtacagtcacgaccggtgctcgatttagtagcatactgttgggtttggggggagaggagcccagcactgggattccgaggtgtttccattcggtgatcagcactgaacacagaggactcaccatggcgttttggctgagctgggttttccttgttgcttgttttaaaaggtgtccagtgtgaggtgcagcgtggcggagtctggaggaggcctgatccaggccgtggggggtccctgagactctccgtgtgcagcctcgttgggttcaggtcgttagtcacaggcctaacttgactcgtcgggtccgcacggctccggaggggacgggcctgggagtcgcgtctctagtttattatgaccgtaataactaccactactacgcagacctcgagaacgggccgtatttcctaatcctaccganaacgacacttccaagtaccaccctctaatccttaagaaactacggaacncccgtagacgacgacccgagtccacggtccgtatacgttacgnggtacgcgggtacggggataaccgttacgtacgggttacggtttaatttccggtaaactttaacctttaaacccgttttccccgacgggttccgggggtaccgtaaccggggtttacccctaccgggg

SEQ ID NO: 368974 - DNA, 830 bp, Homo sapiens
  misc_feature: GZ8MTXP02HSO16.25.37.D04.1.454.CMB.2.raw
  modified_base (244)..(244): a, c, t, g, unknown or other
  modified_base (262)..(262): a, c, t, g, unknown or other
tcagactgtacagtcacgaccggtgctcgatttagtagcatactgttgggtttgggggggagaggagcccagcactgggattccgaggtgtttccattcggtgatcagcactgaacacagaggactcaccatggcgttttggctgagctgggttttcttgttgatgtttaaaggtgtcagtgtgaggtgcagcgtggcggagtcgtagggaggtaggcctgactccgaggccggtggggtcccnggacgacgtctcctggtncctcgtccttggtacggtcaggtcgtttagactaaacgcggtacttacgttggacgtcggttccggggccaccggtacggtccgtacccggaagggggaacggggtctaggggtaacgtcggtccggttaccgttagttacgtttttaaagttataaacggaccccgtttaaaataaaacctaccccgtaaaccgttaaccgttaaaccggaccacggttacccgtacgggtaaaggggtaaaacccggggtcccgttaactttaacccctttccgaccgttaaacccgaagggtaaaacgtaaccttaaccgtaaacccgggtaaaacgtaaaccccctaacccgtttacttaaaccgtacccttaaagaaacccgttaccgaaacccgttcccgggtaagaaacggaccggccggtaaaggaccccggtacgaccggttagtaacgttgtacggggcggacggtcccgggggtaaattacccggtattacggggtttaagttaccgttacgtaccttaacggtttacccttccggttacggcgggtaccgttcgtttccggtcccg

SEQ ID NO: 368975 - DNA, 689 bp, Homo sapiens
  misc_feature: GZ8MTXP02J1UDN.25.37.D04.1.454.CMB.2.raw
  modified_base (430)..(430): a, c, t, g, unknown or other
  modified_base (666)..(666): a, c, t, g, unknown or other
tcagactgtacagtcacgaccggtgctcgatttagtagcatactggttggggtttgggggggagaggagcccagcactgggattccgaggtgtttccattcggtgatcagcactgaacacagaggactcaccatggcgttttggctgagtcttgggttttccttgttgtcttagttttaaaaggtgtcagtgtgaggtgcagcgtggcggagtcgtggaggaggcctgactccgacggtccggtcgggggtccctggacgtactccgtccgtgtgactcgtcctcgtgggttcaggtcgttagtcgacacgtctacgttgacgtccggtcggtaccgcgaggtccgtacggaggggaagggtcgtggtacgtgtcgttactgtagtttaattagaggtacctaactaacctacctaaccttacgacgacncgtacctacggtagaaacggtcctacttacctatccaacaaggtactaactaaattcccgaacgaaaccctacccttatacttaccgtaactaaacgtaccgaaacccgttcgagacgaccgggttaccgaggaccccggtggtaccgttaagtcgttaacgtgcgggtaccgagggggaacttaagacctttaggggtttacttaacgttacttaccttaaccgttaccgtccgnggtaccggtaccgtcgttcctcg

SEQ ID NO: 368976 - DNA, 409 bp, Homo sapiens
  misc_feature: GZ8MTXP01CO0TP.3.1.A01.1.454.CMB.2.raw
  modified_base (405)..(409): a, c, t, g, unknown or other
tcagagacgcactccacgaccggtgctcgatttagacgtctcatccatcagtagtactagtagtaacatatactacgaagactcagtgaagggccgattcaccatctccagagacaaagccaagaactcactgtatctggaaatgaacagcctgagagccgaggacacggctgtgtattactgtgcgagagggcggctttggggttcaggaccgtcctacgctatggacgtctggggccaagggaccacggtcaccgtctcctcagcctccaccaagggcccatcggtcttccccctggcgccctgctccaggagcacctccgagagcacagcggccctgggctgcccctggtcaaggctacttcccgagtgcgtctctgagcggggctgggcaaggcgcatagnnnnn

SEQ ID NO: 368977 - DNA, 410 bp, Homo sapiens
  misc_feature: GZ8MTXP01ALRG9.3.1.A01.1.454.CMB.2.raw
  modified_base (407)..(410): a, c, t, g, unknown or other
tcagagacgcactccacgaccggtgctcgatttagacgtctcatccatcagtagtactagtagtaacatatactacgaagactcagtgaagggccgattcaccatctccagagacaaagccaagaactcactgtatctggaaatgaacagcctgagagccgaggacacggctgtgtattactgtgcgagagggcggctttggggttcaggaccgtcctacgctatggacgtctggggccaagggaccacggtcaccgtctcctcagcctccaccaagggcccatcggtcttccccctggcgccctgctccaggagcacctccgagagcacagcggccctggggctgccccctgggtcaaggctacttccgagtgcgtctctgagcggggctgggcaaggcgcatagnnnn

SEQ ID NO: 368978 - DNA, 468 bp, Homo sapiens
  misc_feature: GZ8MTXP01EZXV1.3.1.A01.1.454.CMB.2.raw
  modified_base (322)..(322): a, c, t, g, unknown or other
  modified_base (328)..(328): a, c, t, g, unknown or other
  modified_base (458)..(468): a, c, t, g, unknown or other
tcagagacgcactccacgaccggtgctcgatttagacgtctcatccatcagtagtactagtagtaacatatactacgaagactcagtgaagggccgattcaccatctccagagacaaagccaagaactcactgtatctggaaatgaacagcctgagagccgaggacacggctgtgtattactgtgcgagagggcggctttggtgtcgacggtcctcctacgctagtcggacgtcggtcgggaccgaacggaccgtacggtccaccgtcctccctcgacgtccctacccaacggaccggccctagtccggttcccttccccgnggcccnccctccacgaagcgccacctcgggtcggggcaacgcggcccgtccgtggctcgccgttcggacgaaagtccttaccgtccgaagtcgccgttctcgtaggacgggccgggtgcggacgaggccgataagnnnnnnnnnnn

SEQ ID NO: 368979 - DNA, 450 bp, Homo sapiens
  misc_feature: GZ8MTXP01CCN7U.3.1.A01.1.454.CMB.2.raw
  modified_base (443)..(450): a, c, t, g, unknown or other
tcagagacgcactccacgaccggtgctcgatttagacgtctcatccatcagtagtactagtagtaacatatactacgaagactcagtgaagggccgattcaccatctccagagacaaagccaagaactcactgtatctggaaatgaacagcctgagagccgaggacacggctgtgtattactgtgcgagagggcggctttggggttcaggaccgtcctacgctatggacgtctggggccaagggaccacgggtcacccgtctcctcagcctccaccaagggcccatcggtccttccccctggccgccctgcctccgaggacgccaccctccgagacgccacgacggccggcccctggggcctcgccccctgggtacaaggccttacttcccggagtcgccgttcctcgtggacggcggggctgggaccgaagggcgacatagnnnnnnnn

SEQ ID NO: 368980 - DNA, 430 bp, Homo sapiens
  misc_feature: GZ8MTXP01CACMR.3.1.A01.1.454.CMB.2.raw
  modified_base (312)..(312): a, c, t, g, unknown or other
  modified_base (328)..(328): a, c, t, g, unknown or other
  modified_base (417)..(430): a, c, t, g, unknown or other
tcagagacgcactccacgaccggtgctcgatttagacgtctcatccatcagtagtactagtagtaacatatactacgaagactcagtgaagggccgattcaccatctccagagacaaagccaagaactcactgtatctggaaatgaacagcctgagagccgaggacacggctgtgtattactgtgcgagagggcggctttggggttcaggaccgtcctacgctatggacgtctggggccaagggaccacggtcaccgtctcctcagcctccaccaagggcccatcggtctcccctgccgccctgcctcaggngcacctcgagagcacngccggccctggggctcgccccgtggtcaaggtacctacgttcccgagtcgcgtctcgtgacggcggggtctgggcaagggcgcagtagnnnnnnnnnnnnnn

SEQ ID NO: 368981 - DNA, 453 bp, Homo sapiens
  misc_feature: GZ8MTXP01BZ5ZE.3.1.A01.1.454.CMB.2.raw
  modified_base (444)..(453): a, c, t, g, unknown or other
tcagagacgcactccacgaccggtgctcgatttagacgtctcatccatcagtagtactagtagtaacatatactacgaagactcagtgaagggccgattcaccatctccagagacaaagccaagaactcactgtatctggaaatgaacagcctgagagccgaggacacggctgtgtattactgtgcgagagggcggctttggggtcaggaccgtcctacgctatggacgtctggggccaagggcccacggtcacccgtctcctcagccctccaccaagggcccatccggtccttcccccgtggccgccctgcctccgaggcgccaccctccgagacgccacgacggccggcccgtggggcctcgcccccgtgggtacaaaggtcctacgttcccggagtcgtccgtctcgtggacggccggggctgggacaaggccgcagtagnnnnnnnnnn

SEQ ID NO: 368982 - DNA, 422 bp, Homo sapiens
  misc_feature: GZ8MTXP01DMR31.3.1.A01.1.454.CMB.2.raw
  modified_base (318)..(318): a, c, t, g, unknown or other
  modified_base (412)..(422): a, c, t, g, unknown or other
tcagagacgcactccacgaccggtgctcgatttagacgtctcatccatcagtagtactagtagtaacatatactacgaagactcagtgaagggccgattcaccatctccagagacaaagccaagaactcactgtatctggaaatgaacagcctgagagccgaggacacggctgtgtattactgtgcgagagggcggctttggggtcaggaccgtcctacgctatggacgtctggggccaaggggaccacggtcaccgtctcctcagcctccaccaagggcccatcggtccttccccctggccgccctgcctccaggancaccctccgagacgcacagccggccctggggctcgcccctggtacaaggcctactccgagtgcgtctcgtgagcgggctggcaaggcgcatagnnnnnnnnnnn

SEQ ID NO: 368983 - DNA, 476 bp, Homo sapiens
  misc_feature: GZ8MTXP01AU0KY.3.1.A01.1.454.CMB.2.raw
  modified_base (466)..(476): a, c, t, g, unknown or other
tcagagacgcactccacgaccggtgctcgatttagacgtctcatccatcagtagtactagtagtaacatatactacgaagactcagtgaagggccgattcaccatctccagagacaaagccaagaactcactgtatctggaaatgaacagcctgagagccgaggacacggctgtgtattactgtgcgaggagggcggtcgttttggggttcagggaccgtcctacgctatggacgtcgtggggccaaagggaccacggtcacccgtctcctcacgccctccaccgaacgggccccagtccggtccttccccccgtggcccgcccctgcctccgaggacgccaccgtcgagacgccacgaggccggcccctggggcctcggccccctgggtacaaagggtccttaccgttcccggagttcgccgttctcgtggacggccggggtctcgggacaagggccacagtagnnnnnnnnnnn

SEQ ID NO: 368984 - DNA, 728 bp, Homo sapiens
  misc_feature: GZ8MTXP01EU46V.3.1.A01.1.454.CMB.2.raw
  modified_base (204)..(204): a, c, t, g, unknown or other
  modified_base (213)..(213): a, c, t, g, unknown or other
  modified_base (217)..(217): a, c, t, g, unknown or other
  modified_base (699)..(699): a, c, t, g, unknown or other
tcagagacgcactccacgaccggtgctcgatttagacgtctcatcaagggaaggaagggggaggaactgctcagttaggacccagagggaaccatggaagccccagctcagcttctcttcctcctgctactctggctcccagataccaccggagaaattgtgttgacacagtctccagccacctgtcttgtctccgaggggaanagccacctntccngcagggccagtcagagtgtagcaactactagcctaggtaaccaacagaaacccgtggacccaaggcctaccccgaggtcccttcctcacttctatcggaatcgcctaagtaccccgaaacggcgggtacccacgtcgggaccaacgtccccgaagtcccgtaagggtttccaggtcgggcctaggggtccgggtcgtacgggggaaactacggtaacctttccaactttccaccaacccattccgaaacgccaacgtacccgttaaggaccgtacccgttaaggttaaaacggttacttttttacgggacctttaaggttttaacttaaccgttagttacccgaaggggttaccgaacggtacgttacggacctaacggtccggtacccttcgttacccgtacggtttacccggggacgggttaacgggaaccggtaagggttcgggaacgttaagtaaccgaaacgttacgttgcggtcgngccacccgtagttccttcgttaacttccg

SEQ ID NO: 368985 - DNA, 400 bp, Homo sapiens
  misc_feature: GZ8MTXP02IT1ED.3.1.A01.1.454.CMB.2.raw
  modified_base (292)..(292): a, c, t, g, unknown or other
  modified_base (396)..(400): a, c, t, g, unknown or other
tcagagacgcactccacgaccggtgctcgatttagacgtctcatccatcagtagtactagtagtaacatatactacgaagactcagtgaagggccgattcaccatctccagagacaaagccaagaactcactgtatctggaaatgaacagcctgagagccgaggacacggctgtgtattactgtgcgagagggcggctttggggtcaggaccgtcctacgctatggacgtctggggccaagggccacggtcaccgtctcctcagcctccaccaaggcccatcggtctccccnggccgcccctgctccaggagcacctccgagagcacagcggccctgggctgccctgtcaaggctacttccgagtgcgtctctgagcgggctggcaggcgcatagnnnnn

SEQ ID NO: 368986 - DNA, 438 bp, Homo sapiens
  misc_feature: GZ8MTXP02GSMOR.3.1.A01.1.454.CMB.2.raw
  modified_base (430)..(438): a, c, t, g, unknown or other
tcagagacgcactccacgaccggtgctcgatttagacgtctcatccatcagtagtactagtagtaacatatactacgaagactcagtgaagggccgattcaccatctccagagacaaagccaagaactcactgtatctggaaatgaacagcctgagagccgaggacacggctgtgtattactgtgcgagagggcggctttggggttcaggaccgtcctacgctatggacgtctggggccaagggaccacggtcaccgtctcctcacgcctccaccaagggccccagtccggtccttccccctggccgcccctgcctccgaggacgccaccgtccgagacgcacaggccggcccgtgggctgcccctggtacaaggactactccgagtcgcgtctcgtgacggcgggctgggaccaaaggccgcaagtagnnnnnnnnn

SEQ ID NO: 368987 - DNA, 403 bp, Homo sapiens
  misc_feature: GZ8MTXP02J0XIP.3.1.A01.1.454.CMB.2.raw
  modified_base (401)..(403): a, c, t, g, unknown or other
tcagagacgcactccacgaccggtgctcgatttagacgtctcatccatcagtagtactagtagtaacatatactacgaagactcagtgaagggccgattcaccatctccagagacaaagccaagaactcactgtatctggaaatgaacagcctgagagccgaggacacggctgtgtattactgtgcgagagggcggctttggggttcaggaccgtcctacgctatggacgtctggggccaagggaccacggtcaccgtctcctcagcctccaccaagggcccatcggtcttccccctggcgccctgctccaggagcacctccgagagcacagcggccctgggctgcccctggtcaaggctactccgagtgcgtctctgagcgggctggcaaggcgcatagnnn

SEQ ID NO: 368988 - DNA, 513 bp, Homo sapiens
  misc_feature: GZ8MTXP02GMQBP.3.1.A01.1.454.CMB.2.raw
  modified_base (205)..(205): a, c, t, g, unknown or other
  modified_base (262)..(262): a, c, t, g, unknown or other
  modified_base (311)..(311): a, c, t, g, unknown or other
  modified_base (401)..(401): a, c, t, g, unknown or other
tcagagacgcactccacgaccggtgctcgatttagacgtctcatcaaggaagggaagggggaggaactgctcagttaggacccagagggaaccatggaagccccagctcagcttctcttcctcctgctactctggctcccagataccaccggagaaattgtgttgacacagtctccagccaccctgtctttgtctccagggaaangccacctctcctgcagggccagtcagagtgttagcaactacttagcctggtaccaanagaaacctggccaggctcccaggcctcctcatctatgatgcatccaaanacgggccacgtggcatcccagccaggttcagtgcagtggtctgggacagcttcactctcaccagtcagcagcctagacgcctagaaagtnttttgctagtttatactgtcagctagcgtagcaacgtggcctctcacgtttcggcggaggaccgaaggtggacatacgaaacgactgtaggctcgacacctatctctcttac

SEQ ID NO: 368989 - DNA, 566 bp, Homo sapiens
  misc_feature: GZ8MTXP02I0S2S.3.1.A01.1.454.CMB.2.raw
  modified_base (205)..(205): a, c, t, g, unknown or other
  modified_base (286)..(286): a, c, t, g, unknown or other
  modified_base (415)..(415): a, c, t, g, unknown or other
tcagagacgcactccacgaccggtgctcgatttagacgtctcatcaagggaaggaagggggaggaactgctcagttaggacccagagggaaccatggaagccccagctcagcttctcttcctcctgctactctggctcccagataccaccggagaaattgtgttgacacagtctccagccacctgtctttgtctccgaggggaangccaccctctcctgcagggccagtcagagtgttagcaactcttagcctggtaccaacagaacctggccaggctccagctcnatctatgatgcatccaacgagggccagtggccatccccagcctaagggttcaggtcgggactggtggggtctggggaaccaggctttccacttctaccacctatcagcacgcctagacgctagaacttnttttgacttagtttattcgttagtcagtcgtagacgtagactaaccgtggaccttcgtacgtaccgtttcgggacgggtacgggtaccgaaggggttggaggacttacgaaaacgtacgtgtaggtctcgacacattccgtgttctttacg

SEQ ID NO: 368990 - DNA, 528 bp, Homo sapiens
  misc_feature: GZ8MTXP02FGDJA.3.1.A01.1.454.CMB.2.raw
  modified_base (350)..(350): a, c, t, g, unknown or other
  modified_base (514)..(514): a, c, t, g, unknown or other
  modified_base (516)..(528): a, c, t, g, unknown or other
tcagagacgcactccacgaccggtgctcgatttagacgtctcatccatcagtagtactagtagtaacatatactacgaagactcagtgaagggccgattcaccatctccagagacaaagccaagaactcactgtatctggaaatgaacagcctgagagccgaggacacggctgtgtattactgtgcgagagggcgctttgggtgtcgacggtaccctccgtacgtctagtcgggtaccgttcggtcggggaccgaaacgggacccgtacggtacccaccgtcctccctcgaccgtcccctacccaaaccggaccgggccccacggttccggttccccctttccccccggngggcccctccccctttccccaaccgaaaggacgccctaccctcggggtcggggaccaacgcggcccggtcccggtgggctccgccgtcggtaccgaacggtacttaccgttccggagtcgtcctctcgtgacggggcggtcgtcggaacgaaggccgactaagngnnnnnnnnnnnnn

SEQ ID NO: 368991 - DNA, 430 bp, Homo sapiens
  misc_feature: GZ8MTXP02HR2LL.3.1.A01.1.454.CMB.2.raw
  modified_base (422)..(430): a, c, t, g, unknown or other
tcagagacgcactccacgaccggtgctcgatttagacgtctcatccatcagtagtactagtagtaacatatactacgaagactcagtgaagggccgattcaccatctccagagacaaagccaagaactcactgtatctggaaatgaacagcctgagagccgaggacacggctgtgtattactgtgcgagagggcggctttggggttcaggaccgtcctacgctatggacgtctggggccaagggaccacggtcaccgtctccctcacgcctccaccaaggccccatcggtctccccctggccgcccctgcctccaggacgccacctccgagacgcacacgcggccccgtggggctcgccccctggtccaaaggactacttcccgagtgccgtctctgagcgggctgggccaaggcgcatagnnnnnnnnn

SEQ ID NO: 368992 - DNA, 636 bp, Homo sapiens
  misc_feature: GZ8MTXP02GJMAA.3.1.A01.1.454.CMB.2.raw
  modified_base (205)..(205): a, c, t, g, unknown or other
  modified_base (215)..(215): a, c, t, g, unknown or other
  modified_base (405)..(405): a, c, t, g, unknown or other
  modified_base (409)..(409): a, c, t, g, unknown or other
tcagagacgcactccacgaccggtgctcgatttagacgtctcatcaaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaanagccaccctntcctgcagggccagtcagagtgttagacaacttacttagcctggtaaccaacaacggaaaccctggaccaggcctccccaggcctcctcatctatgatgcatccaacgaggcccagtcgcactcccgagtccaggttccaggtcggctagggtcgggtcgtagggacacgtccttcactcctaccaaccntacngacagacctagacgccgtaagtaagttagtttttagtagttttattacgtcggttacagtaccgtaagtcggtactacctaacgttcggtccttactaccgttaaccggtttcggggacgggtaacggggtaaccgaaaggggttcggaaactaacgttaaaacggaaacggtaacgttggttcggactaacgaccctaactacgttcgtcgttacctttactaccg

SEQ ID NO: 368993 - DNA, 579 bp, Homo sapiens
  misc_feature: GZ8MTXP01A0U0X.8.1.A01.1.454.CMB.2.raw
  modified_base (287)..(287): a, c, t, g, unknown or other
  modified_base (570)..(570): a, c, t, g, unknown or other
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagatgaattgaccaaagaaatatgcttatggtaccagcagaagtcaggccaggcccctgtcctggtcatttangaggaacaagaaaccgcccgtacgggatccccgtagacagactctcgtggctcccgagctacgaggggacaaggtcggccctaccgttgaactatcgacggtcggggacccgagggtgggaggagtaggaaggagtaactacttattgtactctacgagaggaaggggagtggtacagtcgtagttgggttggttcgggacgggtagggaccgagcgtcgaccgttctaagttccgagcccacggccttaccgccccgtcggtccacctcgttccgttccccncccttcccg

SEQ ID NO: 368994 - DNA, 528 bp, Homo sapiens
  misc_feature: GZ8MTXP01D2YX2.8.1.A01.1.454.CMB.2.raw
  modified_base (286)..(286): a, c, t, g, unknown or other
  modified_base (426)..(426): a, c, t, g, unknown or other
  modified_base (450)..(450): a, c, t, g, unknown or other
  modified_base (506)..(506): a, c, t, g, unknown or other
  modified_base (520)..(520): a, c, t, g, unknown or other
tcagctcgcgtgtccacgaccggtgctcgatttagacgtctcatcaggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgaccaaagaaatatgcttattggtaccagcagaagtcaggccaggcccctgtcctggtcatttangaggacaagaaacgccctcgggatccctgacagactctctggcctcccagctcgagggacaaggtcggccacttgactatcacgtggggcccaggtggaggatggaaggagactactattgttactctcagagaaggggntggtcatcagttgggtgttcgggngggagggaccaagctgaccgttctaagttcgagcccaggccttcgcccctcggtcnctcttcgttccccnccctcccg

SEQ ID NO: 368995 - DNA, 587 bp, Homo sapiens
  misc_feature: GZ8MTXP01BL5U8.8.1.A01.1.454.CMB.2.raw
  modified_base (217)..(217): a, c, t, g, unknown or other
  modified_base (291)..(291): a, c, t, g, unknown or other
  modified_base (489)..(489): a, c, t, g, unknown or other
tcagctcgcgtgtccacgaccggtgctcgatttagacgtctcatcgagggggtgggctcaggaggcagagctctgggaatctcaccatggcctggacccctctcctgcctccccctcctcactttctgcacagtctctgaggcctcctatgagctgacacagccaccctggtgtcagtcgtccccaggacaaacggccaggatcacctgctctgganatgaattgacaaagaaatatgcttattggtaccagcaagaagtcaggccacggcccctgtcctggtctatttangaggaacaagaaaccgacccgtacgggactcccgtgaacagacctctcgtcggcctcccgagctacgacggggactaaggtcggccctacttgactatcgacgtcggggacccagggtggaggagtaggaaggagtactacttattcgttactctacgaagagaaggggatggtcagtcgtagttgggtgttacgggnggtaacggggacaaggcgtaacggaccgttcgtaaacgttcgacgacccgaggccttccgccccgtcggtctccgtccttccgtccccgcccgtcccg

SEQ ID NO: 368996 - DNA, 538 bp, Homo sapiens
  misc_feature: GZ8MTXP01B7S29.8.1.A01.1.454.CMB.2.raw
  modified_base (285)..(285): a, c, t, g, unknown or other
  modified_base (518)..(518): a, c, t, g, unknown or other
tcagctcgcgtgtccacgaccggtgctcgatttagacgtctcatcaggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgaccaaagaaatatgcttattggtaccagcagagtcaggccaggcccctgtcctggtcatttangaggacaagaacgaccctcgggatcccctgacagactctctggctccccagctcgaggggacaagtggcccacttgactatcgacgtgggggcccagggtgagggataggaagggagtaactactatttcgtactctcagagaaggggatggtacatcgagttgggtgttcgggcggtagggaccaaggctgaccgttccgtagttcgacgcccaggcttcgcccctcggtcnctcttcgtccccgccctccg

SEQ ID NO: 368997 - DNA, 537 bp, Homo sapiens
  misc_feature: GZ8MTXP01BKBH1.8.1.A01.1.454.CMB.2.raw
  modified_base (287)..(287): a, c, t, g, unknown or other
  modified_base (446)..(446): a, c, t, g, unknown or other
tcagctcgcgtgtccacgaccggtgctcgatttagacgtctcatcagggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgaattgaccaaagaatatgcttattgtaccatcagaagtcaggccaggcccctgtcctggtcatttangagacaagaaaccgccctcgggatcccctgacagactctctggctcccaggctcgaggaccaagtcgccacttgactatcacgtggggcccaggtgagagtgaagagactatattgtactctacagagaaggatggtcagtcagttgggtgttacgggnggtacggacaagctcggtaccgttcgtaacgcgacgcccgaggccttccgccccctggcctacgtcttaccgtccccgttaacccgtcccg

SEQ ID NO: 368998 - DNA, 558 bp, Homo sapiens
  misc_feature: GZ8MTXP01ECUPJ.8.1.A01.1.454.CMB.2.raw
  modified_base (287)..(287): a, c, t, g, unknown or other
tcagctcgcgtgtccacgaccggtgctcgatttagacgtctcatcagggggtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctgctctggagatgaattgacaaagaatatgcttattggtaccagcagaagtcaggccaggcccctgtcctggtcatttangaggacaaagaaaccgaccccgtcggactccctgacagactctctgctcccgagctgaggacaagtcgcctacttgactatcgacgtggggcccagggtggaggagtaggaaggagtaactactattgtactctacaagagaaggggtagtggtcatcgtagttgggtggttacgggcgggtacgggacaaggctaacgaccgttactaagttcgacgcccaaggcttccgccccgtcggtctacctcgttccgttccccgaaccctcccg

SEQ ID NO: 368999 - DNA, 653 bp, Homo sapiens
  misc_feature: GZ8MTXP01CCSE0.8.1.A01.1.454.CMB.2.raw
  modified_base (216)..(216): a, c, t, g, unknown or other
  modified_base (295)..(295): a, c, t, g, unknown or other
  modified_base (380)..(380): a, c, t, g, unknown or other
  modified_base (638)..(638): a, c, t, g, unknown or other
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctgganatgaattgaccaaagaaatatgtacttattggtaccagcaaggaagtcgaggccacggcccctgtcctggtctatttangaggacaagaacgacccgtcgggatccctgacagactctcgtcggctccccagctcgagggacaagggtcgcctacgttgactcncgacggtcgggacccgagggtcggaggagaggaaggacgtaactacttagtttacgttacctcgtaccgaggtaaggaaggggtgttacgggtacagttcgtaaggtttcgggggtaggtttccggggacgggtaacggggaccgaacggtcgtaacggtaacccgttacgtaaacggttccgaaacggcccgaaacgggttcccttacccggtcccccggttccggttcctacccgttcgttcccgtttaacccccnccccgttaaccccgg

SEQ ID NO: 369000 - DNA, 606 bp, Homo sapiens
  misc_feature: GZ8MTXP01BUSUQ.8.1.A01.1.454.CMB.2.raw
  modified_base (215)..(215): a, c, t, g, unknown or other
  modified_base (286)..(286): a, c, t, g, unknown or other
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcactgctctgganatgaattgaccaaagaatatgcttatggtacagcagaagtcaggccacggcccctgtcctggtctatttangaggacaagaaaccgacccctcgggactccctgacagtactctcgtggcctaccccgagctcgacgggacaaggttcgccctacgtttagacttactccgacgggtcggggacccgagggtaggaggagtaggaaggagtaactacttattcgtactcgtaccgagaggaaggggtatggtacagtcgtaggttgggttacggttcgggcgggacgggtaccgaagtcgtcgtaaccgttacgttaacgcgacgacccgaacggccgttccgtaacccccgtcggtcctaccttccgttccgttccccgaaccctccccg

SEQ ID NO: 369001 - DNA, 560 bp, Homo sapiens
  misc_feature: GZ8MTXP01AXCBP.8.1.A01.1.454.CMB.2.raw
  modified_base (329)..(329): a, c, t, g, unknown or other
  modified_base (433)..(433): a, c, t, g, unknown or other
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgaccaaagaaatatgcttattggtaccagcagaagtcaggccaggcccctgtcctggtctatttatggagacaagaaacgaccctcgggatccctgacagactctcnggctcccagctcgagggacaagtcggccacttgactatcacgtcggggcccagggtggaggagtaggaaggagactactagttgtaactctcgaagagaagggntggtcatcgtagttgggtgttcgggcggtaggggacaagtcgaacgtacccgttcgtaaacgcgaagccccgaaggccttccggtccccctgggtcaccgttcttacggttccccaacccgttcccg

SEQ ID NO: 369002 - DNA, 593 bp, Homo sapiens
  misc_feature: GZ8MTXP01AVNLQ.8.1.A01.1.454.CMB.2.raw
  modified_base (285)..(285): a, c, t, g, unknown or other
  modified_base (323)..(323): a, c, t, g, unknown or other
tcagctcgcgtgtccacgaccggtgctcgatttagacgtctcatcaggggtaggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgaccaaagaatatgcttattggtaccagcagaagtcaggccaggcccctgtcctggtcatttangagacaagaaacgaccctcgggatccctgacagactcnctggctccagctcgaggggacaagtcggccaccttgactatccacgtcgggggcccagggtcggaggatggaaaggagaacgtactattgttactctccagtagaaggggatggttacagttcgtagttggggtgtttacgggcgggtacggggacctaggccgtaacggtacccgttaccgttaaagccgaacgtaccccgaaggttccttcccggcccccgttcgggttcccaccttccgttcccgttaaccccaaccccgttccccg

SEQ ID NO: 369003 - DNA, 670 bp, Homo sapiens
  misc_feature: GZ8MTXP01BR4WD.8.1.A01.1.454.CMB.2.raw
  modified_base (291)..(291): a, c, t, g, unknown or other
tcagctcgcgtgtccacgaccggtgctcgatttagacgtctcatcagggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgaattgaccaaagaaatatgcttagttggtacagcagaagtcaggccacggcccctgtcctggtctatttanggaggaacaaagaaaccgaccccgtcgggactcccgtagacacgtacctctcgtcggcctaccccgagcgtacgagggtacaacggtcgggccctaccgttagacctagtaccgacgggtcgggggacccgtaggggtaggaagggagtagggaaaggtaaggtaacttaacgttagtttacggttaacctcgttaccgaagtaaggtaaggggtaagttcgggtactacgttacgtaaggtttggggttggttacggggcgggaacgggtaacacggtcgtaacggtaccgttacgtaacgttaccgacgtacccgaacggccttaccggtcccccgttacgtcctaccgtccttcccgttaaccccgccccttcccg

SEQ ID NO: 369004 - DNA, 546 bp, Homo sapiens
  misc_feature: GZ8MTXP01CWG94.8.1.A01.1.454.CMB.2.raw
  modified_base (290)..(290): a, c, t, g, unknown or other
  modified_base (334)..(334): a, c, t, g, unknown or other
  modified_base (424)..(424): a, c, t, g, unknown or other
  modified_base (525)..(525): a, c, t, g, unknown or other
tcagctcgcgtgtccacgaccggtgctcgatttagacgtctcatcaggggtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctctggagatgaattgaccaaagaaatatgcttattcggtaaccagcaagaagtcaggccaggcccctgtcctggtcatttangaggacaaagaaccgccctacgggatcccgtagacagactctcnggctcccagctgagggacaagtcggccacttgactatcacgtcggggcccagggtcggaggagtagaaggagactactattcgttactcncgagagaaggggtagtggtacagtcgtagttgggtgttcgggacggtaggaccagctggaccgttctagccgacgcccaacggcttacgccccgtcggtcnctcttcttccccgccctcccg

SEQ ID NO: 369005 - DNA, 612 bp, Homo sapiens
  misc_feature: GZ8MTXP01DG8U3.8.1.A01.1.454.CMB.2.raw
  modified_base (294)..(294): a, c, t, g, unknown or other
  modified_base (387)..(387): a, c, t, g, unknown or other
tcagctcgcgtgtccacgaccggtgctcgatttagacgtctcatcagggggtgggctcaggaggcagagctctgggaatctcaccatggcctggacccctctcctgcctccccctcctcactttctgcacagtctctgaggcctcctatgagctgacacagcccaccctggtgtcagtcgtccccaggacaaacggccaggatcacctgctctggagatgaattgaccaaaagaatatgtacttattggtaccagcaagaagtcaggccacggcccctgtcctggtctatttangaggaacaaaggaaaccgcccgtacgggactccctagaacagtactctcgtggcctccccgagctacgagggacaagtcgcctacttgactancacgtcggggcccaggtgaggagaggaaggagaacttactattcgtactctacaagagaaggggtagtggtacatacgtagttggggtaggttacgggcgggtaacgggaccaacggcgtaacggtacccgttacgtaaacggttccgaacgacccgaacggttccttacccggtcccccgtacgggtcctaccgttccgttcccgttccccgaacccgttcccg

SEQ ID NO: 369006 - DNA, 608 bp, Homo sapiens
  misc_feature: GZ8MTXP01D7E1Y.8.1.A01.1.454.CMB.2.raw
  modified_base (292)..(292): a, c, t, g, unknown or other
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctgagatgaattgaccaaagaaatatgtacttagttggtaccagcagaagtcaggccacggcccctgtcctggtctatttangagacaaagaaacgacctccggtacgtcctacgacacgactctctcgctcccacgcacgaggacgaacgtcgccgacctacgtactactcgacgtcgggtccgacggtgggaggagagtaaggagtaactattactgttactactacgaagaaggaagggtacgtggttacgtacgtacgttaggttggggttcggttacggggcggggaacgggaaccgacgtacgtaacgtaccgttaccgtagttacgacgacccgaacggccttccgtccccgcgttaacgtcctccgttccgttccccttaaccccgtccg

SEQ ID NO: 369007 - DNA, 606 bp, Homo sapiens
  misc_feature: GZ8MTXP01CI5SB.8.1.A01.1.454.CMB.2.raw
  modified_base (281)..(281): a, c, t, g, unknown or other
  modified_base (286)..(286): a, c, t, g, unknown or other
  modified_base (315)..(315): a, c, t, g, unknown or other
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgacaaagaatatgcttattggtaccagcagagtcaggccaggccctgcatgtcatttangaganaagaacacctcggatccctgacagactcnctggccctcgagtcctcgaacgggtaacaggtcggaccctaaaccgttggaacctagtcgtacggtcgggggaccctagggtagggaaggtagtaggaaagggattaaccgtaattagtttacgtaactccgtaccgaagtaggggaaaggtagttgtacaagttcgaggtttggggtagttcgggaggtacgggaccaaggtcttacggaccgtacgttaagtaccgacgaccccgagggccttaacccgcccccgttggtacctccttcgtccccggtttccccgcccg

SEQ ID NO: 369008 - DNA, 557 bp, Homo sapiens
  misc_feature: GZ8MTXP01BF2EV.8.1.A01.1.454.CMB.2.raw
  modified_base (285)..(285): a, c, t, g, unknown or other
  modified_base (532)..(532): a, c, t, g, unknown or other
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctggtgtcagtgtccccaggacaaacggccaggatcacctgctctggagatgaattgaccaaagaatatgcttattggtaccagcagaagtcaggccaggcccctgtcctggtcatttangaggacaagaacgccctcgggatcccctgacagactctctggcctccccagctcgaggggacaaggtggccctacttgactatcacgtcggggcccagggtggaggagtaggaaaggagtaactacttagttacgttactctaccgagaagaaggggatggtcatcgagttgggtggttcgggcgggtagggaccagctcgaccgttctaacgttcgacgcccgaggccttccgcccccgtggtccncctcgttccgttccccgccctcccg

SEQ ID NO: 369009 - DNA, 639 bp, Homo sapiens
  misc_feature: GZ8MTXP01CUVH4.8.1.A01.1.454.CMB.2.raw
  modified_base (218)..(218): a, c, t, g, unknown or other
  modified_base (237)..(237): a, c, t, g, unknown or other
  modified_base (248)..(248): a, c, t, g, unknown or other
  modified_base (254)..(254): a, c, t, g, unknown or other
  modified_base (279)..(279): a, c, t, g, unknown or other
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacacgccaccctggtgtcagtcgtccccaaggaccaaacggccaggatcacctgctctgganatagaattgacaaagaatntgcttatgacngcagancagcacgccctgtcctgtctattangagacaagaaccgccgtcggactccgagacacgtctctcgtcggcctcccgagcgtacgacgggaccacggtacggccctaacgttcgaaccttcgtaccgaccggtcgggggaccccgtaaggggtcggaaggaagtagggaaaggtacgtacttaacgttagtttacgttacctcgtacgaaggtaacggtaaggggtacgtgggttaccagttacgtaggtttaggggttcggttacgggacgggtacggaacgacgtcgtaacggtacccgttacgtaacgttcgaaccgccggaacggttccttacccggccccttcgggtccctccgtccgttcccgtaacccgttcccgtccg

SEQ ID NO: 369010 - DNA, 680 bp, Homo sapiens
  misc_feature: GZ8MTXP01A06LJ.8.1.A01.1.454.CMB.2.raw
  modified_base (215)..(215): a, c, t, g, unknown or other
  modified_base (233)..(233): a, c, t, g, unknown or other
  modified_base (285)..(285): a, c, t, g, unknown or other
tcagctcgcgtgtccacgaccggtgctcgatttagacgtctcatcagggggtgggctcaggaggcagagctctgggaatctcaccatggcctggacccctctcctgcctccccctcctcactttctgcacagtctctgaggcctcctatgagctgacacagccaccctggtgtcagtcgtccccaggacaaacggccaggatcactgctctgganatgaattgacaaagaatntgtcttatggacagcagagtcaggccacggcccctgtcctggtctatttagngaaggacaacgaaccgcccgtcgggactcccgtagacagtaccttctcgtcggcctacccgagtctacggacggggacctaacgggtcggccctaccgtttggaaccttacgtaccgacggggtcgggggaccccgtaggggttacgggaagggtagtagggaaagggtacgtaacgttaacttagtttacgttaacctcgtaccgaaggtaaggaaggggtagtggtacagttcgtaggttcggggttcggttacggggacgggtaacgggaaccgtacggtcggtaacggtacccggttaccgtaacgttccgaacgcccggaacggttccgttacccggtcccccgtacggtcctaccgttccgttacccgttccccttccccgttaacccg

SEQ ID NO: 369011 - DNA, 554 bp, Homo sapiens
  misc_feature: GZ8MTXP01AIJUW.8.1.A01.1.454.CMB.2.raw
  modified_base (217)..(217): a, c, t, g, unknown or other
  modified_base (294)..(294): a, c, t, g, unknown or other
  modified_base (467)..(467): a, c, t, g, unknown or other
  modified_base (470)..(470): a, c, t, g, unknown or other
  modified_base (474)..(474): a, c, t, g, unknown or other
  modified_base (485)..(485): a, c, t, g, unknown or other
  modified_base (547)..(547): a, c, t, g, unknown or other
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctgganatgaattgaccaaagaaatatgtcttattggtaccagcaagagtcgaggccacggcccctgtcctggtctatttagngaaggaacaaagaaaccgccccgtcgggactcccgtagaaccagtacctcgtcgcggcctaccccgagctacggacgggacagggtccgccctacgttgactacgtccgacggtcggggacccgagggtaggaggagtaggaagagtaactatattgtactctacagagaggntgnatgngtggtgtcggnggaggacagcgtgcgttacgacgcgacgccgacgccttccgccctcgctctcttccgtcccnccgtccg

SEQ ID NO: 369012 - DNA, 570 bp, Homo sapiens
  misc_feature: GZ8MTXP01CEQXX.8.1.A01.1.454.CMB.2.raw
  modified_base (289)..(289): a, c, t, g, unknown or other
  modified_base (370)..(370): a, c, t, g, unknown or other
  modified_base (519)..(519): a, c, t, g, unknown or other
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgaccaaagaatatgcttattggtaccagcagaagtcaggccacggcccctgtccgtggtctatttangacggacaagaaaccgacccgtcggactccctgacagactctctggctcccagctgagggacaagtcgcccacttgactancacggtcggggcccagggtggaggagtgaaggagtacttattattcgttactcgtaccaagagaaggggatggtcagtcgtagttgggtgttcgggcggaagggacgagcgtcgaccgttaccgtaacgcgtaccgccaacgggttccnccggtcccccgtcggtcctaccgttccgttccgttccccgccccttcccgg

SEQ ID NO: 369013 - DNA, 661 bp, Homo sapiens
  misc_feature: GZ8MTXP01AC2A7.8.1.A01.1.454.CMB.2.raw
  modified_base (217)..(217): a, c, t, g, unknown or other
  modified_base (514)..(514): a, c, t, g, unknown or other
tcagctcgcgtgtccacgaccggtgctcgatttagacgtctcatcaggggggtgggctcaggaggcagagctctgggaatctcaccatggcctggacccctctcctgcctccccctcctcactttctgcacagtctctgaggcctcctatgagctgacacagccaccctcggtgtcagtcgtcccaggacaaacggccagatcacctgctcgtgganatgaattgaccaaagaaatatgtcttatcggtaccagcagagtcaggccacggcccctgtcctggtctaatttacgaggtaacggaacaaaggaaacccggtccccgtaccggggaacttccccgtagaaccacggtaccttcgttacgcgggcctaccccggagtctaccggagggaccctaagggtcccgggtccctaccgttacgaactttacgccgtaacgggtcgggggacccgtagggtggaggagtaggaaggagtactatattgtactctacgagagaggggatggtanagtacgtaggttcgggtggttacgggacgggtacgggaccgtaacgcgtaacggaccgttaccgtacgttccgacggacccgacggccgttcccggtcccccgttcggtccctaccgtccgttcccggttccccgttcccgtccccg

SEQ ID NO: 369014 - DNA, 544 bp, Homo sapiens
  misc_feature: GZ8MTXP01A3Q4H.8.1.A01.1.454.CMB.2.raw
  modified_base (287)..(287): a, c, t, g, unknown or other
  modified_base (425)..(425): a, c, t, g, unknown or other
  modified_base (427)..(427): a, c, t, g, unknown or other
  modified_base (447)..(447): a, c, t, g, unknown or other
  modified_base (450)..(450): a, c, t, g, unknown or other
  modified_base (507)..(507): a, c, t, g, unknown or other
tcagctcgcgtgtccacgaccggtgctcgatttagacgtctcatcaggggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggcaggatcacctgctctggagatgaattgaccaaaagaaatatgcttattggtaccagcagaagtcaggccaggcccctgtctgtcatttangaggacaaagaaacgccctacgggactccctagacagactctctggctcccagctcaggggactaaagtcggcccaacctttgactaatcacgtgggggcccagggtggaggatgaaaggagaactatattagttacncncaagagaaggggatcggtanatntgtggtggtggcggaggacgacgcgtaacgacgttacgtacgacgacgaccgacgcnccgtcccgtccgtcgtctcttcctcccgttcccgtcc

SEQ ID NO: 369015 - DNA, 592 bp, Homo sapiens
  misc_feature: GZ8MTXP01DLXDR.8.1.A01.1.454.CMB.2.raw
  modified_base (232)..(232): a, c, t, g, unknown or other
  modified_base (281)..(281): a, c, t, g, unknown or other
  modified_base (287)..(287): a, c, t, g, unknown or other
  modified_base (321)..(321): a, c, t, g, unknown or other
  modified_base (399)..(399): a, c, t, g, unknown or other
  modified_base (420)..(420): a, c, t, g, unknown or other
tcagctcgcgtgtccacgaccggtgctcgatttagacgtctcatcagggggtgggctcaggaggcagagctctgggaatctcaccgatggcctggacccctctcctgctccccctcctcactttctgcacagtctctgaggcctctatgagctgacacagccacctcggtgtcagtgtccccaggacaaacggcaggatcacctgctctggagatgaattgaccaaagaatntgattatggtaccagcagaatcaggccaggtccctgtcctggtcatttngagganaagaaccgccgtcgggatccgtgacagactctgngcctccaggctcgaggacaagtcggccacttgactacgtcacggttcgggggacccagggtaggagtagaggaagganacttacttagttcgtacttcncgaagagaaggggtatggtactagtcgagtttgggtacgttacggggcgtaggggaaccaggtccgtaacgcccgttacttaaacgccgaacggcccttaacggccttacccggtcccccgtttacgggcctaacttcccggttacccgttttccccgaaccccgtttcccg

SEQ ID NO: 369016 - DNA, 751 bp, Homo sapiens
  misc_feature: GZ8MTXP01D1F8D.8.1.A01.1.454.CMB.2.raw
  modified_base (218)..(218): a, c, t, g, unknown or other
tcagctcgcgtgtccacgaccggtgctcgatttagacgtctcatcagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctgganatgtaattgaacaaaagtaaatatgtactttagttacggtaccagacaagaagtcgacggccacggtcccctgtcctggtactatttagagaaggaacaaacggaaaccgaccccgtaccgggacttcccagacagtaccttccgtcgtcggcctccccgacgcgtacgacgggacgtaacggtcgccctacttcgaacttacgtcgtacgggtcgggggacccgtaggggtagggaaggtagtaagggaaaggtacgtaacgttaacgtttagtttacgttaactaccgtaacgaaaggaacggtaaaggggtacgttacgggttactaacgttaccggttaaggtttcgggggtttcgggtttaccgggggacggggtaaccggggtaacccgtaacggtaccggtaaccggttaacccggttaccggtaaacggttccgaaccggtaccccggaacgggttcccgttaccccgggtcccccgttcggtccctacccgttcccgttcccggttcccccgccccgttccccg

SEQ ID NO: 369017 - DNA, 694 bp, Homo sapiens
  misc_feature: GZ8MTXP01BHVYG.8.1.A01.1.454.CMB.2.raw
  modified_base (298)..(298): a, c, t, g, unknown or other
  modified_base (326)..(326): a, c, t, g, unknown or other
  modified_base (329)..(329): a, c, t, g, unknown or other
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagcccaccctggtgtcagtcgtccccaggacaacggccaggatcacctgctcgtggagatgaaattgaaccaaagtaaatatgtacttagttaggaccaggcaagaagtcgagccgacggccctgtcctggtctatttanggagacaagaaccgacctcggactcctnacnactctctggcctcccgagtcgtacggacgggtactaacgggtccgccctacgtttacgaaccttacgtcccggaacgggttccggggggaaccccgtaggggttacggggaaagggtaaggtagggaaacgggtaacgtaacccgtttaaagttacgtttacgttaacctaccgttaacgaaagtaacgggtaaggggtaacggttcggtacacgttgtacggttgggtcgggtcgggacggggtaacggtaccgaacggcgtaacgacccgttacgtaacggttccgacggtacccgaggttcccgcccgtccccggttcgtaacctccggttccttacccggtttccccgccccgttaaccgg

SEQ ID NO: 369018 - DNA, 725 bp, Homo sapiens
  misc_feature: GZ8MTXP01BPOEK.8.1.A01.1.454.CMB.2.raw
  modified_base (213)..(213): a, c, t, g, unknown or other
  modified_base (287)..(287): a, c, t, g, unknown or other
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctggtgtcagtgtccccaggacaaacggcaggatcacctgctctgganatgaattgacaaagaaatatgcttattggtaccagcagaagtcaggccacggcccctgtcctggtctatttagngaggaacaaagaaccgacccgtccgggactcccgtagaacagtacctctcgtcggccttcccgagctacgacgggtacaacggtcggccctaccgttcgactactccgtacggtcgggggcccgagggtcggaggagtagggaaggtacgtaacttacgtttaattcggttaacctcgtaaccgtaagggtaacgggtaaaggggtagttacggggtactaacggtttccgttaaggggtttggggttacgggttacccgggggacggggtaaaccggggtaacccgtaaacgggtcccggttaacgggtaaccccggttaccggttaaacgttcccggaaccggtaccccggaacgggttcccgttccccggtaacccccgttcgggtaacccttcccgttccttacccccgggtaaccccttccccgttaaccccg

SEQ ID NO: 369019 - DNA, 570 bp, Homo sapiens
  misc_feature: GZ8MTXP02JPIIR.8.1.A01.1.454.CMB.2.raw
tcagctcgcgtgtccacgaccggtgctcgatttagacgtctcatcaggggtgggctcaggaggcagagctctgggaatctcaccatggcctggacccctctcctgctcccctcctcactttctgcacagtctctgaggcctcctatgagctgacacagccaccctcggtgtcagtgtccccaggacaaacggccaggatcacctgctctggagatgaattgaccaaagaatatgcttattggtaccagcagaagtcaggccaggcccctgtcctggtcatttatgaggacaagaaacgaccctcgggatccctgacagactctctggctcccagctcgagggacagtcgccacttgactatcacgtggggcccagggtggaggatgaaggagactactattgtactctcagagaaggatggtacatcagttggggtagttcgggacggacggggaaccaaggcgtacggacccggttacctaaacggtcaacggaccccgaaacgggtcctaccggccccccgttcgggtacctacccgttccgtccggtttacccccaccccttccccg

SEQ ID NO: 369020 - DNA, 653 bp, Homo sapiens
  misc_feature: GZ8MTXP02I4ZCG.8.1.A01.1.454.CMB.2.raw
  modified_base (290)..(290): a, c, t, g, unknown or other
  modified_base (373)..(373): a, c, t, g, unknown or other
tcagctcgcgtgtccacgaccggtgctcgatttagacgtctcatcagggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgaattgaccaaagaaatatgcttattggtaccagcagaagtcaggccaggcccctgtcctggtctatttangagacaaagaaaccgacccgtcgggactccctagacagactctctggctcccagctcgagggacaggtcgcctacttgactancacgtcggggcccagggtggaggagtaggaaggagtacttactagtttacgttactactaccgaagaaggtaaaggagttggtactaagtacgtaaggtttggggttcggttcggggacgggtaacggggaaccgaaacggccgttacggtacccggttaccgttaaacggtaccgaaccggaccccgtaaacgggtccccgttacccggccccccggttccgggttaccctacccgtttcccgtttacccggtttcccccggttacccctttcccccgg

SEQ ID NO: 369021 - DNA, 603 bp, Homo sapiens
  misc_feature: GZ8MTXP02IB93B.8.1.A01.1.454.CMB.2.raw
  modified_base (294)..(294): a, c, t, g, unknown or other
  modified_base (338)..(338): a, c, t, g, unknown or other
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagatgaattgaccaaaagaaatatgtcttattggtaccagcaagaagtcaggccacggccccctgtcctggtcatttangaaggacaaagaaaccgacccgtcgggatccctgacagactctnggctcccagcctcgagggacaggtcgcctacgttgacctatccacgtgggcccgaggtggaggagtaggaaggagtactacttagtttcgtactcgtacgagtaaggaaggagttaggtctagtcgtagttggggttcggttacggggcgggaaggggacccgaaaggccgttacggacccgttaccgtaaagtccgacggacccgaacggtccctccggcccccgttcggtaccaccgtccgtttccgttcccctaccgtcccg

SEQ ID NO: 369022 - DNA, 574 bp, Homo sapiens
  misc_feature: GZ8MTXP02JGW1T.8.1.A01.1.454.CMB.2.raw
  modified_base (285)..(285): a, c, t, g, unknown or other
  modified_base (313)..(313): a, c, t, g, unknown or other
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgaccaaagaaatatgcttatggtaccagcagaatcaggccaggcccctgtcctggtcatttangaggacaagaaaccgccctcggatcccngacagactctctggctcccagctcgaggggacagtcggcctaccttgactatcgacgtcgggggcccagggtggaggagtaggaaagggagtactacgttattcgtaactctaccagaggaaggatggtacagtcaagttggggtggttcgggacgggacgggaccaaggcctacggacccgtaccgtaaacgtccaacggcccgaacggtcctaccggccccctcgggacctacctccgtccgttcccccgccctacccg

SEQ ID NO: 369023 - DNA, 556 bp, Homo sapiens
  misc_feature: GZ8MTXP02I5JL9.8.1.A01.1.454.CMB.2.raw
  modified_base (286)..(286): a, c, t, g, unknown or other
  modified_base (367)..(367): a, c, t, g, unknown or other
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgaccaaagaatatgcttattggtaccagcagaagtcaggccaggcccctgtcctggtcatttangaggacaagaaacgacccgtcggatccctagacagactctctggcctcccagctcgaggggacaggtcgccacttgactancgacgtcggggcccgagggtggaggagtaggaaaggagactactattagttactctaccgagaagaggagtggtacatacagttgggtggttcgggcgggtagggacgaagcgtacggaccgtacgtaacgtcacgacccgaaggcctacgcccccgtcggtcctactccgtccgttcccaccctcccg

SEQ ID NO: 369024 - DNA, 556 bp, Homo sapiens
  misc_feature: GZ8MTXP02IZAO9.8.1.A01.1.454.CMB.2.raw
  modified_base (288)..(288): a, c, t, g, unknown or other
  modified_base (421)..(421): a, c, t, g, unknown or other
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgaccaaagaaatatgcttattggtacagcagaagtcaggccaggcccctgtccctggtctatttangaggacaaagaaacgaccctcgggatccctgacagactctctggctcccgagctcgagggacagtcgccacttgactatcgacgtcggggcccagggtggaggagtggaaaggagaactacttattgttactntccgagagaaggatggtcatcgagttgggtggttcgggcggtaggaccgaagctacggaccgtactaaacgtcacgcccgaaggtccctcgcccccgttcggtcctaccgtccgtcccgttccctaccctccccg

SEQ ID NO: 369025 - DNA, 614 bp, Homo sapiens
  misc_feature: GZ8MTXP02JNIS2.8.1.A01.1.454.CMB.2.raw
  modified_base (292)..(292): a, c, t, g, unknown or other
tcagctcgcgtgtccacgaccggtgctcgatttagacgtctcatcagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagatgaattgaccaaaagaatatgtcttatggtacagcagaagtcaggccacggcccctgtcctggtctatttagngaggacaaagaaaccgcccgtcgggactccctagacagactctcgtcggctcccgagcctacgaggggacaggtcgcctacgttagacttacgcgacggtcggggacccgagggtcggaaggataggaaaggagtaacttactatttcgttactccgtacgaggtaagaaggtagtagtactagtacgtagttgggtcgggttcgggacgggtacgggaccgaagtcgtacggtacccgtacgtaacggtccaacggtacccgaacggtccacccgtccccgtacggtcctaccgtccgttccgttcccccgcccgtacccg

SEQ ID NO: 369026 - DNA, 616 bp, Homo sapiens
  misc_feature: GZ8MTXP02IOTG7.8.1.A01.1.454.CMB.2.raw
  modified_base (283)..(283): a, c, t, g, unknown or other
tcagctcgcgtgtccacgaccggtgctcgatttagacgtctcatcagggggtgggctcaggaggcagagctctgggaatctcaccatggcctggacccctctcctgcctccccctcctcactttctgcacagtctctgaggcctcctatgagctgacacagcccaccctcggtgtcagtcgtcccaggacaaacggcaggatcacctgctctggagatgaattgacaaagaatatgcttatggacagcagagtcaggccaggcccctgtcctggtctatttangaagaacaaagaaaccgaccccgtcgggactccccgtagaaccagtactcctcgtcggcctccccgagcctcggaaggggacacggtcgcctacgttagaccttacgcgacggtcggggacccgaggggtacggaggagtaggaaaggacgtacttactagtttacgtactcgtacgaaaggagaaggtattggtactagtacgtaggtttgggtacggttacggggacggtaacggacgaacgcgtacgtacccgtacgtaacgcgaccggtaccgaacggtccctcccgtccccgtcgtacctaccgttcctaccgttaccccaccctccg

SEQ ID NO: 369027 - DNA, 642 bp, Homo sapiens
  misc_feature: GZ8MTXP02F1VPC.8.1.A01.1.454.CMB.2.raw
  modified_base (291)..(291): a, c, t, g, unknown or other
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagatgaattgaccaaaagaatatgcttatggtaccagcaagaagtcgaggccacggcccctgtcctggtcatttangaggaacaagaaccgcccgtcggactccccgtagacagactctctggcctcccgagcctacgaggacaggtcggcctacgttgactatccacggtcggggacccgtaggggtacgggaggagtaggaaagggtacgtaacgttacgttaacgtttacgttaacctccgtacccgaaagggtaaggaaagggtagttagggtacctaagttcgtaaggtttgggggttacggttcggggacggggacgggaaccgaggcgtacggtacccgttacgtaacgtcgaacgcccgtaaacggccgtaccgcccccgtcggtcctaccgtccttaccgttacccccacctaccccg

SEQ ID NO: 369028 - DNA, 678 bp, Homo sapiens
  misc_feature: GZ8MTXP02JI8MJ.8.1.A01.1.454.CMB.2.raw
  modified_base (215)..(215): a, c, t, g, unknown or other
  modified_base (287)..(287): a, c, t, g, unknown or other
  modified_base (369)..(369): a, c, t, g, unknown or other
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctgganatgaattgaccaaagaatatgcttattggtaccagcagaagtcaggccacggcccctgtcctggtcatttangaggacaagaaccgcccgtcgggatcccctgacagactctctcggctcccgagctcgagggcaggtcgcccacttgactacncgacgtcggggacccgagggtcggaggacgtaggaaggtacgtacttacgttatttacggttaacctacgtaccgtaaggaaggtaaagggtagttacgggtacctagttaccgtaagggtttcgggggttacgggttacgggggtacggggaacggggtaacccggtaaaggtcccgttaccgggtacccggttaccggttaaacggtaccgtaaccggaccccggtaaacgggtcccgttacccggcccccggttaccggtacccgtaccgttaccgtcccggtttaccccctaccccgttaccccg

SEQ ID NO: 369029 - DNA, 635 bp, Homo sapiens
  misc_feature: GZ8MTXP02HRDUM.8.1.A01.1.454.CMB.2.raw
  modified_base (285)..(285): a, c, t, g, unknown or other
  modified_base (346)..(346): a, c, t, g, unknown or other
tcagctcgcgtgtccacgaccggtgctcgatttagacgtctcatcagggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgaattgacaaagaaatatgcttatggtaccagcagagtcaggccaggcccctgtctggtcatttangagacaagaaaccgcccgtcggactccctgacagactctcgtgctcccagctcgagggacnggtcgccctacgtttgacttagtccgacggtcggggacccaggggtcggaaggtagtagggaaacggaacgtaacgttaaaccgtttagttttacggttaaccgttccgtaaccgaaaggtaaggtaaacgggtagttggtactaagttcgtaaggtttggggtacggttcggggacgggtaacgggaaccgaaggccgtacggacccgttacgtaacgacgacgaccgaacggtccgtccgaaccccgttcggtacctaccgtccttcccggtcccctcccgtacccg

SEQ ID NO: 369030 - DNA, 626 bp, Homo sapiens
  misc_feature: GZ8MTXP02HZNYH.8.1.A01.1.454.CMB.2.raw
  modified_base (292)..(292): a, c, t, g, unknown or other
  modified_base (359)..(359): a, c, t, g, unknown or other
tcagctcgcgtgtccacgaccggtgctcgatttagacgtctcatcagggggtgggctcaggaggcagagctctgggaatctcaccatggcctggacccctctcctgcctcccccctcctcactttctgcacagtctctgaggcctcctatgagctgacacagcccaccctcggtgtcagtgtccccaggacaaacggccaggatcacctgctctggagatgaattgaccaaagaaatatgcttatggtaccagcagaagtcaggccacggcccctgtccctggtctatttangaggaacaaagaaaccgcccgtacggactcccgtgacagactctcgtggctcccagcctcgaggacnggtcgcctacgttgactatcgacgtcggggacccagggtggaggagtaggaaggaagtaactacgttagtttacgttactctactaaaggagaaacggtagtcggtactaagttcgtaaggtttggggtacggtttcggggacggggtaacgggaaccgtaaaggtccgtacggaccggttaccgtaaacgtccgaacgcccgaaacggtcccgtaccgtaacccccgtcggtaccctacgttcctcccgtttccccaccccttccg

SEQ ID NO: 369031 - DNA, 622 bp, Homo sapiens
  misc_feature: GZ8MTXP02GXWU2.8.1.A01.1.454.CMB.2.raw
  modified_base (289)..(289): a, c, t, g, unknown or other
tcagctcgcgtgtccacgaccggtgctcgatttagacgtctcatcagggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgaattgaccaaaagaaatatgcttattggtaccagcagaagtcaggccaggcccctgtcctggtcatttangaggacaagaaaccgccctcgggactccctgacagactctctggctccccagctcgagggacagtggcccacttgactatcgacgtcgggggcccagggtggaggagtggaaaggagtaactactatttcgttactctaccgaagagaaggatggtacatcgagtttggggtaggtttcggggacggggtaacgggaccgaaaggtccgttacggaaccccggttaccgtaaacggtaccgaacggaccccgaaacgggcccgttaccggcccccccgttcgggtacccctaccgttcccgttacccggtttcccccctaaccccttcccccg

SEQ ID NO: 369032 - DNA, 691 bp, Homo sapiens
  misc_feature: GZ8MTXP02F54ZZ.8.1.A01.1.454.CMB.2.raw
  modified_base (290)..(290): a, c, t, g, unknown or other
  modified_base (330)..(330): a, c, t, g, unknown or other
tcagctcgcgtgtccacgaccggtgctcgatttagacgtctcatcagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctctggagatgaattgaccaaagaatatgcttatggtaccagcaagaagtcaggccaggcccctgtcctggtctatttangagacaaagaacgacccgtcggactccctagacagactcnctggcctcccgagcctacgaacgggacaggtcggcccacttgaactatcacgtcggggacccagggtggagagtaggaaaggagtaactacttagttacgttactacgtacaaaggaacggaaaggtagtgggtacctaagttccgtaaagggtttggggttacgggtttacggggacgggggtaacggggaaacccgtaaacgggtaccgttacggtaaccccggttaaccgtttaaacggtaccgaaaccgggtaccccgaaaacggggtccctaaccccggtcccccccggtttacgggttccctaaccccgttcccggtttaccccgtttaccccccgtaaccccctttacccccgg

SEQ ID NO: 369033 - DNA, 548 bp, Homo sapiens
  misc_feature: GZ8MTXP02J09B1.8.1.A01.1.454.CMB.2.raw
  modified_base (290)..(290): a, c, t, g, unknown or other
  modified_base (438)..(438): a, c, t, g, unknown or other
tcagctcgcgtgtccacgaccggtgctcgatttagacgtctcatcagggggtgggctcaggaggcagagctctgggaatctcaccatggcctggaccccctctcctgctccccctcctcacttttctgcacagtctctgaggcctcctatgagctgacacagccaccctcggtgtcagtgtccccaggacaaacggccaggatcacctgctctggagatgaattgaccaaagaatatgcttattggtaccagcagaagtcaggccaggccccctgtccctggtcatttangaggacaagaaacgaccctcgggatccctgacagactctctggcctccccagctcgagggacagtggcccacttgactatcacgtcggggcccagggtggaggataggaaggagactactattgttactctacagagaaggatcggtnatcgtagttggggttgttcgggcggagggaccaaagctacgacccgtcaaacggtcacgcccgaacgccgtccgcccccgtcggtccacttcctcggtccccaccctccg

SEQ ID NO: 369034 - DNA, 569 bp, Homo sapiens
  misc_feature: GZ8MTXP02FMLIT.8.1.A01.1.454.CMB.2.raw
  modified_base (214)..(214): a, c, t, g, unknown or other
  modified_base (286)..(286): a, c, t, g, unknown or other
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcactgctctgganatgaattgaccaaagaatatgtcttatggaccagcagaagtcaggccacggcccctgtcctggtctatttangaggacaaagaaccgacccgtcggactcccgtagacagacctctctggcctcccagctcgagggacaggtcgccctacttgactagtcacggtcggggcccagggtggaggagtaggaaggagactacttattgttactctacgaagagaaggagtggtactatcgtagttggggtcgttcgggacggagggaccgaagcgtacgaccgtacctaagtccgacgacccgaacgccgtaccgcccccgttcggtacctacctcgttaccgtcccccacctcccg

SEQ ID NO: 369035 - DNA, 643 bp, Homo sapiens
  misc_feature: GZ8MTXP02GBL2A.8.1.A01.1.454.CMB.2.raw
  modified_base (219)..(219): a, c, t, g, unknown or other
  modified_base (291)..(291): a, c, t, g, unknown or other
tcagctcgcgtgtccacgaccggtgctcgatttagacgtctcatcagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatccacctgctctgganatgaattgaacaaagaatatgcttattggtaccagcagaagtcaggccacggcccctgtcctggtctatttngagaacaaagaaaccgacccgtcggactcccgtgacagacctcgtcgtcggcctccccgagccgtacgaacggggacacggtcggccctaccttgaaccttatccgacggtcgggggcccgaggggtcggaggagtaggaaggtacgtaacttacgttagtttacgttacctacgtaccgaaggaaggtaaaggtagtaggtactaagtacgttaggtttggggttgttacggacgagggaacggaaccgagtcgtacgaacccgttacgtaacgaccgaccgacccgtaaggtcccgtaacccgtcccccgttcggtaccctccgttccgttccggtttccccgtcccccg

SEQ ID NO: 369036 - DNA, 544 bp, Homo sapiens
  misc_feature: GZ8MTXP02JBEC4.8.1.A01.1.454.CMB.2.raw
  modified_base (292)..(292): a, c, t, g, unknown or other
  modified_base (468)..(468): a, c, t, g, unknown or other
tcagctcgcgtgtccacgaccggtgctcgatttagacgtctcatcagggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgaattgaccaaagaatatgcttattggtaccagcaagaagtcaggccacggcccctgtcctggtctatttagngaggacaaagaaccgaccctcggatcccgtgacagactctctggcctcccagctcgagggacaggtcgccctacgttgactagtcacgtcggggcccaggtggaggagtaggaagagactacgtattacgttactctacgagaagaaggatggtacagtcgtagttggtagtcggnggaggacagctacgaccgtacgtacgcacgccgaacgcctccgccccgtcggtccactcgtccgtcccaccctccg

SEQ ID NO: 369037 - DNA, 610 bp, Homo sapiens
  misc_feature: GZ8MTXP02I2RV8.8.1.A01.1.454.CMB.2.raw
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctctggagatgaattgaccaaagaaatatgacttattggtaccagcagaagtcaggccaggcccctgtcctggtctatttatgaggaacaaagaaaccgacccgtcgggaactcccgtagacacgactcgtctggcctcccgagctacgagggacaggttcgcctacgtgactatcgacgtcgggcccgaggtggagagtagaaggagactacgtattcgtactcgtacgaagagaaggagtggtactagtcgtaggttgggtaggttcgggacgggacgggtacgagtccgtacggtacccgttacgtaacgtaccgaaccggtacccgaacggtcccgtaccgccccccgtacggtaccctaccgtcccgtttcccgtcccccgtcccctttaccccgg

SEQ ID NO: 369038 - DNA, 610 bp, Homo sapiens
  misc_feature: GZ8MTXP02IAZNW.8.1.A01.1.454.CMB.2.raw
  modified_base (291)..(291): a, c, t, g, unknown or other
tcagctcgcgtgtccacgaccggtgctcgatttagacgtctcatcagggggtgggctcaggaggcagagctctgggaatctcaccatggcctggaccccctctcctgcctcccccctcctcactttctgcacagtctctgaggcctcctatgagctgacacggccaccctcggtgtcagtgtccccaggacaacggccaggatcacctgctctggagatgaattgaccaaaagaaatatgcttattggtaccagcagagtcaggccacggcccctgtcctggtctatttangaggaacaagaaaccgcccgtaccggatccccgtagacagactctcgtcggcctccgagctacgagggacaggtcggccctctgactacgtcgacgtcgggggacccagggtcgggaggagtaggaaacggacggaacttacttagtttacgttaacctcgtaccgaagaaggaaggtagttagggtactaagtcgtaaggttggggtacggttcgggacgggacgggtaccgaggtacgtcgtacccgtacttacggacacggaccgaacgccgtccgccccgtcggtcaccttctccgttccccaccgttccacccg

SEQ ID NO: 369039 - DNA, 533 bp, Homo sapiens
  misc_feature: GZ8MTXP02GAUTN.8.1.A01.1.454.CMB.2.raw
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgaccaaagaaatatgcttattggtaccagcagaagtcaggccaggcccctgtcctggtctatttatgaggacaaagaaacgaccctcgggatcccctgacagctctctggctcccagctcgaggggacaggtcgccaccttgactatcacgtggggcccagggtggaggagtagaaggagactactattgttactctcagagaagatgtcatcgtagtggggtgtcggcggaggacaagtcgtacgaccgtctaagtcgacgtaccgaacgcctacgccccgtacggctacgtctcgttcccaccttcccg

SEQ ID NO: 369040 - DNA, 645 bp, Homo sapiens
  misc_feature: GZ8MTXP02H2NT3.8.1.A01.1.454.CMB.2.raw
  modified_base (220)..(220): a, c, t, g, unknown or other
  modified_base (238)..(238): a, c, t, g, unknown or other
  modified_base (257)..(257): a, c, t, g, unknown or other
  modified_base (285)..(285): a, c, t, g, unknown or other
  modified_base (334)..(334): a, c, t, g, unknown or other
  modified_base (355)..(355): a, c, t, g, unknown or other
tcagctcgcgtgtccacgaccggtgctcgatttagacgtctcatcagggggtgggctcaggaggcagagctctgggaatctcaccatggcctggaccccctctcctgcctcccccctcctcactttctgcacagtctctgaggcctcctatgagctgacacagcccaccctcggtgtcagtcgtccccaggacaaacggccaggatcacctgctctgganatgaattgacaaagaatntgcttatgtaccagcagancaggccacggccctgtcctgctatttangagacaaagaacccgacccgtcgggactcccgtagacagtacctctcgnggcctccagcctcgagggacnggtccgcctacttgaaccttcgcgaccggtcggggacccgtagggtaggaggagtaggaagagtactacgttattacgtactctacgaaaggtagtaaaggtagttaggtactagttacgtagggttggggtacggttacggggcgggaaacggggtaccaaaggtccgtaccggtaaccgttaccgttaaacggcccgtaaaccgacccgtaaacggtcccgtcccggtaacccccgttcgggtacccttacccgtccgtttccccgttacccctaacccccgttcccg

SEQ ID NO: 369041 - DNA, 660 bp, Homo sapiens
  misc_feature: GZ8MTXP02HDXIN.8.1.A01.1.454.CMB.2.raw
  modified_base (289)..(289): a, c, t, g, unknown or other
tcagctcgcgtgtccacgaccggtgctcgatttagacgtctcatcagggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctctggagatgaattgaccaaagaatatgcttatggtaccagcaagaagtcaggccacggcccctgtcctggtcatttangagacaagaaccgcccgtcggatcccgtagaccagtacctctcgtcggtcctccccgagtcctcggacggggtacaggtcggccctaccttgacctagtccgacggtcgggggaccctaggggtggaaggagtaggaaacggagtacttaagttagtttacgttaacctcgtaccgaaggaacggtaaggtagtacggtactagttcgtaggttggggtacggttacgggacgggacgggaacctaaggtccgttacggaacccgttacgtaaacggtaccgaaaccggtaccccgaaacgggtccccttcccggcccccgttacggtccctaccgttcccgttccccgttcccccggccccttaaccccg

SEQ ID NO: 369042 - DNA, 610 bp, Homo sapiens
  misc_feature: GZ8MTXP02FMKXW.8.1.A01.1.454.CMB.2.raw
  modified_base (376)..(376): a, c, t, g, unknown or other
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgaccaaaagaaatatgcttattggtaccagcagaatcaggccagggcccctgtcctggtctatttatgaggaacaagaaaccgacccgtccgggatcccctagacagacctctctggctcccgagcctgaggggacaggtcgccacttgactancacgtcggggcccagggtggaggagtaggaaggagactacttattacgttactctacgaagaaggaaaggtagtgggtactagtacgtaggttgggttaggttcgggacgggaacgggaccgaacggtcgtacggtaacccgttaccgtaacgtaccgacggacccgaaacggtcccgtaccggcccccgttccgggtacctaccgttccgttaccgttccccctaccttcccg

SEQ ID NO: 369043 - DNA, 602 bp, Homo sapiens
  misc_feature: GZ8MTXP02ITTMX.8.1.A01.1.454.CMB.2.raw
  modified_base (302)..(302): a, c, t, g, unknown or other
  modified_base (403)..(403): a, c, t, g, unknown or other
tcagctcgcgtgtccacgaccggtgctcgatttagacgtctcatcagggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacgcaggatcacctgctcgtggagatagaattgaaccaaaagaaatatgtacttagttggtaaccagcaagaagtcgacggccacggcccctgtccgtggtactaatttanaggaaggaacaaaggaaaccgtaccccgtacggactcccgtagacagtactctcgtcggtcctaccccgagctcgaacggcaggtcgcctacttgaactanccgacggtcgggacccagggtggagtagaggaaaggagacttactattacgttactacctacgaaagacggaaagtagtggtacagtcgtaggttgggtacggttcgggacgggaggaaccgagcgtacggaccgttacgaacgtcgacgacccgaacgcctccgccccgttgcctacgtctacccgtcccacctcccg

SEQ ID NO: 369044 - DNA, 745 bp, Homo sapiens
  misc_feature: GZ8MTXP02HA8WK.8.1.A01.1.454.CMB.2.raw
  modified_base (216)..(216): a, c, t, g, unknown or other
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctgganatagaattgaccaaagaaatatgcttattggtaccagcaagaagtcgaggccacggcccctgtcctggtctatttagtaggaaggaacaaacgaaaccgaccccgtaccgggaactcccgtagaccagtacctactcgtcggtcctaccccgacgcctacgaaggggtacaggtccggaccccgttaccgtttcggaaaccttacgtacccgtaccggtaccgggggtaccccgaagggggttacgggaaaggaagtaacggggaaaggacgtaacgtttaaccgttaagttttacggttaacctacgttaacccgaaaggtaagggtaaaggtaagtttcgggtactacggttacttaaggggtttacggggttcgggttaccggggacggggaacggggtaacaacggtcgttaacggacccgttactaaacggtcgaaccggtacccgaacggtcccgttaacccggtcccccgttcggtaaccctaccgttccctttacccggttaccccctacccgtttccccg

SEQ ID NO: 369045 - DNA, 619 bp, Homo sapiens
  misc_feature: GZ8MTXP02JJOHK.8.1.A01.1.454.CMB.2.raw
  modified_base (293)..(293): a, c, t, g, unknown or other
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagatgaattgaccaaaagaaatatgacttatggtaccagcaagaagtcaggccacggcccctgtcctggtctatttagngaggaacaagaaaccgacccgtccgggactccccgtagacagactctcgtggcctccccgagcctcgagggcaggtcgcctacttgacttagcgacgtcggggacccagggtcggaggagtaggaaggaagtactacgtagtttacgttactctacgaagaaggaacggtagtggtacagttacgtaggtttggggtcggttcggggacgggagggaaccaaggtcgtacggacccgttacgtaaacggtcgacgacccgaacggtccgtacccggcccccgttacggtcctacccgttcctacccggtttcccccaaccctcccg

SEQ ID NO: 369046 - DNA, 591 bp, Homo sapiens
  misc_feature: GZ8MTXP02FGPV5.8.1.A01.1.454.CMB.2.raw
  modified_base (216)..(216): a, c, t, g, unknown or other
  modified_base (236)..(236): a, c, t, g, unknown or other
  modified_base (288)..(288): a, c, t, g, unknown or other
  modified_base (312)..(312): a, c, t, g, unknown or other
  modified_base (324)..(324): a, c, t, g, unknown or other
tcagctcgcgtgtccacgaccggtgctcgatttagacgtctcatcagggggtgggctcaggaggcagagctctgggaatctcaccatggcctggaccccctctcctgcctcccccctcctcactttctgcacagtctctgaggcctcctatgagctgacacagccaccctcggtgtcagtcgtcccaggacaaacggcaggatcactgctctgganatgaattgaccaaagaatangtcttattggaccagcagaagtcaggccacggcccctgtcctggtcatttangagacaagaacgcctcggatcccngaccagtactcntggcctccccagctcgagggacaggtcgcccacgttgacttatcgacggtcggggcccagggtggaggagtaggaaggagtactacttagttacgttactcctaccgaagtaggaaaggtataggtacagtcgtagtttgggggtaggttcggggacgggacgggaaccgaagcgtacggtaccgtaccgtaacgtccgaccgacccgaacggccgtacccgcccccgtcggtaccaccttccctaccgttcccccaccccgtcccg

SEQ ID NO: 369047 - DNA, 716 bp, Homo sapiens
  misc_feature: GZ8MTXP02GJYXN.8.1.A01.1.454.CMB.2.raw
  modified_base (463)..(463): a, c, t, g, unknown or other
tcagctcgcgtgtccacgaccggtgctcgatttagacgtctcatcagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaacggccaggatcacctgctcgtggagatgtaattcgaaccaaaagaaattatgtacttagttccggtaaccagacaggaagtcgacggtccacggtcccctgtcccgtggtctaagttttagaggaacggtaaaccaaacggaaacccggtaccccgtaccggggaacttccccggtagaaccgtaacggtaccttccgtcggtacggtccttaccccgacggtcctacggaacggggacctagggtccggacctaccgtttagacttacncgtacgggtcggggacccgtaggggtggaaggtagtaggaaaggacgtactacgttattcgttaactccgtacgaaggaagtaaggacgttagggtactagttctaggtttgggtggtttcggggaacgggacggtaacgaacggtccgtacggtaacccgtacgtaacgtaccgaccgtacccgaacggcccgttacccggccccgttacggtaccctaccgtcccgttacccgttccccgaccctttcccg

SEQ ID NO: 369048 - DNA, 589 bp, Homo sapiens
  misc_feature: GZ8MTXP02IXIUQ.8.1.A01.1.454.CMB.2.raw
  modified_base (287)..(287): a, c, t, g, unknown or other
  modified_base (332)..(332): a, c, t, g, unknown or other
  modified_base (352)..(352): a, c, t, g, unknown or other
  modified_base (370)..(370): a, c, t, g, unknown or other
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagcccaccctggtgtcagtcgtccccaggacaaacggccaggatcacctgctctggagatgaattgaccaaagaatatgcttatggtaccagcagaatcaggccacggcccctgtcctggtctatttangaggacaaagaaaccgacccgtcgggactcccagacagactctcnggcctcccagctcgaggacngtcgccaccttgactacncgacgcggggtcccgaggtggaggagtaggaacggagtactacgttattacgttactacctacgaacgtaaggaaagggagttacggtactatacgttaaggttgggttgggttcgggacgggacgggaacgaacgcgtacgaccgtaccgtaacgtacgacgaccgaacggtcctacgcccccgtcgtccgtacctcctcccgttcccaccctacccg

SEQ ID NO: 369049 - DNA, 616 bp, Homo sapiens
  misc_feature: GZ8MTXP02HPSLZ.8.1.A01.1.454.CMB.2.raw
  modified_base (295)..(295): a, c, t, g, unknown or other
tcagctcgcgtgtccacgaccggtgctcgatttagacgtctcatcagggggtgggctcaggaggcagagctctgggaatctcaccatggcctggacccctctcctgcctccccctcctcactttctgcacagtctctgaggcctcctatgagctgacacagcccaccctcggtgtcagtcgtcccaggacaaacggccaggatcacctgctctggagatgaattgaccaaaagaaatatgacttattggtaccagcaagaagtcgaggccacggcccctgtcctggtctatttangaagacaaagaaaccgacccgtacggactccctagacacgtactctcgtcggctcccgagctcgaacgggacacgcggtcctaccgttagactacgtcacggtcggggcccgtaagggtggaaggagtacggaaagggataaacgttacgtatttacgtactcgtacgaaagagaaaggtagtaggtacagtactaggttcggggtggtacgggacgggacggaacgaacgtcgtacggacccgtataaacgccgacgacccgaacggccctaccggcccccgtcggaccctacgtcccttcccgttccccacccctaccg

SEQ ID NO: 369050 - DNA, 614 bp, Homo sapiens
  misc_feature: GZ8MTXP02FRZ9U.8.1.A01.1.454.CMB.2.raw
  modified_base (214)..(214): a, c, t, g, unknown or other
  modified_base (233)..(233): a, c, t, g, unknown or other
  modified_base (236)..(236): a, c, t, g, unknown or other
  modified_base (282)..(282): a, c, t, g, unknown or other
tcagctcgcgtgtccacgaccggtgctcgatttagacgtctcatcagggggtgggctcaggaggcagagctctgggaatctcaccatggcctggacccctctcctgcctccccctcctcactttctgcacagtctctgaggcctcctatgagctgacacagccaccctggtgtcagtgtcccaggacaaacggccaggatcacctgctctgganatgaattgaccaaagaatntgnttagtgtacagcagatcagccacggcccctgtcctggtctatttangaggacaaaggaaaccgaccccgtcggactccctagaccagtactctcgtcggtctcccacgtctacgacgggactaggtccgccctacgttcgaacttactccgtacgggtggggacccctaggggtggaaggtagaggaaacggagtaactacttagtttacgtactacctacgaaagaggaaggtactggtacagtcgtagtgggttagtcgggaggtacggaactacggcgtacgaccgtacgtaacgtaccgaccgtaccgaaaccggtccgtacccgccccgttacgtacccgtactcccgttccgtccccctaacccgttccccg

SEQ ID NO: 369051 - DNA, 633 bp, Homo sapiens
  misc_feature: GZ8MTXP02JX4L6.8.1.A01.1.454.CMB.2.raw
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctcttgagatgaattgaccaaagaaatatgcttattggtaccagcagagtcaggccaggcccctgtcctggtctatttagtgaggaacaaaggaaaccgaccccgtcggggaactccccgtagacagactctctggcctccccgagcctacgacgggacaggtcgccctacttgactatcgacgtcgggggcccaggggtggaacggtagtaggaaaggacgtaactaacgttagtttagtactccttaccgaaaggaaggaaagggtagtggtacaacgttacgtaagtttggtcgggttcgggttcgggacggggaacgggaaccaaaggtccgtacggtacccggtccgtaaaacggtcgaaccgacccgaaggtcctaaccgccccgttacggtcctaccgtcctccgttccccacccccg

SEQ ID NO: 369052 - DNA, 726 bp, Homo sapiens
  misc_feature: GZ8MTXP02I6N6Y.8.1.A01.1.454.CMB.2.raw
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctcgtggagatgtaattgaccaaaagaaattatgtctttaagttcggtaaccagacaagaagtcgacggccacggccccctgtcctggtactatttagtggagaacaaacgaaaccgaccccgtaccggactcccgtagaccacgtacctaccgtcgtcggacctccccgagtccgtacggacgggactaggtccggcccgtaccttgaaccttacgtaccgacgggtcgggggacccgtaggggtaggggaacggagtacgggaaaggtacgtaacgttacgttacgtttacgttaacctaccgtaccgaaggtaaacggtaaagggtacgttacgggtacttagttaccgttagggtttcggggtttacgggttcggggacggggtaacgggtaaccgaacggtccgtaccggtaacccgttcgtaaacggttaccgaccggacccgtaacggtccgtaccccgcccccgttacggtacctccgttacccgtcccgttacccctacccgtccccg

SEQ ID NO: 369053 - DNA, 539 bp, Homo sapiens
  misc_feature: GZ8MTXP02III30.8.1.A01.1.454.CMB.2.raw
  modified_base (283)..(283): a, c, t, g, unknown or other
tcagctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgaccaaagaatatgcttatggtacagcagagtcaggccaggcccctgtcctggtcatttangaggacaagaaaccgccctcggatcccctagacagactctctggcctcccagctcgagggacagtcggccacttgacctatccacgtcggggcccgaggtggaggagtagaaggagactactagttcgttactactcagtagaaggagtagtcatacagttggttaggttcggtagggacggacgaagcgtacgaccgtacctaacgtacacgccgaacggctccgcccgtcgtcactctcgtcccgtccctcccg

SEQ ID NO: 369054 - DNA, 591 bp, Homo sapiens
  misc_feature: GZ8MTXP02G3TG9.8.1.A01.1.454.CMB.2.raw
  modified_base (218)..(218): a, c, t, g, unknown or other
  modified_base (296)..(296): a, c, t, g, unknown or other
  modified_base (315)..(315): a, c, t, g, unknown or other
tcagctcgcgtgtccacgaccggtgctcgatttagacgtctcatcagggggtgggctcaggaggcagagctctgggaatctcaccatggcctggaccccctctcctgcctcccccctcctcactttctgcacagtctctgaggcctcctatgagctgacacagccaccctcggtgtcagtgtccccaggacaaacggccaggatcacctgctctgganatgaattgaaccaaaagaaatatgtacttaagtggtaaccagcaagaagtcaggccaggcccctgtcctgctatttangaggacaaagaaaccgccncggatcccgtagacagactctacgtggcctcccagctacgacggggacaggtcgcctacttcggaacctagttcccaacggtcggggacccgaggtaggaaggagtaggaaacggagtactaacttattacgttactctacgaaagagaaagacgtgtacagtcaggttggtaggttcgggacgggtaggaacgaagtctacgtaccgtacgtaacggcacgaccgtacggccgttaccgccccgttcggcctactcgtccgtcccgtccctcccg

SEQ ID NO: 369055 - DNA, 616 bp, Homo sapiens
  misc_feature: GZ8MTXP02IRFQP.8.1.A01.1.454.CMB.2.raw
  modified_base (293)..(293): a, c, t, g, unknown or other
tcagctcgcgtgtccacgaccggtgctcgatttagacgtctcatcagggggtgggctcaggaggcagagctctgggaatctcaccatggcctggacccctctcctgcctcccccctcctcactttctgcacagtctctgaggcctcctatgagctgacacagcccaccctcggtgtcagtcgtccccaggacaaacggccaggatcacctgctctggagatgaattgaccaaagaatatgcttattggtaccagcagaagtcaggccacggcccctgtcctggtctatttagngaggaacaaagaaaccgccccgtcgggactccctagacagactctcgcggctcccgagctcgaggacaggtcgcctacttgactcgtcacggtcggggcccgagggtggaggagaggaaaggagtactacttatttcgttaactctacgaggaagaagtagtggtctacgtcgtaaggttggggttacggttcggggacgggtagggaaccgtaaggccgtacggtaccgtaccgtaaggtaccgaacggacccgaacggccgtcccggtaacccccgttcggtacctaccttcccgttcccgtttccccgccccgttacccg

SEQ ID NO: 369056 - DNA, 661 bp, Homo sapiens
  misc_feature: GZ8MTXP02HWION.8.1.A01.1.454.CMB.2.raw
  modified_base (295)..(295): a, c, t, g, unknown or other
  modified_base (328)..(328): a, c, t, g, unknown or other
tcagctcgcgtgtccacgaccggtgctcgatttagacgtctcatcagggggtgggctcaggaggcagagctctgggaatctcaccatggcctggacccctctcctgcctcccccctcctcactttctgcacagtctctgaggcctcctatgagctgacacagccaccctcggtgtcagtgtccccaggacaaacggccaggatcacctgctctggagatgaattgaccaaagaaatatgcttagttggtaccagcaagaagtcaaggccacggccccctgtccctggtcatttangaggacaaagaaaccgaccccgtcggactcccngacagactctctggcctcccagcctacgacggggacaggttcggccctacgttagacttacgtaccacggttcggggccccgagggtggaggagtaggaaaggagtacgtacttagtttacgttactcgtaccgaaggaaggtaaaggtagttggtactagtacgtaggtttggggtcggttacggggacggggaagggaccgaaaggtccgtacgggtacccggttacctaaacggtccgaaccggaccccgaacgggtcccgttacccggccccccgttcgggtaccctacccgttccgtttccccggtttcccccgtacccccttccccg

SEQ ID NO: 369057 - DNA, 699 bp, Homo sapiens
  misc_feature: GZ8MTXP02JJ8W7.8.1.A01.1.454.CMB.2.raw
  modified_base (216)..(216): a, c, t, g, unknown or other
  modified_base (292)..(292): a, c, t, g, unknown or other
  modified_base (310)..(310): a, c, t, g, unknown or other
  modified_base (334)..(334): a, c, t, g, unknown or other
  modified_base (337)..(337): a, c, t, g, unknown or other
tcagctcgcgtgtccacgaccggtgctcgatttagacgtctcatcagggggtgggctcaggaggcagagctctgggaatctcaccatggcctggacccctctcctgcctccccctcctcactttctgcacagtctctgaggcctcctatgagctgacacagccaccctggtgtcagtcgtccccaggacaaacggccaggatcacctgctctgganatgaattgaccaaaagaatatgactttatggtaaccagcagaagtcaggccaggcccctgtcctggtactatttangaaggaacaaagaaaccncccgtcggatccctagacagactntcngctcccagctcgaaggacagtcgcctacttgaacctatccgaacgtcggggacccgagggtcggaaggaacgtaggaaaggaacgtaactaacgttaagtttacgttaacctacgtaaccgaaagggtaaacggaaagggtaagttacggtacctaagttaccgtaaagggtttgggggtttacgggtttacgggggaacgggtaacggggaacccgaaaaggtaccgttaaccgggaaaccccgttacccgtaaacggtaccgaaccggtaccccgaaaacgggtcccgtacccggtccccccgtaccggttacctaccccgttacgtttccccgtttcccccggtaccccctttccccgg

SEQ ID NO: 369058 - DNA, 721 bp, Homo sapiens
  misc_feature: GZ8MTXP02HB26F.8.1.A01.1.454.CMB.2.raw
  modified_base (217)..(217): a, c, t, g, unknown or other
  modified_base (290)..(290): a, c, t, g, unknown or other
  modified_base (344)..(344): a, c, t, g, unknown or other
tcagctcgcgtgtccacgaccggtgctcgatttagacgtctcatcagggggtgggctcaggaggcagagctctgggaatctcaccatggcctggaccccctctcctgctccccctcctcacctttctgcacagtctctgaggcctcctatgagctgacacagccaccctcggtgtcagtgtccccaggacaaacggccaggatcacctgctctgganatgaaattgaccaaaagaatatgcttagtggtaccagcagaagtcaggccaggcccctgtcctggtcatttangaggacaagaacgccctccgggatccctagacagtactctctggctcccccganctacaggggacaggttcgcctacttcggactactccgtaacgtcggggggtacccagggttaggggaaggtacttaggggaaacggaaggtaaccttaaccgttagtttacggtttacctaccgttacccgtaaaggagggttaaaaccgggggtagttacgggtaacctaggtttaccgtaacgggtttcgggggtttacgggtttacgggggacgggtaaacggggtaaacccgtaaagggttacccgtaccggtaacccggtttaacgtaaacgggtaccgaaccgtaacccgaaccggtaccccgtacccggtccccccgttacggtaacccttaccgttacccgtcccgtttaccccctaaccccgttcccg

SEQ ID NO: 369059 - DNA, 676 bp, Homo sapiens
  misc_feature: GZ8MTXP02FYF0R.8.1.A01.1.454.CMB.2.raw
  modified_base (173)..(173): a, c, t, g, unknown or other
  modified_base (218)..(218): a, c, t, g, unknown or other
tcagctcgcgtgtccacgaccggtgctcgatttagacgtctcatcagggggtgggctcaggaggcagagctctgggaatctcaccatggcctggacccctctcctgcctccccctcctcactttctgcacagtctctgaggcctcctatgagctgacacagccaccctcggtntcagtcgtccccaggacaaacggccaggactcacctgctctgganatgaattgaccaaagaatatgtacttagttgacagcagaacgtcgagccacggcccctgtccttggtactaatttacgtaggaacggaaccaaacggaaaccgtaccccgtccggggactccccgtagacagtacctcgtacgtcggcctcccgacgcctacggacgggactacggtcgggccctaccgttgaacttactccgtacgggtcgggggacccgtaggggtacggaaggaagtaggaaaggacgtaacttacgttagtttacgtttacctaccgtaccgaaaggtaaggaaaggtagtagggttactagtacgtaaggttggggttaggttcggggacgggtacggggaacgtaacgcgtacgtaccggtccgtaaacgtccgacggaccgtaacggcccgtaccgcccccgtcggtacctaccgtcgttcccggtccccgtccctcccgg

SEQ ID NO: 369060 - DNA, 428 bp, Homo sapiens
  misc_feature: GZ8MTXP01CXU1U.25.77.G11.1.454.CMB.2.raw
  modified_base (396)..(396): a, c, t, g, unknown or other
  modified_base (424)..(428): a, c, t, g, unknown or other
tcagactgtacagtcacgaccggtgctcgatttagctagtcactcaagggaaagggactggagtggattgggagtgtttattatacaggggccacttggcgttacccgcccctcaggagtcgcgtttcgatgtccgttgacacggccacgaatcacttcaccctgaccctaacgtctgtgaccgccgcagacgcggccatatactattgtggggcgagtctgccgtcatacagtagtggccagttcgacctgtcggggcccgggaaccctggtcgccgtctcatcggcctccaccaagggcccatcggtcttccccctggcaccctcctccaagagcacctctgggggcacagcggccctgggctgcctggtccaaggactacgtcccactgtacngtctgagcgggctggcaaggcgcatagnnnnn

SEQ ID NO: 369061 - DNA, 436 bp, Homo sapiens
  misc_feature: GZ8MTXP02JMHH9.25.77.G11.1.454.CMB.2.raw
  modified_base (403)..(403): a, c, t, g, unknown or other
  modified_base (434)..(436): a, c, t, g, unknown or other
tcagactgtacagtcacgaccggtgctcgatttagctagtcactcaagggaaagggactggagtggattgggagtgtttattatacaggggccacttggcgttacccgcccctcaggagtcgcgtttcgatgtccgttgacacggccacgaatcacttcaccctgaccctaacgtctgtgaccgccgcagacgcggccatatactattgtggggcgagtctgccgtcatacagtagtggccagttcgacctggtcggggcccggaaccctggtccgccgtctcatcggcctccaccaaggcccatcggtcttcccctggcacccctcctccaagacgcacctcgtcgggggcacgagcggcccgtgggctgccgtggtcccaaggacctacttccactgtacngtctgaggcgggctggcaagggcgctatagnnn

SEQ ID NO: 369062 - DNA, 571 bp, Homo sapiens
  misc_feature: GZ8MTXP01AG0AO.17.67.G01.1.454.CMB.2.raw
  modified_base (272)..(272): a, c, t, g, unknown or other
  modified_base (382)..(382): a, c, t, g, unknown or other
tcagcgtagactagcacgaccggtgctcgatttagagtatacatattgggtttgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagggtcaccatcacttgccgggcaagtcacagcattagcagtctatttaaatggtatcagacaagaaaccgngggacacgacccctaactcctagatcggtatgctgcatcctagtttgcgaggcggtcgggtccagtacgaaggttcagtggcaggtggatgagggacagtacttcactcncaccatcagctagtctgacctaacctagtaaggttatttacgacctaaactttactactacgtacaaacgtacgtacgtacctaccgacccggtaacccccgggacggttccgggaccggaacgggtaccggagggttacggaaacttacgaaacgtacgtaacggtcggcgacgtccgaaccgtaacg

SEQ ID NO: 369063 - DNA, 606 bp, Homo sapiens
  misc_feature: GZ8MTXP02JBOKV.17.67.G01.1.454.CMB.2.raw
tcagcgtagactagcacgaccggtgctcgatttagagtatacatattgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgttcccatcgactacgcctttcggcctcgccttaggggcactcaccctgccccgatacgtggacaggacccttggtcttccggcgaggcgggcttttcgacccgtacgtttacgtccgttaccttagtgtcagcattcgctacttctgactaccctcacgcatgccctcacagcacaccttcacacggtaccttacaacgaacccgccctaccccctaaccaacacgacaacgtacgccgtcgcgtcgccgcgacgtcgtcgtcgcgtacgttacgttaccgttacccgttcctactccgttcccgtacctactacgtacgtacgtacgtcg

SEQ ID NO: 369064 - DNA, 518 bp, Homo sapiens
  misc_feature: GZ8MTXP01AV3VX.44.73.G07.1.454.CMB.2.raw
  modified_base (321)..(321): a, c, t, g, unknown or other
  modified_base (501)..(501): a, c, t, g, unknown or other
tcagacagtatatacacgaccggtgctcgatttagctctacgctcagggaggaactgctcagttaggacccagagggaaccatggaagcccagctcagcttctcttcctcctgctactctggctcccagattccaccggcgaaattgtgttgacacaatctccagccaccctgtctttgtctccggggaacagccaccctctcttgcagggccgcagactgttgacgacgacttagcctggtaccaacagaagcctggccaggctcccagactcctcatctatgatacttctagtagggcctctggcatccccagccccgntttcagtggcagtgggtctgggacagacttcactctcaaccatcacccagcctagagccctgaagattttgctagtttattactgtctacaccgtaagaagtggcctcaatattcactttcggccctgggacctaaagtggtatatacaaagaactgttgcttgcacattcttgtcttcntcttcccgctaattctg

SEQ ID NO: 369065 - DNA, 523 bp, Homo sapiens
  misc_feature: GZ8MTXP01DK08Z.44.73.G07.1.454.CMB.2.raw
  modified_base (308)..(308): a, c, t, g, unknown or other
  modified_base (360)..(360): a, c, t, g, unknown or other
  modified_base (362)..(362): a, c, t, g, unknown or other
  modified_base (507)..(507): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccttgtctttgtctccgggggaacagccaccctctcttgcagggccggccagactgttgacgacgacttagcctggtaccaacagaagcctggccaggctcccagactcctcatctatgatacttctagtaggcctntggcatccccagccccgcttcagtgcaggtgggtctgggacagcttcactcncnccatccaaccagccctagacgcctgaagtattttgctagtttatacttgtctacaccgtaagaagtgacctacaatattctactttcgccctgggaccaaagtggaatatcaaacgaactgttggcttgcacattcttgtcttcntctcccgctaattctg

SEQ ID NO: 369066 - DNA, 683 bp, Homo sapiens
  misc_feature: GZ8MTXP01CGFKW.44.73.G07.1.454.CMB.2.raw
  modified_base (255)..(255): a, c, t, g, unknown or other
  modified_base (296)..(296): a, c, t, g, unknown or other
  modified_base (330)..(330): a, c, t, g, unknown or other
  modified_base (340)..(340): a, c, t, g, unknown or other
  modified_base (354)..(354): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagagcggccagcctgggaactccctgagactctcctgtgcagcctntggattcatcttcaggacctatgccatgccactgggtcccncaggcctcgaggcgaagggggctgggagtggggngacaaattanagtccaaggaaagntacggaaattaagggaaagaacaacgtaacgggaacgaccgtaccggaaagggaaacgggcccgtaatttccgacccggttactaccgaagaacgaaactaaacgttacccgaaaggaaaccaacgaacctagacctaagttcctaagaacctaaaatcgttaaaccccaaaccttacaaaccgtaaagtcggaaacggtaccgaaccgggtcctttaggttacctttaaagttaagtttgggtacgacggacggttaacccgcccccgttacggaaccggtaaccccgggtcccccggttagtttaaccggaaccgttaacccggggg

SEQ ID NO: 369067 - DNA, 575 bp, Homo sapiens
  misc_feature: GZ8MTXP01AIX12.44.73.G07.1.454.CMB.2.raw
  modified_base (334)..(334): a, c, t, g, unknown or other
  modified_base (511)..(511): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtccgtccggggaacagcccaccctctcttgcagggccggccagactgttgacgacgacttagcctggtaccaacagaagcctggccaggcctcccagactcctcatctatgatacttctagtagggcctcgtggctactccccagccccgtntttcgaggtggcaggtgggtctgggacagtacttcactctcaaccatccaccagcctagacgtcctagaagtatttgactagtttattactgtactacaccgtaagagtcgcctacaattattcctactttccggcccttggaacctaaaggtggtactaataccaaacgaactggnggtcttcgacctaccacttcgttcgttccttctaacttcccttcccgacctaacgttccttaag

SEQ ID NO: 369068 - DNA, 503 bp, Homo sapiens
  misc_feature: GZ8MTXP01EO7YS.44.73.G07.1.454.CMB.2.raw
  modified_base (197)..(197): a, c, t, g, unknown or other
  modified_base (255)..(255): a, c, t, g, unknown or other
  modified_base (362)..(362): a, c, t, g, unknown or other
  modified_base (396)..(396): a, c, t, g, unknown or other
  modified_base (459)..(459): a, c, t, g, unknown or other
  modified_base (464)..(464): a, c, t, g, unknown or other
  modified_base (469)..(469): a, c, t, g, unknown or other
  modified_base (471)..(472): a, c, t, g, unknown or other
  modified_base (477)..(477): a, c, t, g, unknown or other
  modified_base (483)..(483): a, c, t, g, unknown or other
  modified_base (485)..(485): a, c, t, g, unknown or other
  modified_base (495)..(495): a, c, t, g, unknown or other
  modified_base (503)..(503): a, c, t, g, unknown or other
tcagacagtatatacacgaccggtgctcgatttagctctacgctcaggggggaggaactgctcagttaggacccagagggaaccatggaagccccagctcagcttctcttcctcctgctactctggctcccagattccaccggcgaaattgtgttgacacaatctccagccaccctgtctttgtctccgggggaacngcccaccctctcttgcagggccgccagactgttgacgacgacttagcctggtaccaanagaagcctggccaggctcccagactcctcatctatgatacttcagtaggcctctggcatcccagcccgcttcagtggcaggtgggtctgggacagacttcactctcnccatcacccagccctagacgcctgaagtatttgntatttattactgtactacacgtaagagtgcctacaatatcacttcgcctggacaaagtgatanacaanaatgngnngcacnttcttntntctctctccnctcttctn

SEQ ID NO: 369069 - DNA, 519 bp, Homo sapiens
  misc_feature: GZ8MTXP01DXA92.44.73.G07.1.454.CMB.2.raw
  modified_base (250)..(250): a, c, t, g, unknown or other
  modified_base (305)..(305): a, c, t, g, unknown or other
  modified_base (434)..(434): a, c, t, g, unknown or other
  modified_base (457)..(457): a, c, t, g, unknown or other
  modified_base (508)..(508): a, c, t, g, unknown or other
  modified_base (512)..(512): a, c, t, g, unknown or other
tcagacagtatatacacgaccggtgctcgatttagctctacgctcaggggaggaactgctcagttaggacccagagggaaccatggaagccccagctcagcttctcttcctcctgctactctggctcccagattccaccggcgaaattgtgttgacacaatctccagccacctgtctttgtctccgggggaacagccaccctctcttgcagggccgcagactgttgacgacgacttagcctggtaccaanagaagcctggccaggctcccagactcctcatctatgatacttctagtagggcctntggcatcccagccccgctttcagtggcaggtggtctgggacagacttcactctcaaccatcaaccagccctaggagccctagaagtatttgctagtttattactgtctacacgtaagagtgcctcaatntcacttcgcctgggacctaaagngtatatacaaacgaactgaggcttgcaccattcttgtcttcaatcttcccncctnttctaag

SEQ ID NO: 369070 - DNA, 552 bp, Homo sapiens
  misc_feature: GZ8MTXP01DXQGG.44.73.G07.1.454.CMB.2.raw
  modified_base (309)..(309): a, c, t, g, unknown or other
  modified_base (327)..(327): a, c, t, g, unknown or other
  modified_base (363)..(363): a, c, t, g, unknown or other
  modified_base (386)..(386): a, c, t, g, unknown or other
  modified_base (395)..(395): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccggggggaacagccaccctctcttgcagggccggccagactgttgacgacgacttagcctggtaccaacagaagcctggccaggctcccagactcctcatctatgatacttctagtaggcctntggcatccccagccccgnttcagtggcaggtggtctggggacagacttcactcncaaccatccaccagcctaggacncctgaagtntttgctagtttattactgtactacaccgtaagagtgcctacgtaattattctactttccggccctgggaacctaaagtcggtaatacgtacaaaacgtaactggttcggcttgactaccagttcttcgtcttcaacttccttcccgctaattctaag

SEQ ID NO: 369071 - DNA, 579 bp, Homo sapiens
  misc_feature: GZ8MTXP01CWYL7.44.73.G07.1.454.CMB.2.raw
  modified_base (325)..(325): a, c, t, g, unknown or other
  modified_base (362)..(362): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagcccaccctgtctttgtcgtccgggggaacagcccaccctctcttgcagggccgcagactgtgacgacgacttagcctggtaccaacagaagcctggccaggctcccagactcctcatctatgatacttcagtagggcctctggcatcccagccccgnttcgagtggcaggtggtctgggacagcttcactctcnccatccaaccagcctagagtcctagaagtatttgactagtttatacttgtctaacaaccgtaaagaagtcgacctacctaaattactttcaacgtttccggaccccgttagggaaccctaaaaggtggtaattaactacaaaacgaaacttggttcggtcttggcctaaccttagttcttgttccttactaacttccttcccgacctaattcctaag

SEQ ID NO: 369072 - DNA, 519 bp, Homo sapiens
  misc_feature: GZ8MTXP01CL6FJ.44.73.G07.1.454.CMB.2.raw
  modified_base (325)..(325): a, c, t, g, unknown or other
  modified_base (386)..(386): a, c, t, g, unknown or other
  modified_base (441)..(441): a, c, t, g, unknown or other
  modified_base (504)..(504): a, c, t, g, unknown or other
  modified_base (514)..(514): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgctccgggggaacagccaccctctcttgcagggccgcagactgttgacgacgacttagcctggtaccaacagaagcctggccaggctcccagactcctcatctatgatacttctagtagggcctctggcactccccagccccgnttcagtggcaggtggggtctggggacagacttcactctcaaccatccgacagccctagacnccctagaagtatttgctagtttattactgtctacacgtaagaagtgcctacaatnttcactttcgccctgggaccaaagtgatatacaacgaactgttgcttgcacattcttgtctcntctcccgctnttctg

SEQ ID NO: 369073 - DNA, 670 bp, Homo sapiens
  misc_feature: GZ8MTXP01AWHYE.44.73.G07.1.454.CMB.2.raw
  modified_base (254)..(254): a, c, t, g, unknown or other
  modified_base (298)..(298): a, c, t, g, unknown or other
tcagacagtatatacacgaccggtgctcgatttagctctacgctcagggggggagacgagcccagcactggaagtcgacggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagcctntggattcatctcagtacctatcgccatcgctacgtcgggtcccnccgaggcctaccgaggacggaggggcgtagggaggttgggggtgactaaagttatatccgaaggaagagtaggtaaattaaggaaacaacgacgtaaacgggagtaacccgtacgggaaggaacggggccctacgttaccgaccgttaccacccgaagaacgtaaacctaacttaaccgaaacggaaaccaaccgtacgtacgacctacgtacgtacgaaaccttaaaacgtaccgtaaacccaaccctacaaacgtaagtacggaacggaccgacgggtcttagttaccttatttaagtggtacgacggttcgacccgtccccgtaggaaccggtaccccggtcccgttacgttaacggccgtaaccgggg

SEQ ID NO: 369074 - DNA, 590 bp, Homo sapiens
  misc_feature: GZ8MTXP01B0XL3.44.73.G07.1.454.CMB.2.raw
  modified_base (259)..(259): a, c, t, g, unknown or other
  modified_base (300)..(300): a, c, t, g, unknown or other
  modified_base (341)..(341): a, c, t, g, unknown or other
  modified_base (359)..(359): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtcgtgggggaggcgtggtccagcctgggagtccctgagctctcctgtgaagcctntggtatttagttcagtagttctggcatgcacgtgggtcccncaggcctccgaggcgaagggggccgagtggttgctagttangcatagtgatggaacttnaaagattaattatgcagtaccgtccggtaggaacgggccgtattccacctatcctaccaagacgaacctaacgttaccccggaaactactactacgtaaccgtaggtaaactgaactcgacgccgtaggaacgacgggtcggaggtacctcgggcttcgttaggttactttacgtggtcgacggaggttaggtaacggggaagtcgggaccaggcgtaacgttcgtttaag

SEQ ID NO: 369075 - DNA, 515 bp, Homo sapiens
  misc_feature: GZ8MTXP01BAWCM.44.73.G07.1.454.CMB.2.raw
  modified_base (298)..(298): a, c, t, g, unknown or other
  modified_base (363)..(363): a, c, t, g, unknown or other
  modified_base (453)..(453): a, c, t, g, unknown or other
  modified_base (487)..(487): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagcctgggagtccctgagactctcctgtgaagcctgtggtatttagttcagtagtctggcatgcacgtgggtccnccaggcctccgaggcaagggggccgagtggtggcagttatagcatatgatggaacttctaagatnttatgacagctcgtgaacgggccatcacatctcagagaaccacttacccggaacactctacgtacgtggaaacttgaatcagcctagagngacgaggctcggctcgttgtattacgtgtggagngagtcggggaatggcagactgctttaag

SEQ ID NO: 369076 - DNA, 521 bp, Homo sapiens
  misc_feature: GZ8MTXP01A8OTT.44.73.G07.1.454.CMB.2.raw
  modified_base (299)..(299): a, c, t, g, unknown or other
  modified_base (340)..(340): a, c, t, g, unknown or other
  modified_base (347)..(347): a, c, t, g, unknown or other
  modified_base (358)..(358): a, c, t, g, unknown or other
  modified_base (365)..(365): a, c, t, g, unknown or other
  modified_base (398)..(398): a, c, t, g, unknown or other
  modified_base (454)..(454): a, c, t, g, unknown or other
  modified_base (489)..(489): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagcctgggaggtccctgagactctcctgtgaagcctctggatttagttcagtagttctggcatgcactgggtcccnccaggctccgaggcaagggggccgaggtggtggcagtttanagcatangatggaacttnaagattntatgcagactcgtagaacgggccatcaccatcncagagacaattcccggaactactctacgtaccgtaggaaatgaatcagcctagagnggcgaggctcggctcttgtattacgtgtgcgttgngtcggggaagtcgggcagcgaagttcgttaag

SEQ ID NO: 369077 - DNA, 519 bp, Homo sapiens
  misc_feature: GZ8MTXP01DPXEE.44.73.G07.1.454.CMB.2.raw
  modified_base (240)..(240): a, c, t, g, unknown or other
  modified_base (281)..(281): a, c, t, g, unknown or other
  modified_base (320)..(320): a, c, t, g, unknown or other
  modified_base (327)..(327): a, c, t, g, unknown or other
  modified_base (382)..(382): a, c, t, g, unknown or other
  modified_base (394)..(394): a, c, t, g, unknown or other
  modified_base (404)..(404): a, c, t, g, unknown or other
  modified_base (423)..(423): a, c, t, g, unknown or other
  modified_base (484)..(484): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtcgtgggggaggcgtggtccagcctgggaggtcctgagactctcctgtgaagcctntggtatttagttcagttagttctggcatgcacgtgggtccnccaggcctccgaggcaaggggccgagtggttgcagttanagcatangatggaacttctagatattatgcagaactcgtgaacgggcatcaccatctcaganacaactccgaanctctagtacnggaaatgatcagctggagnggacgagactcggactctgtattacgtgtcgcgtagagttcgggaaagtggcttaggcagnttaattcgtcggggctttcgcgttcgggggaaccg

SEQ ID NO: 369078 - DNA, 602 bp, Homo sapiens
  misc_feature: GZ8MTXP01CMJ5B.44.73.G07.1.454.CMB.2.raw
  modified_base (295)..(295): a, c, t, g, unknown or other
  modified_base (337)..(337): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggagagcggccagcctgggaactccctgagactctcctgtgcagcctctggattcatcttcaggacctatcgccatcgcacgtgggtcccnccaggcctccgaggcgaagggggctgggagtgggtgcaattnatccaagaagatagggaaattaggaaagaacacgtaacgggagactccggaaggaacgggcccgtattccgaccgtctcaagagacaactaccagaacacactgacagtctagacaaagtcgtaaccaaccctacaacaagtacgacggaccaacgggtcttacggttacttaatttagttaggtcgaccggttacgacccggtccccccgtacggaaccggtaccccgggtccccgttacgtttcggaacccgttaacccgggg

SEQ ID NO: 369079 - DNA, 533 bp, Homo sapiens
  misc_feature: GZ8MTXP01ELIMB.44.73.G07.1.454.CMB.2.raw
  modified_base (281)..(281): a, c, t, g, unknown or other
  modified_base (295)..(295): a, c, t, g, unknown or other
  modified_base (483)..(483): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccacctgtctttgtctccgggggaacagccaccctctcttgcagggccgccagactgttgacgacgacttagcctggtaccaacagaagcctggccaggctcccagactcctnatctatgatacttntagtaggcctctggcatcccagcccgcttcagtggcaggtgggtctggggacagcttcactctcaacatcaccgagccctagcgcctgagtatttgctagtttatactgtactacaccgtaaagaagtgccctacgaattactctacgtttcgccctagggacctaaagtgtaatatacaaagaatgnggcttgcaccagttcttgttcttcaacttccttcccgctaacttcgtaag

SEQ ID NO: 369080 - DNA, 600 bp, Homo sapiens
  misc_feature: GZ8MTXP01D4FQX.44.73.G07.1.454.CMB.2.raw
  modified_base (303)..(303): a, c, t, g, unknown or other
  modified_base (341)..(341): a, c, t, g, unknown or other
  modified_base (346)..(346): a, c, t, g, unknown or other
  modified_base (357)..(357): a, c, t, g, unknown or other
  modified_base (365)..(365): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagccgtgggagtccctgagactctcctgtgaacgcctgtggtattttagttcagtagttctggcatgcacgtgggtcccncaggctcgaggcgaagggggcgagtggttgctagttangcatntgatgaacttnaaagattntatgacagacctcggtagaacgggcctattccacatcctaccaagacgaactaacgttaccccggaaactacttacgtacgtaaccgtaggtaaacttgaactcgaacgtccgtaggaaacggacgggtcggaacgggtccgtccgggtaacttcgttaggttaactttacggtggtacggacggttaggttacggtaacgggggtaagtggacaggacgtaagttcgtttaagg

SEQ ID NO: 369081 - DNA, 653 bp, Homo sapiens
  misc_feature: GZ8MTXP01ATGM0.44.73.G07.1.454.CMB.2.raw
  modified_base (261)..(261): a, c, t, g, unknown or other
  modified_base (301)..(301): a, c, t, g, unknown or other
  modified_base (338)..(338): a, c, t, g, unknown or other
  modified_base (345)..(345): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtcgtgggggaggcgtggtccagtctgggaggtccctgagactctcctgtgaagcctntggtatttagttcagtagttctggcatgcacgtgggtccncaggctccgaggcaagggggccgagtggtgcagttanagcatangatggaaactttctaaagattaattacgtgacagtacctccgggtaggaaacggggcccgtaattccaacctaattccgtacccaaggaacgaacctaaacgttccccgggaaactaccgttcttacggtaacccgtagggaaaattgaaacttcaacgcccgttaggaaggacggggtcccggaagggtaccgtccggggtcttccgttagggttaacttaccgtgggttggaccggttaaggttaggttaaccgggggaaaggttcggggaccgtaagggttccctaaggttaacccgtttaaggg

SEQ ID NO: 369082 - DNA, 513 bp, Homo sapiens
  misc_feature: GZ8MTXP01BTEWG.44.73.G07.1.454.CMB.2.raw
  modified_base (293)..(293): a, c, t, g, unknown or other
  modified_base (335)..(335): a, c, t, g, unknown or other
  modified_base (355)..(355): a, c, t, g, unknown or other
  modified_base (359)..(359): a, c, t, g, unknown or other
  modified_base (367)..(367): a, c, t, g, unknown or other
  modified_base (390)..(390): a, c, t, g, unknown or other
  modified_base (449)..(449): a, c, t, g, unknown or other
  modified_base (472)..(472): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagccctctggattcatcttcaggacctatgccatgcactgggtccnccaggcctccgaggcaagggggctgggagtgggtgcaattanatccagagatggaattgaanaacnctacgganactcgagagggccattcacgtcncagagacatccagacacactgcagtctgacaaatgtaacaacctcaacaagtgaggacncggctgttactattagtgtgcgngccgccccctggcgccggtccccgcttcgaaccgtaacggg

SEQ ID NO: 369083 - DNA, 629 bp, Homo sapiens
  misc_feature: GZ8MTXP01BWAGS.44.73.G07.1.454.CMB.2.raw
  modified_base (283)..(283): a, c, t, g, unknown or other
  modified_base (327)..(327): a, c, t, g, unknown or other
  modified_base (369)..(369): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggccagactgttgacgacgacttagcctggtaccaacagaagcctggccaggctcccagactcctnatctatgatacttctagtagggcctctggcatccccagccccgnttcgagtggcaggtcgggtctggggacagacttcactctacnccatccaccagcctagacgcctagaagtatttgcttagtttattacttgttactaacgaccgtaagaacgtcggtacccttaccgtaattactttacctaaccgtttccggtaccccgttaggggtaaccctaaaggtgggtaacttaacgtaacgaaaccggtaaacgttggttacgggtccttacggacctaacccttacgttccttcgttcctttacctaaccgtttcccttccccgttacctaacgttccgttaag

SEQ ID NO: 369084 - DNA, 700 bp, Homo sapiens
  misc_feature: GZ8MTXP01EII39.44.73.G07.1.454.CMB.2.raw
  modified_base (253)..(253): a, c, t, g, unknown or other
  modified_base (294)..(294): a, c, t, g, unknown or other
  modified_base (339)..(339): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaacctcctgagctctcctgtgcagcctntggattcatcttcaggacctatgccatgcacgtgggtcccnccaggcctccgaggcgaagggggctgggaggtgggtgctaagttnagtaccaggaaagagtggaaacttaaggaaacgaacgtacgtaaacgggagaaccgtccgggaaagggaacggggtcccgatttccgaaccgtctaccgaagaacgtaacctaacgttaccaacgggaaacaaccgacttagacctaactcgttacgaacctaaaattacggtaaaccctaaacccgttacaaaccgtaaaggttacggaaacgggtaaccgaaccggggtccttaaggttaccgtttaaactttaaacgtttggttacggttacccggacggttaacccggtccccccgtacgggaacccgtaccccggggttccccgccgtttaacggttaacccgttaaccccggggg

SEQ ID NO: 369085 - DNA, 594 bp, Homo sapiens
  misc_feature: GZ8MTXP01A5EGW.44.73.G07.1.454.CMB.2.raw
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagcctctggattcatcttcaggacctatcgccatgcacgtgggtcccgccaggcctccgagggcgaagggggctagggaggtggggtggactaagttatatccgaagaagataggaattaagaaagaacacgtaacgggagaccgtaccggaaggaacgggcccgattccaccgtctaccaagagaacaacttcgaacggaacacgactgacagtcagacaaacttacgaaccaacctacaaacgaagtacggaaggaccgacgggaactgttactaatttagtggtcgcgagacccgccccgtacggaacgacccgggtccccgttcgttcgaacgtaacccggg

SEQ ID NO: 369086 - DNA, 581 bp, Homo sapiens
  misc_feature: GZ8MTXP01BOZ9S.44.73.G07.1.454.CMB.2.raw
  modified_base (255)..(255): a, c, t, g, unknown or other
  modified_base (295)..(295): a, c, t, g, unknown or other
  modified_base (539)..(539): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaacctccctgagactctcctgtgcagcctntggattcatcttcaggacctatgccatgcactgggtcccnccagctcccaggacgaaggggcgtgggaggtcgggtggcgaattatataccagaaagagtggtaacgttaagaagaacgactaacgggaaggacctaccggaaggaacggggacccggacttacgacccgtacgtccaacgagaaacaacttaccacggaacacactacgacactctagacaaatacgtacaaacctcaaccaagtacgacggacaaccgggctgttcctattagttgtgacgngacgcccccgtcgaagacccggtcccgcttcgcgtaaccggg

SEQ ID NO: 369087 - DNA, 682 bp, Homo sapiens
  misc_feature: GZ8MTXP01ED8FN.44.73.G07.1.454.CMB.2.raw
  modified_base (253)..(253): a, c, t, g, unknown or other
  modified_base (294)..(294): a, c, t, g, unknown or other
  modified_base (339)..(339): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggccagcctgggaactccctgagactctcctgtgcagcctntggattcatcttcaggacctatgccatgcacgtgggtcccncaggctccgaggcgaagggggctgggagtggggtgactaaattanataccgaaggaaagagtagggaaatttacggaaagaacgacgtaaacggggagaaccgtaccgggaaagggaaacggggcccgtaactttaccgaacccggttccaccgaagaacgaaactaaacgttacccgaagggaaaccaccactacgacctaagtctagaacctaaaagttcgtaaaccaacccttacaaaccgtaaaggtacggaacggaaccaccggggtaactttaggttaccgttaattttaacgttggttacggaccgacggaccccggtccccccgtacggaaccggtaccccgggtcccccgttcgttaaccggaaccgttaacccggggg

SEQ ID NO: 369088 - DNA, 692 bp, Homo sapiens
  misc_feature: GZ8MTXP01C2P9L.44.73.G07.1.454.CMB.2.raw
  modified_base (304)..(304): a, c, t, g, unknown or other
  modified_base (347)..(347): a, c, t, g, unknown or other
  modified_base (356)..(356): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagcttgggttttcctcgttacttcttttaagaggtgtccagtgtcaggtgcaccgtggtggagtcgtgggggagcgtggtccagccgtgggagtccctgagctctcctgtgaagccttgtggtatttagttcagtagttctggcatgcacgtgggtcccncaggctccgagggcgaagggggccgagttgggtgactagttanagcatacgngtatggtaacttcgtaaagtattaattagtggacctaaggtaccgttacccgggaggtaaacccgggggcctaactttacccaaaccctagttacccgtaacccgaaacggtaaacgaacctaaaccgttaccccgggaaaactaccgttactacgggttaaaccctaaggggtaaaccttgaactacgaaccgtccgtaggaaacggcgggaccgtaacgggtacccgtcgggtaacctttcgttggtttaaaccgttcgtagggttacgaccggttaagggttacggttcgggggaaagtcggaccgtaaggcctaaggttaaccgttttaagg

SEQ ID NO: 369089 - DNA, 602 bp, Homo sapiens
  misc_feature: GZ8MTXP01CDBRW.44.73.G07.1.454.CMB.2.raw
  modified_base (253)..(253): a, c, t, g, unknown or other
  modified_base (293)..(293): a, c, t, g, unknown or other
  modified_base (336)..(336): a, c, t, g, unknown or other
  modified_base (379)..(379): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagcctntggattcatcttcaggacctatgccatgcacgtgggcccncaggctccgaggcaagggggctgggagtgggtgactaaattanatccaggaagatacggaattaggaaacgaacacgtaacggganacctccggaagaacgggcctattccaccgtctaccagagaacaattccgaagaacacgaactcgacacgtctagacaaagttcgtaaaccaacctacaacgaacgtaggaacggaccacgggccttggttacttaagtttagttacggtgaccggagacccggtcccccgtacggaaccggtacccgggttccccgcgtttaaccgaaccgtttaacccgggg

SEQ ID NO: 369090 - DNA, 535 bp, Homo sapiens
  misc_feature: GZ8MTXP01B1NLX.44.73.G07.1.454.CMB.2.raw
  modified_base (256)..(256): a, c, t, g, unknown or other
  modified_base (296)..(296): a, c, t, g, unknown or other
  modified_base (523)..(523): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagagcggcccagcctgggaactccctgagactctcctgtgcagcctntggattcatcttcaggacctatgccatgcacgtgggtccnccaggctccgaggcaagggggctgggagtgggtgacaattatatccagaagataggaattagaagaacacgtacggagactccggaaggaacgggccgattcaccgtctccagagaacaatccaggaacacactgacagtctagactaaatcgtaaaccaacctacaacgaagtaggaggacacggctgttctattagtgtgcgcgacgcccctgaacgaccgtccnctcgcgtaacgg

SEQ ID NO: 369091 - DNA, 542 bp, Homo sapiens
  misc_feature: GZ8MTXP01AQIDY.44.73.G07.1.454.CMB.2.raw
  modified_base (315)..(315): a, c, t, g, unknown or other
  modified_base (333)..(333): a, c, t, g, unknown or other
  modified_base (394)..(394): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagcctgggaggtccctgagactctcctgtgaagcctctggatttagttcagtagttctggcatgcactgggtcccgccaggctccaggcaaggggccgagtggtggcagtanagcatatgatggaacttnagatattatgcagaactccgtgaagggccattcacatctccagacgacaacttcccggaanactctagtaccctaggaaattgaatcagccgtgacggaggcgaaggctcggcttcgtgtaattactggtgcggaagagtcggggaagtgggcagttccagtccttaagttcgtccgggggtcttttcgaacggttcgggggaacccgg

SEQ ID NO: 369092 - DNA, 664 bp, Homo sapiens
  misc_feature: GZ8MTXP01DO6QU.44.73.G07.1.454.CMB.2.raw
  modified_base (255)..(255): a, c, t, g, unknown or other
  modified_base (298)..(298): a, c, t, g, unknown or other
  modified_base (347)..(347): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagcctcnggattcatcttcaggacctatcgccatcgcacgtggggtcccnccaggctcccgaggcgaagggggctgggaggtggggtgactaaagttanatccgaggaaagatagggaaattaagaaacgaacacgtaacgggaagaccgtccggaaggaaacggggcccgtattaccgacccgtactacccgaagacgaaacctaaacttacccgaacgggaaaccaacgaaccttagaccctagttacctaggaaccctaaatacgtaaaccctaaacccttacaaaaccgtaaaggttaggaaacggaaccgaaccgggtcttaggttacttaagtttagttagtcggacgcgacccgtcccccgtacggaaccggtacccggtccccgttacgttcgaaccgttaaccgggg

SEQ ID NO: 369093 - DNA, 581 bp, Homo sapiens
  misc_feature: GZ8MTXP01CI4BV.44.73.G07.1.454.CMB.2.raw
  modified_base (282)..(282): a, c, t, g, unknown or other
  modified_base (329)..(329): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggccagactgttgacgacgacttagcctggtaccaacagagcctggccaggctcccagactcctnatctatgatacttctaggtaggcctcgtggcactccccagccccgtntttcgaggtggcaggtcggggtctcgggggacaggtactttcacttcctaccaacccatccaaccagccctaaggacgccctagaagtattttgactagtttattactgtactacgacgtaagacgtgacctacgaattacttctacgtttccggcccgttagggaacctaaggtcgtaatactacaaacgtaactggttggcttcgacacagttcttcgtcttctaacttccttcccgctaacgttctaag

SEQ ID NO: 369094 - DNA, 534 bp, Homo sapiens
  misc_feature: GZ8MTXP01EJLY4.44.73.G07.1.454.CMB.2.raw
  modified_base (293)..(293): a, c, t, g, unknown or other
  modified_base (334)..(334): a, c, t, g, unknown or other
  modified_base (492)..(492): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagcggcccagcctgggaactccctgagactctcctgtgcagcctctggattcatcttcaggacctatgccatgcactgggtccnccaggctccaggcaagggggctgggagtgggtgcaaattanatccaggaaagatggaaattgaaagaacacgtaacgggagactccggaaggaacgggcccgattcaccgtctccaagagaacaacttccaaggaacacactagcatctgacaaatgacaacctcaacagtgaggacacggctgttctattatgtgcgngacgcccccgtgaacgccggtccccgcgttcgccgtaaccgg

SEQ ID NO: 369095 - DNA, 611 bp, Homo sapiens
  misc_feature: GZ8MTXP01C93FS.44.73.G07.1.454.CMB.2.raw
  modified_base (276)..(276): a, c, t, g, unknown or other
  modified_base (303)..(303): a, c, t, g, unknown or other
  modified_base (322)..(322): a, c, t, g, unknown or other
tcagacagtatatacacgaccggtgctcgatttagctctacgctcaggggggaggaactgctcagttaggacccagagggaaccatggaagccccagctcagcttctcttcctcctgctactctggctccagattccacggcgaaattgtgttgacacaatctccagccaccctgtctttgctccggggggaacagccacctctcttgcagggccggcagactgttgacgacgacttagcctggtaccaacagaagcctggccaggctcccagacnctcatctatgatactctagtaggcctntggcatccccagccccgtntcgaggtggcgtagggtggtctcgggacagtacttcactcacaacatcacgagtccagacgtactagtaagttactttgacttaagtttacttacgtagtacctaaccgaacgtaaagaacgtcgtacctacgtaattacttaccgtacgttccggaccgtaggaaccgaaagtacgtaataactaacgaaacgtaacgtacggttacggtacgttacgtacgtaacttacgttcttacgttccttaccttaaccttcccttacccgttaccctaacgttaacgtaacg

SEQ ID NO: 369096 - DNA, 608 bp, Homo sapiens
  misc_feature: GZ8MTXP01BACNQ.44.73.G07.1.454.CMB.2.raw
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggccagactgttgacgacgacttagcctggtaccaacagaagcctggccaggctcccagacctcctcatctatgatacttctagtaggcctctggcactcccagccccgcttcgagtggcaggtgggtctcggggacagtacttcactctcaaccatccaccagcctagacgtccctagtaagtatttgactagtttattactgttactacgaccgtaaagaacgtcggacctaccgtaaattacttacctaccgtttccggccccgttacgggaaccctaaaggttggtaacttaacgtaacgaaaaccggtaaacgtggttcgggtacttcggactacccttattcgttcgtaaccttctaacttcccttcccgcctaacgttcctaag

SEQ ID NO: 369097 - DNA, 607 bp, Homo sapiens
  misc_feature: GZ8MTXP01B0YBR.44.73.G07.1.454.CMB.2.raw
  modified_base (295)..(295): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagcggcccagcctgggaactccctgagactctcctgtgcagcctctggattcatcttcaggacctatgccatgcactgggtcccnccaggcctccgaggcgaagggggctgggagtgggggtggactaagttatatccgaaggaagtatagggaattaggaaagaacaacgtaacgggagaccgtccggaaggaacggggcccgtattcgaccgtctaccagagaacaattccaacggaacacactgacactctagacaaagtcgtaaccaacctacaacgaaagtaggaacggacgacgggtctggttacttatttagttggtacgcgacggaccgtcccccgtcggaaccggtacccgggtccccgttcgttaaccggttaaccgtaacccgggg

SEQ ID NO: 369098 - DNA, 610 bp, Homo sapiens
  misc_feature: GZ8MTXP01A4Z82.44.73.G07.1.454.CMB.2.raw
  modified_base (406)..(406): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggtttttcctcgttgctcttttaagaggtggccagtgtcaggtgcagctagtggagtcgtgggggagagcggcccagcctgggaacctccctgagactctcctgtgcagcctctggattcatcttcaggacctatgccatgccacgtgggtcccgccaggcctcccgaggccgaagggggctggggaggttgggggtggactaaagtttatagtccgaaggaaagtagtagggaaacttaggaaacgtaacacgtaacggganaccgtccggaaggaaacgggcccgattcaccgtctccgagacgaacaacttaccaaggaacacactgcagtctgacaaatacgtaaccaaacctacaacaaggtacgacggacacgggtctgttacttattagttgtgccgttacgacccgtcccccgtacggaaccgtacccgggtccccgttacgttcgaaccgtaaccggg

SEQ ID NO: 369099 - DNA, 565 bp, Homo sapiens
  misc_feature: GZ8MTXP01CQXDP.44.73.G07.1.454.CMB.2.raw
  modified_base (282)..(282): a, c, t, g, unknown or other
  modified_base (338)..(338): a, c, t, g, unknown or other
  modified_base (348)..(348): a, c, t, g, unknown or other
  modified_base (359)..(359): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagcttgggttttcctcgttactcttttaagaggtgtccagtgtcaggtgcacctggtggagtcgtgggggagcgtggtccagcctgggaggtccctgagactctcctgtgaagcctctggtatttagttcagttagttctggcatgcacgtgggtccncaggctccgaggcaaggggccgagtggtggctagttatagcatatgatggaacttntagatattangacagactcgnggacggctatcactatcacagacactacgtccgaacactactacgtactaggaaatgactacgacgccggtaggacggacggacggacggtcgtcggcttcgtagttacttcgtgcggaacggtaaggttacggtacgggacggtacggtcgacgcgacgtaacgttacgttaacgtcgggtacggttacgtcggttcgggtcggg

SEQ ID NO: 369100 - DNA, 653 bp, Homo sapiens
  misc_feature: GZ8MTXP01BL2RO.44.73.G07.1.454.CMB.2.raw
  modified_base (168)..(168): a, c, t, g, unknown or other
  modified_base (254)..(254): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagnggtggccagtgtcaggtgcagctagtggagtcgtgggggagagcggccagcctgggaacctccctgagactctcctgtgcagcctntggattcatcttcaggacctatgccatgcacgtcgggtcccgccaggcctccgagggccgaagggggctggggaggttggggtggactaaagttatataccaaggaaagatagggaaatttaaggaaagaacacgtaacgggagaaccgtaccggaagggaaacggggcccgtacgttaccgacccggtctaccgaagaacgaaacgtaacttaccgaacgggaaaccacgactagactaagtctagaactaaatacgtaaccaaacctacaaacgaagtacggaacggtaaccgacgggtctcggttacttaattagttgtcgacggacggttacccggcccccgttcggaacggtaccccgggtaccccgttcgttaacggaaccgttaacccgggg

SEQ ID NO: 369101 - DNA, 592 bp, Homo sapiens
  misc_feature: GZ8MTXP01AZ87E.44.73.G07.1.454.CMB.2.raw
  modified_base (255)..(255): a, c, t, g, unknown or other
  modified_base (342)..(342): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagagcggcccagcctgggaactccctgagactctcctgtgcagcctntggattcatcttcaggacctatgccatgcacgtgggtcccgccaggctccgaggccgaagggggctgggagtggggtgacaagttanatccgaagaagatagggaattagaaagaacacgtaacgggagacgtccggaaggaaacgggcccgtattaccgaccggtctaccgaagacgaacaaacttaccgaacggaaaccacaactgacactctagacaaatcgtaaccaaacctcaacgaagtagaacggaccaacggctagttactaattagtgtcgacgttcgaccgccccgtggaaccgtacccggtcccgcgttaacgaacgttaaccggg

SEQ ID NO: 369102 - DNA, 661 bp, Homo sapiens
  misc_feature: GZ8MTXP01D8Q1A.44.73.G07.1.454.CMB.2.raw
  modified_base (239)..(239): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtcgtggggaggcgtggtccagcctgggagtccctgagactctcctgtgaagcctntggtatttagttcagttagttctggcatgcacgtgggtccgccaggcctccgaggcgaaggggccgaggtggttggctagttatagcatatgatggaacttctagatattatgacagaactccgtggaaacggccgtattccgaccatctacagacgactaacgttacccgaaactacttacgttacgtacccgtaagggaaacttcgaattacgacggacccggttagggacggaacggggacggaagggtacccgtcggtctttaccgttagttaaccgttaacgttggtggaacggtaagggaaggtaccgggggttaaagggtcgggaacgttaacggttcgttaacggttaaccgtttaaggttaacgggttccggggttaccggtttaccggtaacgggggttccgggggaaccgg

SEQ ID NO: 369103 - DNA, 586 bp, Homo sapiens
  misc_feature: GZ8MTXP01DUBJ1.44.73.G07.1.454.CMB.2.raw
  modified_base (256)..(256): a, c, t, g, unknown or other
  modified_base (386)..(386): a, c, t, g, unknown or other
  modified_base (480)..(480): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagagcggcccagcctgggaactccctgagactctcctgtgcagcctnggattcatcttcaggacctatcgccatcgcacgtgggtcccgccaggcctccgaggcgaagggggctgggagtggggtgactaattatatcaagaagagtaggaaacttagaaagaacacgtaacggganaccgtccgggaagaacgggccgattcgaccgtcaccgagacgaacacttacagaactacactgacagtctagaaccaaagtactaaccaaccanaaccgaagtgaacggacgaacggtctagttacttaagttagttgtcgacgttcgacccgtccccgtagaacggtcccggtcccgttcgtaacgaaccgtaaccggg

SEQ ID NO: 369104 - DNA, 572 bp, Homo sapiens
  misc_feature: GZ8MTXP01C5369.44.73.G07.1.454.CMB.2.raw
  modified_base (283)..(283): a, c, t, g, unknown or other
  modified_base (370)..(370): a, c, t, g, unknown or other
  modified_base (372)..(372): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggcagactgttgacgacgacttagcctggtaccaacagaagcctggccaggcctcccagactcctnatctatgatacttctagtagggcctcgtggccactccccagccccgtctttcgaggtggctaggtgggtctgggacagcttcactcncnccatccaccagcctagacgcctagtaagtattttgctagtttatacttgtactacgaccgtaaagagtcgaccctacaaattacttctaccgtttcggccccgttagggaccctaaagtgtaatatacaaacgtaatggttaggcttcgactacttattcttcgtcttcaactttccccgtcccgttactcttcgttaag

SEQ ID NO: 369105 - DNA, 556 bp, Homo sapiens
  misc_feature: GZ8MTXP01BRIOR.44.73.G07.1.454.CMB.2.raw
  modified_base (368)..(368): a, c, t, g, unknown or other
  modified_base (370)..(370): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccgccagactgtgacgacgacttagcctggtaccaacagaagcctggccaggctcccagactcctcatctatgattacttctagtacgggcctctggcactccccagccccgctttcaggtggcaggtggggtctggggacagacttcactcncnccatccaccagccctagacgcctagaagtatttgctagtttattactgtactacacgtaagagtcgtcctactaattacgttctaccgtttccggcccgtagggaaccaaaggtgtataactacaaacgtaactgttggcttgaccacttagttcttgtctcaacttccctcccgctaattctaag

SEQ ID NO: 369106 - DNA, 738 bp, Homo sapiens
  misc_feature: GZ8MTXP01CJ3M2.44.73.G07.1.454.CMB.2.raw
  modified_base (340)..(340): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggccagcctgggaactccctgagactctcctgtgcagcctctggattcatcttcaggacctatgcccatgcacgtcgggtcccgccaggcctccgaggcgaagggggctgggagtggggtgcaagttanatccaaggagatagggaattagaaagaacacgtaacgggagaccgtaccgaagggaaacggggcccgtaagttccgaacccggtaccttacccgaaggaacggtaaacctaaacgttaccccgaaagggtaaacccaaacctaaccgttacggaccctaagttacccgttacggaacctaaaaacgttaccggttaaacccaaaccccgttaacctaaaccgaaaacggttacggaaaccggggaacccgtaacccggggtaaccttacggttaccgtttaaattttaacgtttggttacggacccggttacggacccggtaaccccccctacgggtaacccggtaaccccgggtccccccggttaccgtttaaccgggaacccgtttaaccccgggg

SEQ ID NO: 369107 - DNA, 588 bp, Homo sapiens
  misc_feature: GZ8MTXP01AX98P.44.73.G07.1.454.CMB.2.raw
  modified_base (253)..(253): a, c, t, g, unknown or other
  modified_base (294)..(294): a, c, t, g, unknown or other
  modified_base (342)..(342): a, c, t, g, unknown or other
  modified_base (385)..(385): a, c, t, g, unknown or other
  modified_base (501)..(501): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagctctcctgtgcagcctntggattcatcttcaggacctatgccatgcacgtgggtcccncaggcctccgaggcaagggggctgggaggtggggtggactaaatttanatccgaaggaagagtaggaattagaaagaacacgtaacggganacgtaccggaaggaacgggccattacgacccgtctacccgaagacgaacaacttaccgaaggaaccacactgacagtcagacaaatcgaaccaacctcaaacgagtagacggaccnggctgttacttattacgtgtcgacggacgttacccgcccccgtcggaaccggtacccggtccccggacttcggaaccgtaaccgggg

SEQ ID NO: 369108 - DNA, 543 bp, Homo sapiens
  misc_feature: GZ8MTXP01D1KCX.44.73.G07.1.454.CMB.2.raw
  modified_base (194)..(194): a, c, t, g, unknown or other
  modified_base (202)..(202): a, c, t, g, unknown or other
  modified_base (277)..(277): a, c, t, g, unknown or other
  modified_base (325)..(325): a, c, t, g, unknown or other
  modified_base (372)..(372): a, c, t, g, unknown or other
  modified_base (387)..(387): a, c, t, g, unknown or other
  modified_base (395)..(395): a, c, t, g, unknown or other
  modified_base (506)..(506): a, c, t, g, unknown or other
tcagacagtatatacacgaccggtgctcgatttagctctacgctcagggggaggaactgctcagttaggacccagagggaaccatggaagccccagctcagcttctcttcctcctgctactttggctcccagattccaccggcgaaattgtgttgacacaatctccagccacctgtcttgtctccgggggaacngccacctntcttgcagggccgccagactgttgacgacgacttagcctggtaccaacagaagcctggccaggctccagactccncatctatgatacttctagtagggcctcgtggcactccccagccccgtnttccagtcgggctaggtgggtctggggaccagtacttcactcacacntcaccagcctagacnctagagtntttgctagtttattactgttctacacgtaagtagtggcctaccaattacttctaccgttcggccgtcgggtaccaaagtggactatacgaaacgaactgtggctgcacctnttcttcgttcttcacttccttcccgcttatcttgtaa

SEQ ID NO: 369109 - DNA, 697 bp, Homo sapiens
  misc_feature: GZ8MTXP01CQMCB.44.73.G07.1.454.CMB.2.raw
  modified_base (257)..(257): a, c, t, g, unknown or other
  modified_base (269)..(269): a, c, t, g, unknown or other
  modified_base (277)..(277): a, c, t, g, unknown or other
  modified_base (297)..(297): a, c, t, g, unknown or other
  modified_base (360)..(360): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagattggggtttttcctcgttgcttcttttaagaggtggccagtgtcaggtgcagctagtggagtcgtgggggagagcggccagcctgggaactccctgagactctcctgtgcagcctntggattcatctnaggactangccatcgcacgtcgggcccncaggcctcgaggcgaagggggctagggacggtggggtgactaaattatataccgaaggaaagngtagggaaatttaaggaaagaactacgtaaacgggaagtaaccgtaccgggaaggggaaacgggcccgtaactttacccgaacccggttacctaccgaaacgaacgaaacctaaacttacccgaaacgggaaaccaacaaccgtagaccacgtcttacggaactaaacgtacgtaaaccaaacccgtacaaacgtaagtacggaacggaccgtaacggtcttacggttacctttaaagtttacgtttaggcggttaccggacggttaaccccgtcccccggtacggaaccggttaccccgggtccccgttacgtttaacggaacccgttaaccgggg

SEQ ID NO: 369110 - DNA, 679 bp, Homo sapiens
  misc_feature: GZ8MTXP01CVZJ1.44.73.G07.1.454.CMB.2.raw
  modified_base (329)..(329): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtcttgtcgtccgggggaacagccaccctctcttgcagggccgccagactgttgacgacgacttagcctggtaccaacagaagcctggccaggcctcccagactcctcatctatgatacttctagtaggcctcgtggcactccccagccccgtntttacgaggtggccgtaggtgggtcgtacggggacagtaccttcaccgttctccaacctatacccaaccgacgtaccctaggacgtacccttagtaaagttacttttgaccgtttaaggtttttaacttacgttacgttacctaaccgtaaaccggttaaagtaacggttacggtaccccttaaccgtaaactttactttaccgaccgttttcccggaccccgtaaggggtaaacccgaaaggttaggtaactaactaccgaaaacgtaactggttcggtacttcgacctacccgttagttccttacgttccttcgtaaccttcccttccccgacctaagttccgttaag

SEQ ID NO: 369111 - DNA, 609 bp, Homo sapiens
  misc_feature: GZ8MTXP01A1ZRK.44.73.G07.1.454.CMB.2.raw
  modified_base (283)..(283): a, c, t, g, unknown or other
  modified_base (323)..(323): a, c, t, g, unknown or other
  modified_base (357)..(357): a, c, t, g, unknown or other
  modified_base (370)..(370): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagccgtgggaggtccctgagactctcctgtgaagcctctggtattttagttcagttagttctggcatgcacgtgggtccnccaggctccgaggcgaaggggccgaggtggtggctagtanagcatatgattggaacttcgtaagacttattagngacagaacctcgnggacgggctactccactatcacgagacgactaaccgtacccgaactactactacgtacgtagaactgaactcgacgtcgagggaacggacgggacggaacggtaccgtccggtacttacgttagttaacgtttacgtcggtacggaacggtaaggttacgggtacgggggttaagtcgggaacgaggcgaggtaacttagttaacggtcgggttcgttacgaacgggttccggggaacg

SEQ ID NO: 369112 - DNA, 596 bp, Homo sapiens
  misc_feature: GZ8MTXP01DSMPB.44.73.G07.1.454.CMB.2.raw
  modified_base (252)..(252): a, c, t, g, unknown or other
  modified_base (368)..(368): a, c, t, g, unknown or other
  modified_base (585)..(585): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccgccagactgtgacgacgacttagcctggtaccaanagaagcctggccaggctcccagacctcctcatctatgatacttctagtaggcctctggccatccccagccccgtctttcgaggtggctaggtgggtctggggacagacttcactcncaaccatcacccagcccctagacgccctagtaagtattttgactagtttattacttgtactaacaccgttaaagaagtcggaccttaccgaaattactttacctaaccgtttccggccccgttagggaacccgtaaaagtcggtaaattaactacaaaacgaacttggttacggcttgacctaaccagttccttgttccttcaacttccttaccccnctaattctaag

SEQ ID NO: 369113 - DNA, 539 bp, Homo sapiens
  misc_feature: GZ8MTXP01CL0WT.44.73.G07.1.454.CMB.2.raw
  modified_base (280)..(280): a, c, t, g, unknown or other
  modified_base (323)..(323): a, c, t, g, unknown or other
  modified_base (495)..(495): a, c, t, g, unknown or other
  modified_base (501)..(501): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccgcagactgttgacgacgacttagcctggtaccaacagagcctggccaggctcccagactcctnatctatgatacttctagtagggcctctggcactcccagccccnctttcagtgcaggtgggtctcggggacagacttcactctcaaccatcaccagcctagacgccctagaagtattttgctagtttatacttgtctacacgtaagagtgcctacaattattaccactttccggccgtcgggacaaagtcggtatatacaaacgtaactgttggcngtaccncagttcttgttctctaatcctcccgctaacttcttaag

SEQ ID NO: 369114 - DNA, 526 bp, Homo sapiens
  misc_feature: GZ8MTXP01BK494.44.73.G07.1.454.CMB.2.raw
  modified_base (205)..(205): a, c, t, g, unknown or other
  modified_base (278)..(278): a, c, t, g, unknown or other
  modified_base (326)..(326): a, c, t, g, unknown or other
  modified_base (365)..(365): a, c, t, g, unknown or other
  modified_base (383)..(383): a, c, t, g, unknown or other
  modified_base (479)..(479): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctntcttgcagggccgccagactgttgacgacgacttagcctggtaccaacagaagcctggccaggctcccagacncctcatctatgatacttctagtagggcctctggcatccccagccccgnttcaggtggcaggtgggtctgggacagtcttcactctcnccatccaccagcctaagntccctagaagtattttgctagttttattactgtctacacgtaagagtgcctcaattattctacgttcgcccgtagggacctaagtgtatatacaanaactgttggcttgcacattcttgtctcaactcctccgcctaattctg

SEQ ID NO: 369115 - DNA, 654 bp, Homo sapiens
  misc_feature: GZ8MTXP01BYCVV.44.73.G07.1.454.CMB.2.raw
  modified_base (281)..(281): a, c, t, g, unknown or other
  modified_base (285)..(285): a, c, t, g, unknown or other
  modified_base (396)..(396): a, c, t, g, unknown or other
tcagacagtatatacacgaccggtgctcgatttagctctacgctcaggggggaggaactgctcagttaggacccagagggaaccatggaagccccagctcagcttctcttcctcctgctactctggctcccagattccaccggcgaaattgtgttgacacaatctccagccaccctgtctttgtcgtccgggggaacgagccaccctctcttgcagggccgccagactgttgacgacgacttagcctggtaccaacagaagcctggccaggctcccagacncctnatctatgatacttctagtagggcctctggccactccccagtccccgcttcgaggtggcaggtgggtctggggacagaccttcactctcaaccatccaaccagcctaggacncctagtaagtattttgactaagtttattactgtactacgaaccgtaaagtaacgtacgtaccctacgtaaacttacttacctaccgtttccggacccgtaggggtaaaccctaaaaggttcggtaaacttaacgtaaccgtaaaaacggtaaccgttaggttacgggtacgttacggacccgtaaccttacttccggttcgtttaaccctttacctaaccgtttccccttccccgttacccttaacgtttcgttaacg

SEQ ID NO: 369116 - DNA, 700 bp, Homo sapiens
  misc_feature: GZ8MTXP01EY76V.44.73.G07.1.454.CMB.2.raw
  modified_base (254)..(254): a, c, t, g, unknown or other
  modified_base (266)..(266): a, c, t, g, unknown or other
  modified_base (290)..(290): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagcctntggattcatctnagacctatgccatgcactggtccncaggctcgaggcaagggggctgggagtgggtgcaattatatcagaagagtggaattagaaagaacacgtaacgggagaccgtaccggaaggaaacggggcccgtagttaccgaacccgtacctacccgaaggaaacgaacctaaacgtttacccgaaacgggaaaccaaccgtaaccgttacggaccctaagtttaccgtaacggtaaacctaaaacgtttacggttaaaccccaaacccctttaaccgaaaaccgaaacggttaggaaacgggtaaccgaaccggggtaacctttaggttacctttaaacgtttaacgttggtacggacggacgacccggtccccccgtacgggaaccggtaccccgggtacccccgttacgtttaaccggaacccgtttaacccgggg

SEQ ID NO: 369117 - DNA, 741 bp, Homo sapiens
  misc_feature: GZ8MTXP01C0362.44.73.G07.1.454.CMB.2.raw
  modified_base (257)..(257): a, c, t, g, unknown or other
  modified_base (303)..(303): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagagcggccagcctgggaacctccctgagactctcctgtgcagccctntggattcattcttcaggacctatcgccatgccacgtcgggtccccncacggcctccgaggcgaagggggctaggggaggtggggtgactaaatttatacgtaccgaaaggaaagtagtaaggggaaatttaacgggaaaacgaaccgtaaacgtaaaccggggaaacgtaacccgtacccgggaaagggaaaccgggggtacccgtaacgtttacccgaacccggttaccgtacccgaaggtaaacgaaacctaaacgttacccgaaacgggaaaccaaccgaaccgtacgaccctaagttactacggaaacctaaacttacgtaaacccaaaccctacgaaaccgtaaaggtacggaacggaaccgaccgggtaacttcggttacctttaagttagtttacggtcggttaccggacggacccgtcccccgtacggaaccggtaccccggtccccggttacgttccggaaccgttaacccgggg

SEQ ID NO: 369118 - DNA, 568 bp, Homo sapiens
  misc_feature: GZ8MTXP01B68ZZ.44.73.G07.1.454.CMB.2.raw
  modified_base (294)..(294): a, c, t, g, unknown or other
  modified_base (490)..(490): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagcctctggattcatcttcaggacctatgccatgcactgggtcccncaggctccgaggcaagggggctgggaggtgggtgctaattatatccgagaagatggaaattgaaagaacacgtacgggagactaccggagaacgggccattcaccgtcacagacgacaattccaaggaacacactgacagtctagactaaatcgtaaccaacctacaacaagtgaacggaccacgggcttacgttnttaattgttgtcgcgttacgacccgcccccgttcggaacgtaccccggggtcccttacgttcggaaccgttaaccggg

SEQ ID NO: 369119 - DNA, 748 bp, Homo sapiens
  misc_feature: GZ8MTXP01C0BOD.44.73.G07.1.454.CMB.2.raw
  modified_base (353)..(353): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagattgggttttcctcgttgctcttttaaggaggtggccagtgtcaggtgcagctagtggagtcgtgggggagagcggcccagcctgggaacctccctgagactctcctgtgcagcctctggattcatcttacaggacctatcgccatcgcacgtggggtccccgcgaggcctcccgagggcgaagggggctggggaggtgggtgacaaagttanataccgagaaagagtaggaaattaaggaaagaacgaacgtaacgggaacgtacgtaccgggaaggaacggggacccgtacttaccgacccgtaccgtaccgaacgaacgaaaccgtaaacgtttacccgaaacggggaaacccaaaccgtaccgtacggtaccgtaacttacccgtacggtaaacctaaaacgttaccgttaaaaccctaaacccttaacgaaaacccgtaaagggtaacggaacgggaaccggtaaccggtaacgttacggttactttaaagttacgtttagggtcgaacccggttacggaccccgggtaacccccgtacgggtaaccgggtaaccccgggttcccccggttacgtttaaccgggaacccggttaacccggggg

SEQ ID NO: 369120 - DNA, 640 bp, Homo sapiens
  misc_feature: GZ8MTXP01BTI3Q.44.73.G07.1.454.CMB.2.raw
  modified_base (199)..(199): a, c, t, g, unknown or other
tcagacagtatatacacgaccggtgctcgatttagctctacgctcaggggggaggaactgctcagttaggacccagagggaaccatggaagccccagctcagcttctcttcctcctgctactctggctcccagattccaccggcgaaattgtgttgacacaatctccagccaccctgtctttgtcgtccgggggaacgngcccaccctctcttgcgagggccgccagactgttgacgacgacttagcctggtaccaacagaagcctggccaggcctcccagacctcctcatctatgacttacttcgtaggtacgggcctcgtggcacgtccccacgccccgtcttcgaggtcggcgaggttggggtccgtacggggacagtaccttaccacgtcctaccaacctatcccaacccacgtccctaagacgtaccctagaaacgttatttgacgttaagtttacttaccgtcgttaacctacgtaaaccgtaagtaaggtcgtaccctacgtaaattacttaccgtaccgtttccggcccgttagggaacctaaaggtcgtaaataactacaaacggaactggttggcttgaccacgttattcttcgttccttactcttcccttcccgactaacgttctaacg

SEQ ID NO: 369121 - DNA, 734 bp, Homo sapiens
  misc_feature: GZ8MTXP01CHDAE.44.73.G07.1.454.CMB.2.raw
tcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcaccgtggtggagtcgtgggggagcgtggtccagccgtgggaggtccctgagactctctgtgaagcctcgtggtattttagttcagttagttcgtggctatgcacgtcgggtcccgcgaggcctccgagggcgaacgggggccggtaggttgggttcggacgtaaggttagtaggctaattagtggagttacgggtaaactttcgtaaggtactttaagttagtcggacctaacgggtaaaccccgtttacccgggtaaggggtaaaccgggggtaccccttaacgtttaccccgaaacccgtactttaccccgtacccgaaaggtaaccggtaaacccttaaaccggtttacccccgggaaacttacccgttaccgttaacggttaacccgtagggtaaaacttcggaaacttccgaacggtacccggtagggaacgggtacgggaccgggtaaggtcccgtcggtacttcgtagttaccttagtcgtggaacgtaggaggtcgggaagtcggcttagcagtcttagttcggtcgggtcgttacgcgggttcggggaaccg

SEQ ID NO: 369122 - DNA, 582 bp, Homo sapiens
  misc_feature: GZ8MTXP01AE06O.44.73.G07.1.454.CMB.2.raw
  modified_base (295)..(295): a, c, t, g, unknown or other
  modified_base (341)..(341): a, c, t, g, unknown or other
  modified_base (410)..(410): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggagagcggcccagcctgggaactccctgagactctcctgtgcagcctctggattcatcttcaggacctatcgccatgcacgtgggtcccnccaggctccgagggcaagggggctgggagtggggtgaactaattanatccgaagaagatggaattagaaagaacacgtaacggagactccggaagacgggccgacttcaccgtcnccagagacatacagaacacactgcatactcgacaaactacgaaccaacctacaacgaacgtgacggacgacggtctagttacttattaacgttgtcggcgacggttacccgtcccccgtacggaaccggtaccccgggtccccgttaccgttaacgaaccggttaaccgggg

SEQ ID NO: 369123 - DNA, 703 bp, Homo sapiens
  misc_feature: GZ8MTXP01A826U.44.73.G07.1.454.CMB.2.raw
  modified_base (347)..(347): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagattgggtttttcctcgttgcttcttttaagaggtggccagtgtcaggtgcagctagtggagtcgtgggggagagcgcccagcctgggaacctcctgagactctcctgtgcagcctctggattcatcttcaggacctatgcctatcgcacgtgggtcccgccaggcctccgaggcgaagggggctggggagtgggggtgactaaattnatccgaaggaaagtagtagggtaattaacggaaagtaaccgaacgttaacgggaacgaccgtaccgggaaggaacggggaccgtacgttaccgaacccgtccgtaccaaggaacgaaccgtaaactttacccgaaacggaaaccaaccaacgttacgctaactccgttaagaaccctaaaatacggtaacctaaacccgttcaaaaccgtaaagtacgggaacggaaccggtacgggtaaccttacggttacttaacgtttaagttaggttcgaaccgggacgttacccggtaacccccgttccgggaacgtaccccggggtcccttacgttaaccgggttaacctaacccggggg

SEQ ID NO: 369124 - DNA, 634 bp, Homo sapiens
  misc_feature: GZ8MTXP01CSBYO.44.73.G07.1.454.CMB.2.raw
  modified_base (302)..(302): a, c, t, g, unknown or other
  modified_base (343)..(343): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagccgtgggagtccctgagactctcctgtgaagcctcgtggtatttagttcagtagttctggcatgcacgtgggtcccnccgaggcctcgaggcgaaggggccgagtggttggcagttanagctatatgatggtaacttcgtaaagattaattagtgacacgtacgtccggtagaaacgggtcctagttaccacctacgtcctaccgaagtacgtaactaaccgttaccccggaactaccttacgtacgtaccgtagggaaattgaacgttacgacgtccgtaggaacggacggccggaacgggtaccgtccgggtaacttcgttaggtttaacgttacgttgggtcgacggttagggttacgtaacgggggaacgttgggaccgtaggacctaacggttaacgtttaagg

SEQ ID NO: 369125 - DNA, 704 bp, Homo sapiens
  misc_feature: GZ8MTXP01BEZDQ.44.73.G07.1.454.CMB.2.raw
  modified_base (298)..(298): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagcctctggattcatcttcaggacctatgccagtgccacgtcgggtcccnccaggcctccgaggcgaagggggctgggaggtgggtggactaattatataccgaagaaggtaagtaggggtaaactttaagggaaacgtaacgacgtaaacggggaacgtacccgtacccgggaaagggaaacggggtacccgtaagttaccaacgttccgtactacccgaagtaacggaactaacgttacccaaagggaaaccaaccgtaactcgacgtaacttccgtagaacctaaaattaccgtaaccctaaacccgttacaaaccgtaaaggtaccggaaagggacccgtaacgggtcttaggttaccttaagtttaagttcggttacggcgttaccggaacccggtccccccgttgggtaacccggtcccgggttcccccgtcgttaacggtaaccccggg

SEQ ID NO: 369126 - DNA, 620 bp, Homo sapiens
  misc_feature: GZ8MTXP01CYNHS.44.73.G07.1.454.CMB.2.raw
  modified_base (195)..(195): a, c, t, g, unknown or other
  modified_base (205)..(205): a, c, t, g, unknown or other
  modified_base (284)..(284): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaanagccaccctntcttgcagggccggcagactgttgacgacgacttagcctggtaaccaacagaagcctaggccaggctcccagactcctnatctatgatacttctagtacgggcctcgtggccactccccagccccgctttcgagttggctaggtggtccgtgggactagtctttcaccttcctcaaccatccaaccacggcctaggactccctagtaagttatttgcttagtttatacttacgtactaacgtaccgtaaagagtacggtaccctacgtaaacttactttacctaccgtttaccggcccgtaacgggtaaccctaaaggtacggtaataacgtaaccgaaacgtaactggttcggacttcgtaccaacttacgttcttcgttccttctaacttcccttccgacctaacgttcgtaa

SEQ ID NO: 369127 - DNA, 594 bp, Homo sapiens
  misc_feature: GZ8MTXP01C8X2X.44.73.G07.1.454.CMB.2.raw
  modified_base (332)..(332): a, c, t, g, unknown or other
  modified_base (364)..(364): a, c, t, g, unknown or other
  modified_base (396)..(396): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagcctgggagtccctgagactctcctgtgaacgcctcgtggtatttagttcagttagttctggctagtgcacgtcggggtcccgccaggcctccgaggccgaagggggccgaggtggttggctagttanagcatatgattaggaacttgaagtattattangacagaacctcgtggacgggccattccacctntctacagacgaactaacgtaccccggaactacgttacgtacgtaaccgtaggaaactgaactaccgacgccgtaggacggaacgggcggaacgaccgtcggcttccgtagttattacgtggtcgcggtaggaggtcggggaagtcggcaggcttagtccttaagttcggtcgggtctttacgcgggttcggggaaccg

SEQ ID NO: 369128 - DNA, 646 bp, Homo sapiens
  misc_feature: GZ8MTXP01B6D4C.44.73.G07.1.454.CMB.2.raw
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtcgtccgggggaacacgccaccctctcttgcagggccgcagactgttgacgacgacttagcctggtaccaacagaagcctggccaggcctcccagacctcctcatctatgattacttctagtacgggcctcgtggccactccccagcccccgtctttcgaggtggctaggtggggtcctggggaccaggtacctttcaccttcctaccaacccatcccaacccacgccctaaggacgtcctagtaagttattttgacttagtttattaacgtgtactaacgacgtaagaagtcgtaccctactaattacttcctaacgtttcccggacccgttagggaaccctaaaaggtggtaacttaactaaccgtaaaacggtaaacgtggttacggtccttagaccctaacttacgttccttacgttaaccttcctaactttcccttccccgttactaacgttccttaag

SEQ ID NO: 369129 - DNA, 587 bp, Homo sapiens
  misc_feature: GZ8MTXP01CVT9T.44.73.G07.1.454.CMB.2.raw
  modified_base (257)..(257): a, c, t, g, unknown or other
  modified_base (260)..(260): a, c, t, g, unknown or other
  modified_base (286)..(286): a, c, t, g, unknown or other
  modified_base (307)..(307): a, c, t, g, unknown or other
  modified_base (353)..(353): a, c, t, g, unknown or other
  modified_base (547)..(547): a, c, t, g, unknown or other
  modified_base (555)..(555): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagcttgggttttcctcgttacttcttttaagaggttgtccagtgtcaggtgcaccgtggtggagtcgtgggggagcgtggtccagccgtggggacgtccctgagactctctgngancctgtggtatttagttcagtagttcnggcagtcgcacgtgggtcccnccgaggcctcgagggcgaagggggcgagttgggtgctagttatagntatatgagtggtaacttcgtaaagtattaattactgtacgagtaccgtaccggtagggaaaccgggcctaattccgaactattccaacccgagtaacgaacctaacgttaccccgaaaactcttacgtacgttaaccggtaggaaattcgactcgacgccgtagaggagtcgagacgtgctgttgtattcgtgngacggagngggtcggagtgccgtagacgtcgttcgttaag

SEQ ID NO: 369130 - DNA, 818 bp, Homo sapiens
  misc_feature: GZ8MTXP01CUUCC.44.73.G07.1.454.CMB.2.raw
  modified_base (187)..(187): a, c, t, g, unknown or other
  modified_base (238)..(238): a, c, t, g, unknown or other
  modified_base (304)..(304): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagattgggttttcctcgttgctcttttaagaggtggccagtgtcaggtncagctagtggagtcgtgggggagagccggccagcctgggaacctccctganactctcctgtgcagcctctggattcatcttcaggtacctatcgaccatcgccacgtcgggtccccncgaggcctaccgagggaccgaagggggctggggaggtggggtagactaaatttcagtaccgaaaggtaagtgtaagggtaaacttaaggaaaacgtaacctaaacggttaaaccggggaaacgtaaacccgtacccggggaaagggtaaacggggtcccgtaaactttcccgaaacccggttccgtaccgaaagggtaaccgaaactaaaccgttaccggaaacggaaaccaacgtaacctacggaacctaacgttaccgtaacggaaaaccttaaaacggttaaccgttaaaaccccaaacccgtttaacctaaaaaccgggtaaacggtaacggggaaaccgggttaacccgaaaccggggtttccttaaacggtttacgttttaaacttttaacggtttagggaccgttaaaccccgggttcgaaacccccggttcccccgggtaaacggtaacccgggtaccccggttcccccgttaggttaaccggttaaccccggtttaacccggggg

SEQ ID NO: 369131 - DNA, 638 bp, Homo sapiens
  misc_feature: GZ8MTXP01D94MX.44.73.G07.1.454.CMB.2.raw
  modified_base (251)..(251): a, c, t, g, unknown or other
  modified_base (294)..(294): a, c, t, g, unknown or other
  modified_base (347)..(347): a, c, t, g, unknown or other
  modified_base (557)..(557): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctaggtggagtcgtgggggagagcggccagcctgggaactcctgagctctctgtgcagcctnggacttcatcttcaggacctatcgccatcgcacgtgggtcccnccgaggcctaccgaggcgaagggggtctagggaggtggggtagactaaattanagtaccgaggtaaagtagtacggaaattaaggaaacgaacgtacgtaaacggggacgtaccgtacgggaagggaaacgggtccctaattccgaaccgtctaccgaagaacgaactaagttccgaagggaaaccaccaacgttacgacctaattcgtaagaacctaaaagtccgaaaccctacctacaaacgaagtgaacggacaccggtntcgttacttaaattcgtacgtcgcgttacggcccctaaccggcgaaccggtcccgtcgttacgtcgaaccggtaaccgggg

SEQ ID NO: 369132 - DNA, 690 bp, Homo sapiens
  misc_feature: GZ8MTXP01DI9RD.44.73.G07.1.454.CMB.2.raw
  modified_base (253)..(253): a, c, t, g, unknown or other
  modified_base (298)..(298): a, c, t, g, unknown or other
  modified_base (345)..(345): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactcctgagactctcctgtgcagcctntggattcatcttcaggtacctatcgccatcgccacgtgggtcccnccgaggcctccgaggcaagggggctgggagtggggtgactaaagttntatccgaagaagtagtaggaaattaggaaaacgtaaccgacgtaaacgggaacgtaaccgtacccgggaaaggaacggggcccgtaacgttccgacccgttcctaccgaaggaacgaaacgtaaacttaccgaacggaaaccaaccaacgttacgacctaagttaccgttacggaacctaaaacgttccgtaaaccaaacccgttacaaaccgtaaggtacggaacggaaccaacgggtaaccttaggttaccttaagtttacgttggtacgaccggttacgacccgtcccccgtacgggaacggtaccccgggtccccgttacgttcgaaccgttaacccgggg

SEQ ID NO: 369133 - DNA, 624 bp, Homo sapiens
  misc_feature: GZ8MTXP01ECBJ1.44.73.G07.1.454.CMB.2.raw
tcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacgtggtggagtcgtgggggaggcgtggtccagccgtgggacgtcctgagactctcctgtgaagtcctcgtgtatttagttcagttagttctggcatcgcacgtcgggtcccgcgaggcctccgagggacgaagggggccggaggtggttggctagttatagcagtatgataggtaacttctaagtattattagtgacagaaccgtcgtggaacgggcctattccactatctacagacgaacctaacgttacccgaaactacgttactacgtaacgtaggaaatgaactacgacgtaccggtaggaacgggaacgggcggtaacggtaccgttcggctttacgttgttaaacgttacgtggtacggaacggtaaggacgggtcggggttaaagcggacaggttcacgggtaacttagttcggtcggtcgttcgaacgggttcgggaaccgg

SEQ ID NO: 369134 - DNA, 613 bp, Homo sapiens
  misc_feature: GZ8MTXP01DLCIU.44.73.G07.1.454.CMB.2.raw
  modified_base (240)..(240): a, c, t, g, unknown or other
  modified_base (283)..(283): a, c, t, g, unknown or other
  modified_base (350)..(350): a, c, t, g, unknown or other
  modified_base (423)..(423): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtcgtgggggaggcgtggtccagcctgggagtccctgagactctcctgtgaagcctntggtatttagttcagttagttctggcatgcacgtggggtcccnccgaggcctccgagggcgaagggggccggagtggtggctagttatagctattatgattggaaacttntaagtattattatgacagtaacctcgtggaaacgggcctattccaccatcaccagacacaacgttcccggaanactcgtacgtacctaggaaattgaatcgaacgccgtagaaggaggtccgaggtaccgtcggacttcgtggtaacttacgtggtcggtaacgaaggttacggttaccgggggaaagtcggggaccaggaccaggttaaccttagtttaacggtccgggggtctttacggaaccgggttcgggggaacccgg

SEQ ID NO: 369135 - DNA, 728 bp, Homo sapiens
  misc_feature: GZ8MTXP01EXMQ4.44.73.G07.1.454.CMB.2.raw
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccgcagactgttgacgacgtacttagcctaggtaaccaacagaagcctggccaggctcccagacctcctcatctatgatacttctaggtacgggcctctggactactccccgagccccgtctttcgaggtcggccgtaggttcgggggtcgtacggggacctagtacctttcaccgttcctaccaaccctatcccaaaccacggtaccccttaagggacgtcccgttagtaaagttactttttaggacttaagttttaacttaccgtggttacctaaccgtaaccgtaaagtaacgttcggtacccttaaccgtaaatttactttacctaaccgtttcccgggaccccgttaggggaaaccctaaaagggtcggtaattaacgtaaccgaaaacggtaaccttgggttaacggccttacggaccctaaccgttactttcccggttcgtttaacccctttacctaaacccgtttccccgtttaacccccgttacctttaaccgtttccgtaacg

SEQ ID NO: 369136 - DNA, 582 bp, Homo sapiens
  misc_feature: GZ8MTXP01B7ERH.44.73.G07.1.454.CMB.2.raw
  modified_base (288)..(288): a, c, t, g, unknown or other
  modified_base (378)..(378): a, c, t, g, unknown or other
  modified_base (517)..(517): a, c, t, g, unknown or other
tcagacagtatatacacgaccggtgctcgatttagctctacgctcaggggggaggaactgctcagttaggacccagagggaaccatggaagccccagctcagcttctcttcctcctgctactctggctcccagattccaccggcgaaattgtgttgacacaatctccagccaccctgtctttgtcgtccgggggaacgagcccaccctctcttgcagggccgccagactgttgacgacgacttagcctggtaaccaacagaagcctggccaggcctcccagacctccncatctatgattactctagtacggctcgtggcactcccacgcccgtcttcgagtggcgaggtggtcgtcgggacagtacttcactctaccncactccaccagcctagagcctagaagttattgactagtttatactgtactacaccgtaagagtgaccctacgtaacttattcctaccgttcgtcccgtaggaccgtaaaaggtgtaatactaacgaaacgtaacttggnggtccttggctaacccgttattccttgttcctctaaccttccctcccttacctaacttccgtaag

SEQ ID NO: 369137 - DNA, 700 bp, Homo sapiens
  misc_feature: GZ8MTXP01CSYVE.44.73.G07.1.454.CMB.2.raw
  modified_base (261)..(261): a, c, t, g, unknown or other
  modified_base (346)..(346): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagcttgggttttcctcgttactcttttaagaggtgtccagtgtcaggtgcacctggtggagtcgtgggggagcgtggtccagccgtgggagtccctgagactctcctgtgaagcctntggtatttagttcagtagttctggcatgctacgtgggtcccgccaggcctccgaggcgaagggggccgagtgggttgctagttanagctatatgatggtaacttcaaagtattaattatgactaaggtacctccgggtagggaaacggggtccctaatttcccgaacctattcctacccgaaggtaaccgtaacctaaaccgtttacccccggaaactaccttaccgttacggttaacccgtaaggggtaaaacttcggaaacttcgaacggtcccgttaggaaccgggacgggtccgggaagggtacccgttcggggaacctttcggttaggtttaaaccttggttacgggcggttaccggggaaggttaacggggttaaccgggggaaaaggttccggggaacttaacgggaccgtaaggttcccgtttttaaaggg

SEQ ID NO: 369138 - DNA, 791 bp, Homo sapiens
  misc_feature: GZ8MTXP01BR45Q.44.73.G07.1.454.CMB.2.raw
  modified_base (253)..(253): a, c, t, g, unknown or other
  modified_base (297)..(297): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagattgggttttcctcgttgctcttttaagaggtggccagtgtcaggtgcagctagtggagtcgtgggggagagcggccagcctgggaactcctgagactctcctgtgcagcctntggattcatcttcaggacctatgccatcgccacgtgggtccccnccgaggcctccgagggacgaagggggcgtgggacggtgggggtgactaaagtttactataccgaaggtaaagtagtagggaaagtttaaggaaaacgtaacgaaccgttaacgggaacgtaaccgtacccggaaaggggaaacggggtacccgtaacgtttacccgtaacccgtaccgtacccgaacggaacgtaaaccgtaaacgtttacccgaaacgggaaaccaaccgtaaccgttacggacccgtacgtacctttaacggaaaccgtaaaaacttaccggttaaacccaaaccccgttaacgaaacccgttaaagggtacgggtaaacggggaaacccgtaaccgggtaacgtttaacgggtttcctttaaacgttttagtttacgggttaacggttccgggaacggttacccggtccccccggtacggtaacccggtaaccccgggttcccccgttaccgtttaacccggaaccgtttaaccccggggg

SEQ ID NO: 369139 - DNA, 572 bp, Homo sapiens
  misc_feature: GZ8MTXP01DV4IJ.44.73.G07.1.454.CMB.2.raw
  modified_base (295)..(295): a, c, t, g, unknown or other
  modified_base (326)..(326): a, c, t, g, unknown or other
  modified_base (381)..(381): a, c, t, g, unknown or other
  modified_base (542)..(542): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctccccagattccaccggcgaaattgtgttgacacaatctccagccaccctgtctttgtctccggggaacagccaccctctcttgcagggccgccagactgttgacgacgacttagcctggtaccaacagaagcctggccaggctcccagactcctcatctatgatactntagtaggcctctggcactccccagccccgtntttcgaggtggcaggtcgggtctggggacagtaccttcactctcaaccatccacngtcctagagtccctgtaagttattttggcttagtttattaacctgttacctacaaccgtaagaacgttcggacccttaccgtaatttacttctaccgttccggacccgtagggtaacctaaaggtgtatatacaaacgaactgttgcttcgcacacgttcngttctctcttcctcccgctaacttcgttaa

SEQ ID NO: 369140 - DNA, 641 bp, Homo sapiens
  misc_feature: GZ8MTXP01CEFWU.44.73.G07.1.454.CMB.2.raw
  modified_base (173)..(173): a, c, t, g, unknown or other
  modified_base (239)..(239): a, c, t, g, unknown or other
  modified_base (277)..(277): a, c, t, g, unknown or other
  modified_base (317)..(317): a, c, t, g, unknown or other
  modified_base (322)..(322): a, c, t, g, unknown or other
  modified_base (335)..(335): a, c, t, g, unknown or other
  modified_base (346)..(346): a, c, t, g, unknown or other
  modified_base (468)..(468): a, c, t, g, unknown or other
  modified_base (491)..(491): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagcttgggttttcctcgttactcttttaagaggtgtccagtgtcaggtncactggtggagtcgtgggggagcgtggtccagccgtgggacgtccctgagactctctgtgagcctntggtatttgtcagtgttctggcatgcacgtgggtcccncaggctccgagggcgaaggggccgagtggtggctagttangcatntgtatggaacttnagtactattangacagtactccggtaagacgggcctattaccgacctactcctaccaaggtacaactaacgttaccccggaaatacgttcgtacgtacgtaggaaatcgaactcgaacgtccggtagaacggnggacgtaacggtacctccgggtnttaccgttgttaaacgtttccggtcggtaggaacggtaaggttacggttaccgggggaaagttcgggaacaacggcgttacggttaacctttaaagtttccgggttcgggggttaccctttccggaacggggttccggggggaaccccgg

SEQ ID NO: 369141 - DNA, 611 bp, Homo sapiens
  misc_feature: GZ8MTXP01EIJ9K.44.73.G07.1.454.CMB.2.raw
  modified_base (301)..(301): a, c, t, g, unknown or other
  modified_base (348)..(348): a, c, t, g, unknown or other
  modified_base (419)..(419): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctaggtggagtcgtgggggagagcggcccagcctgggaactccctgagactctcctgtgcagcctctggattcatccttcgaggacctatcgccatcgccacgtcgggcccnccgaggcctccgaggcgaagggggctgggagtgggtgactaaattanatcaaggaagagtaggaattaggaaagaacacgtacgggacacgtccggaaggacgggccgtatcacgtcncgagagacattacacgaacacactagcatctagactaaagtacgtaacaacctacaaacgtacgtaggaacggtaccgaacgggtcttcggttacttaagtttacgttggtacgacggttacgacccggtcccccgtacggaaccggtacccgggtccccgttcggttaaccggttaaccgttaacccgggg

SEQ ID NO: 369142 - DNA, 654 bp, Homo sapiens
  misc_feature: GZ8MTXP01ES2YG.44.73.G07.1.454.CMB.2.raw
  modified_base (256)..(256): a, c, t, g, unknown or other
  modified_base (297)..(297): a, c, t, g, unknown or other
  modified_base (347)..(347): a, c, t, g, unknown or other
tcagacagtatatacacgaccggtgctcgatttagctctacgctcagggggggagacgagcccagcactggaagtcgccggtgtttccattcggtgatcatcactgaacacagaggactcatcatggactttgggctgagtatgggttttcctcgttgcttcttttaagaggtggccagtgtcaggtgcagctagtggagtcgtgggggagagcggccagcctgggaactccctgagactctcctgtcgcagcctntggattcattctcgaggacctatgccatgcacgtgggcccnccgaggcctccgaggacgaagggggctgggaggtgggtgactaattatancgtaagaagtatagggtaaaattaggaacgaaacacgtaacgggagtaacccgtacgggaaggaacgggccgtaagttacccgtaccggtactaccgaagtaacgaacctaaacgttaccgaaaggaaccaacaacgtgactacgttactagaaccctaaagtacgtaacctaaacctacaaacgtaaggtacgacggaaccgaacggtcttagtacttaagttaagttcggttacgaccggttacggaaccccgtccccgtaacggtaaccgggtacccgttaccccggtcgtttaacgaacccgg

SEQ ID NO: 369143 - DNA, 653 bp, Homo sapiens
  misc_feature: GZ8MTXP01DAQSD.44.73.G07.1.454.CMB.2.raw
  modified_base (207)..(207): a, c, t, g, unknown or other
  modified_base (248)..(248): a, c, t, g, unknown or other
  modified_base (269)..(269): a, c, t, g, unknown or other
  modified_base (303)..(303): a, c, t, g, unknown or other
  modified_base (336)..(336): a, c, t, g, unknown or other
  modified_base (352)..(352): a, c, t, g, unknown or other
tcagacagtatatacacgaccggtgctcgatttagctctacgctcaggggggggagacgagcccagcactggaagtcgccggtgtttccattcggtgatcatcactgaacacagaggactcaccatggactttgggctgagattgggtttttcctcgttgcttcttttaaggaggtggccagtgtcaggtgcagctagtggagtcgngggggagagcggccagcctgggaactcctgagctctcctgngcagcctcgtggattcatctnacggacctatcgaccatcgccacgttcgggcccncgacggcctccgaggcgaagggggctgggaggnggggtagactaaattnatacgaaggaaagatacggaaattaagaaagaacgacgtaacgggagaaccgtaccgggaaggaacgggccgtattccgaaccggttcaccgaagacgaactaacgtaccgaacggaacactactgacactacgtacgaactaaacgtacgtaaactaacctacaaacgtaaggtacggaacggaaccgacgggtaactaggttacttaaacgttgttacgtcggaccgacggttaacccgtcccccgtaggtaacccggtacccgggtaccccgttgttaaccggaaccgttaaccgggg

SEQ ID NO: 369144 - DNA, 575 bp, Homo sapiens
  misc_feature: GZ8MTXP01A7JU1.44.73.G07.1.454.CMB.2.raw
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggagagcggcccagcctgggaactccctgagactctcctgtgcagcctctggattcatcttcaggacctatgccatgcacgtgggtcccgccaggcctcccgaggccgaaagggggctgggaggtggggtggactaattatatccagaagatagggaaattaggaaagaacacgtaacgggagacgtaccggaaggaacgggcccgtattccaccggtctaccaagacgaacaacttccaaggaacacactgacagtctagacaaagtctaaccaaccacaacaagtaggacgacgacggaactgttctattgttagtgcgttacgacgtccccgtgaacgacccggcccgttctcgttaacgtaaccggg

SEQ ID NO: 369145 - DNA, 562 bp, Homo sapiens
  misc_feature: GZ8MTXP01A01EW.44.73.G07.1.454.CMB.2.raw
  modified_base (281)..(281): a, c, t, g, unknown or other
  modified_base (320)..(320): a, c, t, g, unknown or other
  modified_base (338)..(338): a, c, t, g, unknown or other
  modified_base (374)..(374): a, c, t, g, unknown or other
  modified_base (400)..(400): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagcctgggagtccctgagactctcctgtgaagcctctggtatttagttcagttagttctggcatgcacgtgggtcccnccaggctccgaggcgaaggggccgagtggtggcagttanagcatatgatggaacttntagatattatgcagaactcgtgaacgggcaatcacntcaccagacgactaacgttcccgaanactctgtaacctaggaaactgatcgaagtcctagggacgagggcgaaggacctcggtctacgttcgttaattaccgtggtcgaacgaggttagtcgggaaagtcgggacaggcaggtcttagtaacggtcggggtacttccgaacggttcgggggaacccgg

SEQ ID NO: 369146 - DNA, 649 bp, Homo sapiens
  misc_feature: GZ8MTXP01C9EY5.44.73.G07.1.454.CMB.2.raw
  modified_base (214)..(214): a, c, t, g, unknown or other
  modified_base (248)..(248): a, c, t, g, unknown or other
  modified_base (267)..(267): a, c, t, g, unknown or other
  modified_base (299)..(299): a, c, t, g, unknown or other
  modified_base (348)..(348): a, c, t, g, unknown or other
tcagacagtatatacacgaccggtgctcgatttagctctacgctcaggggggggagacgagcccagcactggaagtcgccggtgtttccattcggtgatcatcactgaacacagaggactcaccatggactttgggctgagattgggtttttcctcgttgcttcttttaagaggtggccagtgtcaggtgcagctagtggagtcgtgggggagngcggccagcctgggaactcctgagctctcctgtncagcctctggattcatctnaggacctatcgccatcgctacgtcgggtcccncgaggcctccgaggcgaagggggctgggaggtgggggtgactaaattanatacgaaggaagtagtacgggaaatttaagggaaaacgtaaccgaacggtaaacggggaacgtaaacccgtaccggggaaagggaacggggtacccgtaattacccgaacccggttcaaccgaaggtaaacgaactaaacttaccgaaacggaaaccacgaacgtagacctaagtcgtaacgaactaaactcgtaaaccaacctacaaacgaagtggaacgacacggtctagttacttattagtcgtgcgttgacccgtccccgtagcgtacccggtcccgttactcggaaccgtaacggg

SEQ ID NO: 369147 - DNA, 715 bp, Homo sapiens
  misc_feature: GZ8MTXP01EFAW8.44.73.G07.1.454.CMB.2.raw
  modified_base (262)..(262): a, c, t, g, unknown or other
  modified_base (294)..(294): a, c, t, g, unknown or other
tcagacagtatatacacgaccggtgctcgatttagctctacgctcaggggggaggaactgctcagttaggacccagagggaaccatggaagccccagctcagcttctcttcctcctgctactctggctcccagattccaccggcgaaattgtgttgacacaatctccagccaccctgtctttgtcgtaccggggggaacacgcccaccctctcttggcagggccgcagactgtgacgacgtacttacgcctaggtaaccaanagaagcctggccaggcctaccagacctcctanattactatcgtattacttcgtaggtacgggcctcgtggcctacgtccccacggtccccgtctttacgacggtggaccgtagggtcggggttcgtaccggggactacggtacctttaccaccttacctaccaacccgtatacccgaacccgacgtacccgttaagggacgtcccttaggtaacgttaacgttttgaccgtttagttttaacttacttacggttacctaacgtaaccggttaaagtacggttacgtaccttaccggtaattacgttacctaccggtttccgaccccgtagggaaacctaaaggtacgtaagttactaaccgtaaacggtaagttggcggtacttacgaccctaacttacgttccgttacgttccttacctcttaccccgttacccttacgtaacttcgttaag

SEQ ID NO: 369148 - DNA, 767 bp, Homo sapiens
  misc_feature: GZ8MTXP01EX5L1.44.73.G07.1.454.CMB.2.raw
tcagacagtatatacacgaccggtgctcgatttagctctacgctcaggggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagagcggcccagcctgggaactcctgagactctctgtcgcagcctgtggacttcatccttcgaggtaccctatcgcccatcgccacgtcgggtcccgccaggcctccgagggacgaagggggctgggtaaggtgggggagactaaattagtatacgaaggtaaagtataggggtaaacttaagggaaaacgaacgtaaccgtaaaggggaacgaccgtaacccgggaaagggacggggtaccgtaacgttaccgtaacccgtacgtacccgaaagaacggtaaactaaaccgttaccgaaacgggaaaaccaaccgtaactacgacctaacgttacgttaacggtaaacctaaaacggttaccgttaaaacccgaaacccgtaaccgaaaccgtaaaggtacgggaaaccggaaccgtaaacccgggtcgtttaacggttacgtttaaactttagtttacggtacggttaccggttaccggttaccccggcccccgttaccggaaccggtaccccgggtccccgttacgtttaaccgttaaccggttaacccggggg

SEQ ID NO: 369149 - DNA, 760 bp, Homo sapiens
  misc_feature: GZ8MTXP01DQXEV.44.73.G07.1.454.CMB.2.raw
  modified_base (246)..(246): a, c, t, g, unknown or other
  modified_base (265)..(265): a, c, t, g, unknown or other
tcagacagtatatacacgaccggtgctcgatttagctctacgctcaggggggggagacgagcccagcactggaagtcgccggtgtttccattcggtgatcatcactgaacacagaggactcaccatggactttgggctgagattgggttttcctcgttgcttcttttaaggaggtggccaggtgtcaggtgcagctaggtggagtcgtgggggagagccggcccagccgtgggaacctccctgacnctctcctgtgcaggccctntggattcatcttcaggacctatcgccatcgccacgtcgggtcccgccaggcctccgagggcgaagggggctgggaggtggggtgactaaattatactaccgaaggtaaagagtaggtaaattagggaaaacgtaaccgtaacgtaaaccggggaacgtaaccggtacccgggaaaggggtaaacggggcccgtaacgttacccgtaacccggtacctaccgaaggtaacggtaaactaaacgttaaccgaaacggaaaccaaccgtacgtacgacctaacttaccgtaggtaaacctaaaacttaccgtaaaccctaacccttacgaaaccggtaaggtaacgggaaacggtaaccgacgggtaaccttacggttaacctttaagtttaagtttcgggtacggttaccggttaacgggttaccccgtccccccggttacgggaacccggtaccccgggtccccgttacgttccggttaacccgttaacccggggg

SEQ ID NO: 369150 - DNA, 622 bp, Homo sapiens
  misc_feature: GZ8MTXP01C7LQS.44.73.G07.1.454.CMB.2.raw
  modified_base (238)..(238): a, c, t, g, unknown or other
  modified_base (280)..(280): a, c, t, g, unknown or other
  modified_base (320)..(320): a, c, t, g, unknown or other
  modified_base (328)..(328): a, c, t, g, unknown or other
  modified_base (339)..(339): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagcctgggagtcctgagactctcctgtgaagcctntggtatttagttcagtagttctggcatcgcacgtgggtcccncgaggctccgaggcgaaggggccgagtggtggctagttanagctatangatggaacttnagattatatgacagaacctcgtggaacgggtccattaccgaccattcctacgaagacgaacctaacgttccccggaaactacgtacgttacgtaaccgtaggaaactgactacgacggccgtaggaacgggaggacggtacggtacctcggtccttagtagttaacttacgtggtacggaacggtaagacggttacggggaagtcgggaccaaggttccgttaggtaaccttaggtttaacggttccgggtacgttttacgcgggttaacggggtaacccggg

SEQ ID NO: 369151 - DNA, 675 bp, Homo sapiens
  misc_feature: GZ8MTXP01AHXFA.44.73.G07.1.454.CMB.2.raw
  modified_base (287)..(287): a, c, t, g, unknown or other
  modified_base (303)..(303): a, c, t, g, unknown or other
  modified_base (310)..(310): a, c, t, g, unknown or other
  modified_base (345)..(345): a, c, t, g, unknown or other
  modified_base (378)..(378): a, c, t, g, unknown or other
tcagacagtatatacacgaccggtgctcgatttagctctacgctcagggggagctctgggagaggagcccagcactagaagtcggcggtgtttccattcggtgatcagcactgaacacagaggactcaccatggagtttgggctgagcttgggttttcctcgttacttcttttaagaggtgtccagtgtcaggtgcaccgtggtggagtcgtaggggagcgtggtccagccgtgggacgtccctgagactctctgtgaacgcctgtggtatttagttcagtagttcnggcatgcacgtggccncgaggcncgaggcgaagggggccgaggtgggttgctagttanagcatagcgagtaggaacttctaagattaattngacagtacctccgggaggaaacggggtccctattaccgaacctactccgtaccgaaaggacgtaaacctaacgttaccccggaaactacgtacgttaccggttaaaccgtaggggtaaaacttcgaaccgttccgaaacggtacccgttaagggaaaaccgggtccggtaaagggtacccttcgggtcttaaccggttgtttaaacgttcgttaggtcgggtaacggacgggttagggttaccggggtaaaggtcgggaacaccgggtattacggtaaccgtttaaggtttccgggg

SEQ ID NO: 369152 - DNA, 609 bp, Homo sapiens
  misc_feature: GZ8MTXP01B9IS2.44.73.G07.1.454.CMB.2.raw
  modified_base (287)..(287): a, c, t, g, unknown or other
  modified_base (305)..(305): a, c, t, g, unknown or other
  modified_base (397)..(397): a, c, t, g, unknown or other
  modified_base (534)..(534): a, c, t, g, unknown or other
  modified_base (568)..(568): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcaccgtggtggagtcgtgggggagcttggtccagccgtggggacggtccctgagactctcctgtgaacgcctgtggtatttagttcagtagttcnggcatgcacgtgggtccnccgaggcctcgagggcgaacgggggccggaggtgggttggcgtagttataggctaagttacgtgtagtaggtaaactttcgtaaagtaattnttagtcgactaacgtacgtcccgggtaggaaccgggtcctaattccaacctagttccctacgaaggtacgtaactaacgtaccccggaaactacttcgtacgttaccgaaggtaaatgactacgagcctaggaacgnggccgtaggctcggaacttgttagtacttgtggngacggagcgtaaggggagtcgactagctaagttcttaacgg

SEQ ID NO: 369153 - DNA, 517 bp, Homo sapiens
  misc_feature: GZ8MTXP01C1GV6.44.73.G07.1.454.CMB.2.raw
  modified_base (253)..(253): a, c, t, g, unknown or other
  modified_base (291)..(291): a, c, t, g, unknown or other
  modified_base (331)..(331): a, c, t, g, unknown or other
  modified_base (341)..(341): a, c, t, g, unknown or other
  modified_base (364)..(364): a, c, t, g, unknown or other
  modified_base (367)..(367): a, c, t, g, unknown or other
  modified_base (385)..(385): a, c, t, g, unknown or other
  modified_base (392)..(392): a, c, t, g, unknown or other
  modified_base (402)..(402): a, c, t, g, unknown or other
  modified_base (501)..(501): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagcctntggattcatctcaggacctatgccatgcactgggtccnccaggcctccaggcaagggggctgggagtgggtgcaattntatcagaagntggaattgaaagaacatacgganacncgagaaggcatcacgtcncagaganatcagaacanactgcatctgacaaatcgtaacacctacaacaagtcgaagaccacggctgttactattagttgtgcgttacgacgcccctcgaacgtaccggtccccgngttccgcgtaaccggg

SEQ ID NO: 369154 - DNA, 622 bp, Homo sapiens
  misc_feature: GZ8MTXP01D4SH4.44.73.G07.1.454.CMB.2.raw
  modified_base (283)..(283): a, c, t, g, unknown or other
  modified_base (389)..(389): a, c, t, g, unknown or other
tcagacagtatatacacgaccggtgctcgatttagctctacgctcaggggggaggaactgctcagttaggacccagagggaaccatggaagccccaactcagcttctcttcctcctgctactctggctcccagattccaccggcgaaattgtgttgacacaatctccagccaccctgtctttgtctccgggggaacgagccaccctctcttgcagggccggccagactgttgacgacgacttagcctggtaccaacagaagcctggtcaggcctccagactcncatctatgatacttcgtaggtacggcctgtggcactccccgacgccccgtctttcgagtcggcgtaggtcgggtcgtgggaccaggtacttcacctcctaaccacnctccaccacgtccctagacgtcgtagtaagttactttgacttagtttacttacttacggttactaacgtaacggtaaagacgtcgtacctactaaggttacttcgtaccgtttccgggacccgttacgggaactaaaggttcgaaatactaacgaaacgtaacgtggtacgcgtcgacctaactacttcgttcttccttaacaccttcccgtacccattcttaacttgttaac

SEQ ID NO: 369155 - DNA, 679 bp, Homo sapiens
  misc_feature: GZ8MTXP01CYJ4L.44.73.G07.1.454.CMB.2.raw
  modified_base (312)..(312): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagattgggttttcctcgttgcttcttttaagaggtggccagtgcaggtgcagctagtggagtcgtgggggagagcggccagcctagggaactcccgtgacgactctcctgtcgcagtccctgtggtacttcatcttacgacggtacctatcgaccagtcgcacgtcgggtcccnccgacggctccgaggacggaaggggcgtgggaggtggggtagactaagttatagtaccgaagaaagagtagggaaattaagaaaacgtaacaacgtaaacgggaacgtacgacccggaagggaaacgggtccctaacgttacccacccgtaccgtaccgaagtaaacgaaaccgtaacttacgaaacggaaacacgactacgacatactagaacaagttacaaaccaacctacgaaaccgtaaggtgaacggacgtaaccgggtaacttacgttacgttttaagttagtttacggcgttacgggacttacccgccccggtacggtaacggtccccggtcccgttacgttaacgaaccgttcccgggg

SEQ ID NO: 369156 - DNA, 735 bp, Homo sapiens
  misc_feature: GZ8MTXP01ED74K.44.73.G07.1.454.CMB.2.raw
  modified_base (255)..(255): a, c, t, g, unknown or other
  modified_base (298)..(298): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagagcggccagcctgggaactcctgacgactctctgtgcacgcctntggattcatcttcagacctatgccatcgcacgtcggggtcccnccaggcctccgagggcgaagggggctggggaggtgggtagactaaattatactccgaaggaaagtagtaggtaaattaggaaacgtaacgacgtaaacgggagtaaccgtaccgggaagggaaacgggcccgtaacgttacccgtaacccgtaccgtacccgaaaggtaacgaaaccgtaaacgtttaacccgaaacgggtaaaccaacccgaacgttacggacctaacgttacgttacggtaaacctaaaacgttaccggtaaaccctaaaccctacgtaaaccgtaaaggtacggaacgggaaccgaccgggtaacgttacggtttaccttaacgtttaagttcggtacggaccggttacggacccggtccccccgtacggaacccggttaccccgggtccccgttacgtttaaccgaaccgtttaacccggggg

SEQ ID NO: 369157 - DNA, 871 bp, Homo sapiens
  misc_feature: GZ8MTXP01CAG2D.44.73.G07.1.454.CMB.2.raw
tcagacagtatatacacgaccggtgctcgatttagctctacgctcagggccgctgtgctctcggcggtgtttccattcggtgatcagcactgaacacagaggactcaccatggagtttgggctgagcttgggttttcctcgttactcttttaagaggtgtccagtgtcaggtgcacgtggtggagtcgtgggggagcgtggtccagccgtgggagtcctgagtactctcctgtagaacgtccttgtggtattttagttcagttagttcgtggctagtcgcacgtcgggtcccaccgaggcctcccggaagggccggaacggggggtccggtagttgggttacggctaaggtttagagtctaagttagtgtaagttcgggtaaactttgtaagtaacttagttacgtagaaccgtaaggtaacccgttaccgggtaagggggtaaacggggtccccttaaactttaccccgaaccttacgtttacccgaacccgtaaacgtaaccggtaaaccctaaacccggttacccccgggtaaaacccttacccggtttaacccgtttaaccggttaaacccggttaaaggtaaaacgttcggtaaaccttacccggaaacgggtccccggggttaaggggaaacggggtaaccgggtaccgggttaagggaaccccggttccgggttcctttacggttaacggtttaacgtttacccgggttgggtacgggtaaccgggtaaacgggttagggttacggggttaaacgggttacgggacttaccggggttagttaacccggtaagggtttaactttaaccgggggtaccggggtttaccgttaccgggtaaccgggggttcggggtaaccccggggg

SEQ ID NO: 369158 - DNA, 726 bp, Homo sapiens
  misc_feature: GZ8MTXP01AFH5V.44.73.G07.1.454.CMB.2.raw
  modified_base (252)..(252): a, c, t, g, unknown or other
  modified_base (260)..(260): a, c, t, g, unknown or other
  modified_base (277)..(277): a, c, t, g, unknown or other
  modified_base (294)..(294): a, c, t, g, unknown or other
  modified_base (343)..(343): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagtattcgggtttttcctcgttgcttcttttaagaggtggccagtgtcaggtgcagctagtggagtcgtgggggagacgcggccagccgtggaacctccgtgacgctctctgtncacgcctntgattcatctcagactngccatgcacgtcggccncgacgctccgaggacgagggggctgggaggtgggtacgactaaagttanagtacgaaggaaagtagtaacggaaattaaggaaaacgtaacaaccggtaaacggggaacgtaccgtaccgggaagggtaaacgggtacccgtacgttacccgaacccggttacgtaacccggaaaggtaaccgtaaaccgtaaaccgttaccggaaaacggaaacccaactaaacgtcgaacttaacgtacgtaacgtaaacctaaaacgtttaccgaaacccgtaaacctaccgtaaaacgaaacggtacggaaaccggtaaccgtaacgggtcttacgttagtttacttagttcggaacgttccggaaacggccccgtaaccccggtcggtaacccggtcccgggtccccgttcgttaaccgaacccggttaaccggggg

SEQ ID NO: 369159 - DNA, 739 bp, Homo sapiens
  misc_feature: GZ8MTXP01ACP80.44.73.G07.1.454.CMB.2.raw
  modified_base (286)..(286): a, c, t, g, unknown or other
tcagacagtatatacacgaccggtgctcgatttagctctacgctcaggggggagacgagcccagcactggaagtcgacggtgtttccattcggtgatcatcactgaacacagaggactcaccatggactttgggctgagattgggttttcctcgttgcttcttttaagaggtggccagtgtcaggtgcagctagtggagtcgtgggggagagcggcccagcctgggaacctcccgtgacgactctcctgtgcagccctctggattcattcttacgacggtaacctntcgcctatcgctacggttcgggcccaccggacgtcctaccggaggaccgggtaacgggggtcgtagggggtaggttcgggggtacgtacttaaagttacgtataccggaaaggaagtacggtaaggtaacgttaaacggaaacgtaaccgacggtaaacggggacgaacccgtacggggaacgggaaccggggtacctacttaccggaccttcaacccggaaggtactaaacgtaaccttaacgaacggaaccaacgtaccgtacacctattaccgaagtaactaaacgttaccgtaaacctaaacctaccgtaaagaacgttacggaacggtaaacccgtccggttaacttaggtttaacttaagttgtttacgaacggccgaccgttaccccgtccccgtacggaaccgggtaccccgggtcccttaacgtccgttaacccggttccgggg

SEQ ID NO: 369160 - DNA, 616 bp, Homo sapiens
  misc_feature: GZ8MTXP01DL9LO.44.73.G07.1.454.CMB.2.raw
  modified_base (254)..(254): a, c, t, g, unknown or other
  modified_base (290)..(290): a, c, t, g, unknown or other
  modified_base (336)..(336): a, c, t, g, unknown or other
  modified_base (501)..(501): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagagcggccagccgtgggaactcctgagctctcctgtgcagcctntgattcatctcagctatcgccatgcacgtcggcccncaggctccgaggcgaagggggctagggagtgggtagactaaattanatccgaaggaagataggtaaattaggaaacgaacgacgtaacgggaagtaccctaccgggaaggtaaacggggccctaactttccgaacccgtctaccgaagaacgaacctaactaccgaaggaacacactgactacgtctagactaaagtcgtaaccaaccgtnaaacgtagtggaacgaccacggtcttgttacttaagttagttacggcgaccgttacgacccgtcccccgtacggcggtaccccggtcccgttacgttcgaaccgttaacccgggg

SEQ ID NO: 369161 - DNA, 672 bp, Homo sapiens
  misc_feature: GZ8MTXP01AL63J.44.73.G07.1.454.CMB.2.raw
  modified_base (289)..(289): a, c, t, g, unknown or other
  modified_base (356)..(356): a, c, t, g, unknown or other
  modified_base (614)..(614): a, c, t, g, unknown or other
  modified_base (631)..(631): a, c, t, g, unknown or other
tcagacagtatatacacgaccggtgctcgatttagctctacgctcaggggggaggaactgctcagttaggacccagagggaaccatggaagccccagctcagcttctcttcctcctgctactctggctcccagattccaccggcgaaattgtgttgacacaatctccagccaccctgtctttgcgtccgggggaacagccaccctctcttgcagggccggccagactgttcgacgacgacttacgctggtaaccaacgagaagcctggccaggcctccgagactcctanatctatgtaacttacgttcgtaaggtacgggccttcgtggccactccccgacgccccgtctttccgngtacggcgtagggtacgggtcgtacggggacctacggtactttccaccttacctacccaacccattacccgaaccttaccgccgttaagggaccgtaccgttaggtaaacgttacgttttcggacttttaagtttaacttaccgtacgttacctaaaccgtaaccggtaaacgtacggtacgtaccctacggtaacttactttccgtaccgttcccggtacgtaacggactaaacgtgtaattaacgacgaacgtaanggttacgcttacgtacncttacttcgttctctctaaccgtcctaccgactgttcgtaa

SEQ ID NO: 369162 - DNA, 847 bp, Homo sapiens
  misc_feature: GZ8MTXP01A5EAV.44.73.G07.1.454.CMB.2.raw
  modified_base (170)..(170): a, c, t, g, unknown or other
  modified_base (212)..(212): a, c, t, g, unknown or other
  modified_base (247)..(247): a, c, t, g, unknown or other
  modified_base (255)..(255): a, c, t, g, unknown or other
  modified_base (300)..(300): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagattgggttttcctcgttgcttcttttaagnggtggccagtgtcaggtgcagctagtggagtcgtgggggagngcggccagcctgggaacctcctgacgctctctgtncagcctgnggattcatctcaggacctatcgaccatcgccacgtcgggtccccnccgaggccctccgagggacgaagggggtcgtagggggaggtgggggtacggacttaaagtttacgtaagtaccgaaaggtaagtaaggttacgggtaaaagtttaacgggaaaacgaaccgtaaacggtaaaccggggtaacgtaacccggtacccgggaaaggggtaaaccgggggtacccctaacgtttaccccgaacccggttaccgtaccccgaaaggtaaaccgtaaacccgtaaaccgtttaaccccgaaacgggtaaaaccccaacgtaacccgttacggaaccgtaacttaccggttaacgtaaaccttaaaacggttaccgtaaaacccctaaacccttaccgaaaacccggttaaagggtacgggaaaccggggtaaccgtaaacccggggtcctttagggtttaaacccttaaacgttttagggttacggtaacgggttacccggaacggttaaccccggtccccccggttaacgggaaccgggtacccccgggttccccgttacgtttaaccgggttaacccgttaacccggggg

SEQ ID NO: 369163 - DNA, 719 bp, Homo sapiens
  misc_feature: GZ8MTXP01C0RT9.44.73.G07.1.454.CMB.2.raw
  modified_base (254)..(254): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagagcggccagcctgggaactccctgagctctcctgtgcagcctntggattcattctcaggacctatcgccagtcgaccgacgttcggggtccccgaccgacggcctaccccggaagggggacccgaaagggggggtcctggggggtaacggttggggggttacggacctaaaagtttagtaacgtacccgaaaggtaaaggtagttaaggggaaatttaaacgggaaacgtaacgaaaccggttaacgggacgtaaccgtaccgggaaagggtaaacggggcccgtaacttacgacccgtctaccgaagaacgaactaacgttaccaacggaacacacttagacatctagtaacaaagtacgtaaccaacctacgaaaccgtaaagtacggacgaaccgtacggtaacgttgttacttaagtttagttacggtcgttaccggacggacccgtcccccggtacgccgggtaaccccggtccccgttacgttcgttaaccgtaacccgggg

SEQ ID NO: 369164 - DNA, 607 bp, Homo sapiens
  misc_feature: GZ8MTXP01ANY1W.44.73.G07.1.454.CMB.2.raw
  modified_base (240)..(240): a, c, t, g, unknown or other
  modified_base (271)..(271): a, c, t, g, unknown or other
  modified_base (282)..(282): a, c, t, g, unknown or other
  modified_base (320)..(320): a, c, t, g, unknown or other
  modified_base (324)..(324): a, c, t, g, unknown or other
  modified_base (337)..(337): a, c, t, g, unknown or other
  modified_base (346)..(346): a, c, t, g, unknown or other
  modified_base (500)..(500): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacgtggtggagtcgtgggggagcgtggtccagcctgggacgtccctgagactctcctgtgaagcctntggtatttagttcagttagttctggcatgcncgtgggtcccncaggctcgaggcgaaggggccgagtggtgctagtatgntatntgatggtaacttntagtatatngacagtaactcggtgaaacgggcctattccacgtatcctacagacgaacctacgttacccgaactctcgtagtaacctaggaaatcgaactcgacgtccggtaggaaacggtcgggaccgggtaacgtccgtacggcttacgttagtacttcgnggtcgaacggaaggttacggtacggggagtcgacgcggttccgaaggttaacttaacggttcgggtccgggttccgtttacgggaaccggggttcggggaacccggg

SEQ ID NO: 369165 - DNA, 614 bp, Homo sapiens
  misc_feature: GZ8MTXP01DEBQA.44.73.G07.1.454.CMB.2.raw
  modified_base (211)..(211): a, c, t, g, unknown or other
  modified_base (299)..(299): a, c, t, g, unknown or other
  modified_base (339)..(339): a, c, t, g, unknown or other
  modified_base (348)..(348): a, c, t, g, unknown or other
  modified_base (474)..(474): a, c, t, g, unknown or other
  modified_base (517)..(517): a, c, t, g, unknown or other
  modified_base (521)..(521): a, c, t, g, unknown or other
tcagacagtatatacacgaccggtgctcgatttagctctacgctcaggggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagngcggccagccgtgggaactccctgagactctcctggtgcagcctctggattcatcttcaggacctatgccatcgcacgtcgggtcccnccaggctccgaggcgaagggctgggagtgggtgacaattnatcaggaangtagtaattaagaaagtaacacgtagggaagacgtaccgaagggaacgggcccgtattaccgacccgtacctaccgaagacgaactaaacgttaccaacggtaacaccaactcgacctagtcgtanaacaaactacgtaaccaaccgtacaacgaagtagaacgaaccncggngttcgttacgttattagttcggtgttacggacgttacccgtccccgtacgaaccggtacccgggtccccgttcttcggaaccgttaaccgggg

SEQ ID NO: 369166 - DNA, 647 bp, Homo sapiens
  misc_feature: GZ8MTXP01CA19G.44.73.G07.1.454.CMB.2.raw
  modified_base (253)..(253): a, c, t, g, unknown or other
  modified_base (275)..(275): a, c, t, g, unknown or other
  modified_base (294)..(294): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggtttcctcgttgctcttttaagaggtggccagtgtcaggtgcagctagtggagtctgggggagagcggcccagcctgggaactccctgagactctcctgtgcagccctcnggtattcatctcacggacctangaccatgcacgtgggcccncgaggctccgaggcgaagggggctgggaggtggggtggctaaattatagtaccgaaggtaagagtagggtaattaaggaaacgaacgtacgtaacggggaagtacccgtacggaagggaacggggccgtattccgaacccgtactaccgaagacgaacctaacgttaccgaagggtaaaccacaacgttacgactacggtactaggactaaacgtaccgtaaccaaccgtacaaccgtaagtacggacgaccgacggaacttcgttacgttattagttcgtcgttacggacggacccgtcccccggtagaaccggtacccgggtccccgttacgttcgaaccgttaaccgggg

SEQ ID NO: 369167 - DNA, 783 bp, Homo sapiens
  misc_feature: GZ8MTXP01EP4SV.44.73.G07.1.454.CMB.2.raw
  modified_base (308)..(308): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagattgggtttttcctcgttgctcttttaagaggtggccagtgtcaggtgcagctaggtggagtcgtgggggagagccggccagccgtgggaacctccctgacgctctcctgtgcacgcctcgtggacttcattcttcaggacctatcgcctatgccacgtgggtccccncgaggcctcgagggcgaagggggtctggggaggttggggagactaattagtatccgaaggtaaagagttagggaaactttaagggaaactaaccgaacgttaaacgggggaacgtaacccgttaccgggggaaaggggtaaaccggggtcccgttaaccgtttacccggaaccccggttaccgtaaccccgaaaggaacgtaaacccgtaaacgttacccgaaacggaaacccaacgtacctagaccctattacgtacgaaaccttaaacgtcgtaaacccaaaccgtacaaaccggtaagtacggaacggtaccgccggtaacgttccggttattaaggttttaacgtcgggtttacggaacccggttacccgggttaccccgtcccccccgggttaaccgggaacccggggttaaccccccgggttccccggttaacccgtttccgggttaaccccggtttaaccccgggggg

SEQ ID NO: 369168 - DNA, 740 bp, Homo sapiens
  misc_feature: GZ8MTXP01D5UBL.44.73.G07.1.454.CMB.2.raw
  modified_base (313)..(313): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtggggggagagcggcccagcctgggaacctcctgagactctcgtgtgcagcctctggtacttcattcttacgaggtaccctatcgcctagtcgcctacgtggggtccccncacgggctacccggaggcgaagggggtctggggtaggtgggggtacgactaaatttagtagtaccgaaggaaagtagtaaggaaattaagaaaacggtaacaacggttaaaccgggaaagtacccgtaccggggaaagggaaacggggtacccgtacgttaccgacccgttacgtaccgaagaacggaaacctaacgttaaccgaaacggaaaccaaccaacgtacgtactaacgttacgtaacgtaaactaaaacgttaccgtaaacctaacccgttaacaaaacgtaacggtaaggaaccgtaaccgaccggggtcttacggttacctttaagttacgttagtcggttaccgacggttaccgtcccccgttaaacgggcccggttacccggtccccgttacgtttcggaaccgtttaacccgggg

SEQ ID NO: 369169 - DNA, 640 bp, Homo sapiens
  misc_feature: GZ8MTXP01A6AMT.44.73.G07.1.454.CMB.2.raw
  modified_base (252)..(252): a, c, t, g, unknown or other
  modified_base (275)..(275): a, c, t, g, unknown or other
  modified_base (279)..(279): a, c, t, g, unknown or other
  modified_base (292)..(292): a, c, t, g, unknown or other
  modified_base (322)..(322): a, c, t, g, unknown or other
  modified_base (623)..(623): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccgcagactgttgacgacgacttagcctggtaccaanagaagcctggcaggctccagacncctnatctatgatactntagtaggcctctggcactcccagccccgtntttccagtcggacgtaggtcggggtctggaccagtaccttcacctctcaaccatcccaccgacgcctagacgtcctagaattatttgacgttattttatacgttgttacctaactacggtaaagtaacggtcggtacccctacgtaaattaccgttacctaaccggttttccggaccccgtagggtaacccgtaaaaggttcggtaacttaaacttaccgaaacggtaaactcggttaggccttacggacctaacccgttattcccgttacgttcccttaccgtaacttccccgttccccncttaacccgtttgtaag

SEQ ID NO: 369170 - DNA, 612 bp, Homo sapiens
  misc_feature: GZ8MTXP01B16Z3.44.73.G07.1.454.CMB.2.raw
  modified_base (254)..(254): a, c, t, g, unknown or other
  modified_base (303)..(303): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagcctntggacttcattcttcaggacctatcgccatcgccacgttcggggccccnccgaggcctccgaggacgaagggggctggggaggtgggggtgactaaagttatatccgaaggaagtagtagggaattaagaaacgaacaacgtaacgggaagaccgtaccggaaggaacggggtaccgtacttccgaccgtctaccgagacgaacgtaacttaccgaacggaaccacacgtacgacactctacgaactaaacgtacgtaaccaacctacaacaaggtaggacggacgacggtctgttctagttagtgtcgcgcgaccgccccgtcggaacgcccggtacccgcgttcgccgtaaccggg

SEQ ID NO: 369171 - DNA, 806 bp, Homo sapiens
  misc_feature: GZ8MTXP01A3C8F.44.73.G07.1.454.CMB.2.raw
tcagacagtatatacacgaccggtgctcgatttagctctacgctcaggggggaggaactgctcagttaggacccagagggaaccatggaagccccagctcagcttctcttcctcctgctactctggctcccagattccaccggcgaaattgtgttgacacaatctccagccaccctgtctttgtcgtccgggggaacacgccaccctctcgttgcgacgggccgcagactgttgacgacacttagcctggtaaccaacagacgcctggccacggcctcccagacctcctctatctatcgattacgttctaggtacgggcctacgtggcactccccgacgtccccgtctttcgagggtcggcgtagggtggggtcgtacggggactagtacctttcacctactacccgaacctacgtacccaaccgacgtacccctaaggaccgtacccttagtaaagtttacgttttcggaaccgttttaagttttaaccgtttaccgttagtttacccgtaaaccggtaaaccggttaaaggaaccggttccgggtaacccctttaactaaacgttttaaccgtttaccttaacccgggttttacccggacccccggttaaagggggtaaacccctaaaagggggttcggtaaaaccgttaaacgtaaacccggttaaaaaaccggtaacgttcggggttaccggggtacctttaccgggacccttaacccgttaaccggttttcgttacccgtttaaccttaccttaaccgttttccccctcccccggttacttaaccggtttccgtttaaaag

SEQ ID NO: 369172 - DNA, 550 bp, Homo sapiens
  misc_feature: GZ8MTXP01EKGX3.44.73.G07.1.454.CMB.2.raw
  modified_base (280)..(280): a, c, t, g, unknown or other
  modified_base (324)..(324): a, c, t, g, unknown or other
  modified_base (359)..(359): a, c, t, g, unknown or other
tcagacagtatatacacgaccggtgctcgatttagctctacgctcaggggggaggaactgctcagttaggacccagagggaaccatggaagccccagctcagcttctcttcctcctgctactctggctcccagattccaccggcgaaattgtgttgacacaatctccagccaccctgtctttgtctccggggggaacagccaccctctcttgcagggccggccagactgttgacgacgacttagcctggtaccaacagaagcctggcaggctcccagacnctcatctaatgatactctagtaggcctctggcatcccagcccgnttcagtgcagtggtctgggacagacttcactctcnccgatcaaccagcctagagcctagagtatttgctagtttattactgtactacacgtaagaagtggtacctaccgaaattattacaccgtttcggccccttagggacctaaaaggtgactaatacaaaggaactaggttggccttgacacacttcttctcttctaacttcttcccttacctaacttcttaag

SEQ ID NO: 369173 - DNA, 664 bp, Homo sapiens
  misc_feature: GZ8MTXP01BNQHT.44.73.G07.1.454.CMB.2.raw
tcagacagtatatacacgaccggtgctcgatttagctctacgctcaggggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccgcagactgtgacgacgacttagcctggtaaccaacagaacgcctgggccagggcctacccagacctcctcatctatgtactacttctagtagggccctcgtggcactccccagccccgtctttcgaggtcgcgaggtcggggtcgtacggggactaggaccttccacttccctaccaacctatcccaacccacgccctaaggacgaccctagaaagtacttttggacttagtttaactttacgttacgttctaacgaacgttaaagtaacgtacggtccctaccgaaattacttacctaccgttttcggaccccgtaaggaaaccctaaaggtcggtaactaacgttaaccgaaaacggtaaactcggttacggtccgttacgacctaaccattccgttcttaaccttctaacctttcctccccgttcctaacttaaccgttaacg

SEQ ID NO: 369174 - DNA, 523 bp, Homo sapiens
  misc_feature: GZ8MTXP01C2SUS.44.73.G07.1.454.CMB.2.raw
  modified_base (281)..(281): a, c, t, g, unknown or other
  modified_base (384)..(384): a, c, t, g, unknown or other
  modified_base (408)..(408): a, c, t, g, unknown or other
  modified_base (448)..(448): a, c, t, g, unknown or other
  modified_base (455)..(455): a, c, t, g, unknown or other
  modified_base (464)..(464): a, c, t, g, unknown or other
  modified_base (468)..(468): a, c, t, g, unknown or other
  modified_base (482)..(482): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtctgggggagcgtggtccagcctgggaggtccctgagactctcctgtgaagcctctggtatttagttcagttagttctggcatgcacgtggggtccnccaggctccgaggcaaggggccgagtggttggctagttatagcattagtgattggaaactttcaagattattatgcagaactcgtgaagggcctattcacctncacagacacacgtaccgactactntagtactagaatgatcgacgcgtggagaggacgagctcgntgtagtntacgtgtgngagnggtgggagtcggangcagtctagttcggtcggtcgttacgcggttcggggaaccg

SEQ ID NO: 369175 - DNA, 687 bp, Homo sapiens
  misc_feature: GZ8MTXP01CP6R9.44.73.G07.1.454.CMB.2.raw
  modified_base (300)..(300): a, c, t, g, unknown or other
  modified_base (365)..(365): a, c, t, g, unknown or other
  modified_base (434)..(434): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagtcttgggttttcctcgttactcttttaagaggtgtccagtgtcaggtgcacgtggtggagtcgtggggagcgtggtccagccgtgggacgtcctgacgactctcgtgtagaacgtcctgtaggttacttttagttcaggttagttcgtggctagtcgactacggtcgggtcccncgacggcctacccggagggaccggaagggggcccggtaggttcgggttaggacttaaggtttaanaggactaattagtggtattacggtaaacctttgtaagtaattattagcgtacaagtaacccgttacggnggaaacggtccctaaacttacccaactactccaacaagtacgaacctaaccgttacccgaaactaccgtacgtttaacgtaccgtaaggtaaactagacttacgaccggtacgtaacggaagggacgacggtacggtacctcggtcttacgtacgttatacgtgtacgaagtagacggtggagtagggcacgttgacgtttaacgtaaggttccggtcggttacgttaccgggaacggttcgggggaacccgg

SEQ ID NO: 369176 - DNA, 539 bp, Homo sapiens
  misc_feature: GZ8MTXP01A0R4O.44.73.G07.1.454.CMB.2.raw
  modified_base (261)..(261): a, c, t, g, unknown or other
  modified_base (281)..(281): a, c, t, g, unknown or other
  modified_base (299)..(299): a, c, t, g, unknown or other
  modified_base (337)..(337): a, c, t, g, unknown or other
  modified_base (345)..(345): a, c, t, g, unknown or other
  modified_base (356)..(356): a, c, t, g, unknown or other
  modified_base (362)..(362): a, c, t, g, unknown or other
  modified_base (364)..(364): a, c, t, g, unknown or other
  modified_base (387)..(387): a, c, t, g, unknown or other
  modified_base (496)..(496): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagccgtggggagtccctgagactctcctgtgaagcctntggatttagttcagtgttcnggcatgcacgtgggtccncaggctccgaggcaagggggccgagtggtggcagttanagcatacngatggaacttnaagatntngcagctcgagaacggcattcacntctcagacacacttcccgaatctctagtaccgaggaatgactcgacgtccgtaggaaggacgggtcgaaggtcctcgggcttcgttagttaacttcgtaggtgaccggngttacggtcggggaagtcggacgagttcgtaagttcgtttaag

SEQ ID NO: 369177 - DNA, 674 bp, Homo sapiens
  misc_feature: GZ8MTXP01AGVWT.44.73.G07.1.454.CMB.2.raw
  modified_base (213)..(213): a, c, t, g, unknown or other
  modified_base (261)..(261): a, c, t, g, unknown or other
  modified_base (367)..(367): a, c, t, g, unknown or other
tcagacagtatatacacgaccggtgctcgatttagctctacgctcaggggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagngcggccaggcctgggaactcccgtgagtctctcctgtgcagcccttgnggtacttcacttcttacgacggtacctagtcgcctagtcgcgtacgtcgggcctcgaggcctacgaggcgaaggggtctgggaaggttgggggtagactaaagttntaacgtcgaaggaagtagtacgggtaattaacgggaaacgtaacgaaacgtaccgggaaagtacccgtaccggggaaggaaccggggtaccctagttacccgtacccggttcacgaagaacgaaactaaccgttaccgaacggaaccttacacgtagacaactacacgtaacaaacttacgaaccaacctacaacgaacgtagacgacgtacgtctattacttagttacgttggccgacgaccggttacccgcccccgttaggaacccggttacccggtccccttagttccggaacgtaacccgggg

SEQ ID NO: 369178 - DNA, 516 bp, Homo sapiens
  misc_feature: GZ8MTXP02HUJOY.44.73.G07.1.454.CMB.2.raw
  modified_base (288)..(288): a, c, t, g, unknown or other
  modified_base (339)..(339): a, c, t, g, unknown or other
tcagacagtatatacacgaccggtgctcgatttagctctacgctcagggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggagagcggccagcctgggaactccctgagactctcctgtgcagcctctggattcatctcaggacctatgccatgcactgggtccnccaggctccaggcaaggggctgggagtggggtggcaattatatccagaagntagggaaattggaaagacactaacggagactccgagaagggccgattcaccgtctccagagacaattccaggaacacactgcatctgacaaatgtaacaacctcaacaagtgagacacggctagtctattattgtgcgagcgcccccgtcgacgaccggtcccgcttcgactaccgg

SEQ ID NO: 369179 - DNA, 505 bp, Homo sapiens
  misc_feature: GZ8MTXP02GXC36.44.73.G07.1.454.CMB.2.raw
  modified_base (298)..(298): a, c, t, g, unknown or other
  modified_base (336)..(336): a, c, t, g, unknown or other
  modified_base (359)..(359): a, c, t, g, unknown or other
  modified_base (363)..(363): a, c, t, g, unknown or other
  modified_base (411)..(411): a, c, t, g, unknown or other
  modified_base (422)..(422): a, c, t, g, unknown or other
  modified_base (468)..(468): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtctgggggaggcgtggtccagcctgggaggtccctgagactctcctgtgaagcctctggatttagttcagtagttctggcatgcactgggtccnccaggctccaggcaaggggccgagtggttggcagttanagcatatgatggaacttcagatnttangcagactcgtgaagggccattcacatctccagagacaattcccggaanactctgtaccnggaaatgatcagcctgagaggcgaggactcggactctgtacttacngtcgcgagagtcggggaatcgggacagcagctttaag

SEQ ID NO: 369180 - DNA, 525 bp, Homo sapiens
  misc_feature: GZ8MTXP02G55Y4.44.73.G07.1.454.CMB.2.raw
  modified_base (323)..(323): a, c, t, g, unknown or other
  modified_base (378)..(378): a, c, t, g, unknown or other
  modified_base (388)..(388): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccgccagactgttgacgacgacttagcctggtaccaacagaagcctggccaggctcccagactcctcatctatgatacttctagtaggcctctggcatcccagcccgnttcagtggcagtgggtctgggacagacttcactctcaccatcaccagcctagacncctagaagtntttgctagtttattactgtctacaccgtagagtgctcatatctacttcgtccgtcggacgaacgtaggatagtacaaacgaacgtacgtggcgtcgacactactcttcgtcttctactcttcccgtcctactctacg

SEQ ID NO: 369181 - DNA, 519 bp, Homo sapiens
  misc_feature: GZ8MTXP02IV53T.44.73.G07.1.454.CMB.2.raw
  modified_base (350)..(350): a, c, t, g, unknown or other
  modified_base (363)..(363): a, c, t, g, unknown or other
  modified_base (437)..(437): a, c, t, g, unknown or other
  modified_base (510)..(510): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccggggaacagccaccctctcttgcagggccggccagactgttgacgacgacttagcctggtaccaacagaagcctggccaggctcccagactcctcatctatgatacttctagtaggcctctggcatcccagccccgcttcagtggcaggtgggtctggggacngacttcactctcnccatccaccagccctagacgccctgaagtattttgctagtttattactgtctacaccgtagaagtgcctcaatnttcacttcgccctggaccaagtggatatacaaacgaactgtggctgacaccactctgtcttcacttcgtcccncctatctag

SEQ ID NO: 369182 - DNA, 573 bp, Homo sapiens
  misc_feature: GZ8MTXP02I12YE.44.73.G07.1.454.CMB.2.raw
  modified_base (289)..(289): a, c, t, g, unknown or other
  modified_base (559)..(559): a, c, t, g, unknown or other
tcagacagtatatacacgaccggtgctcgatttagctctacgctcagggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggagagcggcccagcctgggaactcctgagactctcctgtgcagcctctggattcatcttcaggacctatgccatgcactgggtccnccaggctccaggcaaggggctgggagtgggtgactaattatatccgaagaagatagggaaattacggaaaagacacgtaacgggagaaccgtccggaaggaaacggggcccgaattccgacccggtctacccgaagaacgaactaacgttaccgaaggaaaccaacactagacctaatcctagaccaaaatacgtaaccaacctacaacaaagtgaagacacggctgtactattatgtcgacgagaccgccccgtagacgaccggtcccncgttacgactacgg

SEQ ID NO: 369183 - DNA, 525 bp, Homo sapiens
  misc_feature: GZ8MTXP02JF735.44.73.G07.1.454.CMB.2.raw
  modified_base (292)..(292): a, c, t, g, unknown or other
  modified_base (391)..(391): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagcctctggattcatcttcaggacctatgccatgcactgggtccnccaggctccaggcaaggggctgggagtgggtggcaattatatccagaagatggaattgaagacactacggagactccgagaagggccgattcaccgtcnccagagacatcaagacacactgcatctgacaaatagtaaccaacctacaacgaaagtgaacggacacggctgtactattattgtcgacgtagacgcccccgtcgacgacccggtcccgtcttcgacttaccggg

SEQ ID NO: 369184 - DNA, 512 bp, Homo sapiens
  misc_feature: GZ8MTXP02ICBO9.44.73.G07.1.454.CMB.2.raw
tcagacagtatatacacgaccggtgctcgatttagctctacgctcagggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggaggagcggcccagcctgggaactccctgagactctcctgtgcagcctctggattcatcttcaggacctatgccatgcactgggtccgccaggctccaggcaaggggctgggagtgggtggcaattatatccagaagatggaattgaagacactaacggagactccgagaagggccgattcaccgtctccagagacaattcaaggaacacactgcatctgacaaatgtacaacctcacaagtgagacacggctgtctattattgtgcgagacgcccccgtcgacgaccggtccccgcgttcgactacgg

SEQ ID NO: 369185 - DNA, 527 bp, Homo sapiens
  misc_feature: GZ8MTXP02JKEHP.44.73.G07.1.454.CMB.2.raw
  modified_base (289)..(289): a, c, t, g, unknown or other
tcagacagtatatacacgaccggtgctcgatttagctctacgctcagggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggagagcggcccagcctgggaactccctgagactctcctgtgcagcctctggattcatctcaggacctatgccatgcactgggtccncaggctccaggcaaggggctgggagtgggtgcaattatatccagaagatggaattgaagacacgtacggagacctccgagaagggccgattcaccgtctccagagacaattccaaggaacacgactgcatctgacaaatgtaaccaacctcaacaaggtagaggacacggctgtctattattgtcgcgagtaccgcccccgtagaccggtaccggtccccgtacttcggacttaccgg

SEQ ID NO: 369186 - DNA, 509 bp, Homo sapiens
  misc_feature: GZ8MTXP02FGOSM.44.73.G07.1.454.CMB.2.raw
  modified_base (253)..(253): a, c, t, g, unknown or other
  modified_base (325)..(325): a, c, t, g, unknown or other
  modified_base (357)..(357): a, c, t, g, unknown or other
  modified_base (367)..(367): a, c, t, g, unknown or other
  modified_base (433)..(433): a, c, t, g, unknown or other
  modified_base (435)..(435): a, c, t, g, unknown or other
tcagacagtatatacacgaccggtgctcgatttagctctacgctcaggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggccagactgttgacgacgacttagcctggtaccaanagaagcctggcccaggctcccagactcctcatctatgatacttctagtaggcccctggcatcccagccccgnttcagtggcagtgggtctggggaccagacttnactctcaccntcaccagcctagagcctgaagattttgctagtttattactgtctacacgtaagaagtgcctcaatntnactttcgcctggaccaagtgatatcaaacgaactgtagctgcacatctgtactcatccttcccgccactctgta

SEQ ID NO: 369187 - DNA, 524 bp, Homo sapiens
  misc_feature: GZ8MTXP02HSV5V.44.73.G07.1.454.CMB.2.raw
  modified_base (362)..(362): a, c, t, g, unknown or other
  modified_base (381)..(381): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccgcagactgtgacgacgacttagcctggtaccaacagaagcctggccaggctcccagactcctcatctatgatacttctagtagggcctctggcagtcccagccccgcttcagtggcagtgggtctggggacagacttcactctcnccatcaccagccctagacnccctagaaagtattttgctagtttattactgttctacaccgtaagagtggacctaccaattattctactttccgccctaggaccaaagtggatatacaaacgaactgtagctgacacatctgtcttcactctccgcactctag

SEQ ID NO: 369188 - DNA, 513 bp, Homo sapiens
  misc_feature: GZ8MTXP02FWA4L.44.73.G07.1.454.CMB.2.raw
  modified_base (254)..(254): a, c, t, g, unknown or other
  modified_base (294)..(294): a, c, t, g, unknown or other
  modified_base (365)..(365): a, c, t, g, unknown or other
  modified_base (387)..(387): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagcggcccagcctgggaactccctgagactctcctgtgcagcctntggattcatcttcaggacctatgccatgcacgtgggtccncaggctccaggcaaggggctgggagtgggtgcaattatatccagaagatggaattgaaagacactacgganactcgagagggccatcacgtcncagagacatcagacacactgcatctgactaaatgtaaccaacctacaacaagtacgaaggacgacggctagtactattattgtgcgagacgcccccgtgacgaccggtcccgacttcgacgtacgg

SEQ ID NO: 369189 - DNA, 704 bp, Homo sapiens
  misc_feature: GZ8MTXP02I0X7F.44.73.G07.1.454.CMB.2.raw
  modified_base (260)..(260): a, c, t, g, unknown or other
  modified_base (298)..(298): a, c, t, g, unknown or other
  modified_base (337)..(337): a, c, t, g, unknown or other
  modified_base (363)..(363): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtcgtgggggaggcgtggtccagcctgggagtccctgagactctcctgtgaagcctntggatttagttcagtagttctggcatgcactgggtccnccaggctccgaggcgaaggggccgagtggtggcagttanagcatatgatggaactttcgagattnttatgacaagtacctccggtaggaaacggggtcccgtaattccaaccctaactcctacccgaaagacgaaacctaaacgtttacccccgggaaaactaccttaccgttacgttaaaccccgtaggggtaaaacttggaaacgttaccaaacgggtccccttaaggggaaacgggtaagggggaccggaacgggggtaacccgttccgggggtaccttcccggtttagggtttaaactttaaccggttgggttcggtaacccggggtaaggtaaacgggttaaccggggggtaaaaggtcgggggtacccaagggcccgtaaaagggtcccttttaaacggg

SEQ ID NO: 369190 - DNA, 638 bp, Homo sapiens
  misc_feature: GZ8MTXP02JQXIO.44.73.G07.1.454.CMB.2.raw
  modified_base (295)..(295): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaacctccctgagactctcctgtgcagcctctggattcatctcaggacctatgccatgcacgtcgggtcccnccaggcctccgaggcgaaggggctgggaggtggggtgactaattatatccgagaagatggaattggaaagacacgtacggagtacctaccggaaggaaacgggccgtagttccgaaacccgttccaccgaaggaacgtaacctaacgttacccgaagggaaaccaccgaacgtcgaccaattccgagactaaaagttacgtaaaccaaccctacaaacgtaaggtagaacggaacgacgggtctacggttacttaacgtttagttcggtacgtacggaacgacccgtaacccccgtaggaccggtacccggtcccgtaccgtttacggaccgttaacccgggg

SEQ ID NO: 369191 - DNA, 539 bp, Homo sapiens
  misc_feature: GZ8MTXP02FYJ5Z.44.73.G07.1.454.CMB.2.raw
  modified_base (254)..(254): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagcggcccagcctgggaactccctgagactctcctgtgcagcctntggattcatcttcaggacctatgccatgccacgtgggtccgccaggcctccgaggcgaaggggctgggagtggggtggcaattatatccagaagatggaattagaagacactaacgggagacctccgaaggaagggccgattcgaccgtctaccagagacaattaccgaaggaccacactgacatctagacaaatgtaaccaacctacaacaagtgagacacggctgtctattattgtcgcgagacgccccgtacgacgaccggtccccgcgttcgacgtaccgg

SEQ ID NO: 369192 - DNA, 568 bp, Homo sapiens
  misc_feature: GZ8MTXP02F0LSP.44.73.G07.1.454.CMB.2.raw
  modified_base (297)..(297): a, c, t, g, unknown or other
  modified_base (340)..(340): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagcggcccagcctgggaactccctgagactctcctgtgcagcctctggattcatcttcaggacctatcgccatgcacgtggggtcccnccaggcctccgaggcaaggggctgggagtggggtgcaaattanatccagaagatggaattgaaagacacgtaacggagacctccgaagaaaggggcccgaattcaccgtctaccagagacaattaccaaggaacacactacgcatctagacaaaatagtaaaccaacctacaacaagtagaaggacacggctagtacttattaattgtgacgacgtaaccgcccccgtacggacgtacccgggtcccccgtacgttacggaccgttaccgg

SEQ ID NO: 369193 - DNA, 539 bp, Homo sapiens
  misc_feature: GZ8MTXP02IJK9J.44.73.G07.1.454.CMB.2.raw
  modified_base (293)..(293): a, c, t, g, unknown or other
  modified_base (325)..(325): a, c, t, g, unknown or other
  modified_base (405)..(405): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagcggcccagcctgggaactccctgagactctcctgtgcagcctctggattcatcttcaggacctatgccatgcactgggtccncaggctccgaggcaaggggctgggagtggggngctaattatatccaaggaagagtagggaaattggaaagactacgtacggagacctccgaggaacgggccgatcaccgtcncagagacactcagaacacactgaccatctagacaaagtactaaccaacctacaacaagtacgaggacgacggtactgtactatttacgtgtcgacgagacgcccgtcgacgccggtcccgcgttcgacgtacgg

SEQ ID NO: 369194 - DNA, 622 bp, Homo sapiens
  misc_feature: GZ8MTXP02HRXLC.44.73.G07.1.454.CMB.2.raw
  modified_base (286)..(286): a, c, t, g, unknown or other
  modified_base (589)..(589): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggccagactgttgacgacgacttagcctggtaccaacagaagccctggcccaggcctcccagactcctnatctatgatacttctaggtacgggccttctggccatccccagtcccccgtctttcgaggttgggctaggtggggtcctggggaccaggtacctttcacttcctcaccatccaaccacgtccctaaggacgtccctagtaagtattttgacttaagttttatttacgttgttacttaaccgaaccgttaaagaacgtcggtaccctactaaattacttactactttcccgggacccgtacgggaacctaaaggtacggattaactacgaaaacgtaactggttaggctacggacaccattcgtntccttctacttcccttcccgtacactttctacg

SEQ ID NO: 369195 - DNA, 626 bp, Homo sapiens
  misc_feature: GZ8MTXP02J21VB.44.73.G07.1.454.CMB.2.raw
  modified_base (235)..(235): a, c, t, g, unknown or other
tcagacagtatatacacgaccggtgctcgatttagctctacgctcgaggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagagccggccagcctgggaacctccngagactctcctgtgcagcctctggattcatcttcaggacctatcgccatcgcacgtgggtcccgccaggcctcgaggcgaaggggctgggaggtgggtgctaattatatccgaagagataggaattaggaaagacacgtaacggagacctaccggaaggaacgggcccgattaccaccgtctaccagagacaacttccaaggaaaccacaacgtcgacactctagacaaactacgtaaaccaacctacaacgaaaggtagaacggaaccgacgggtacctaggttaccttaagtttaagtttcggtacgaccggtaacggacccggaaccccccgttacggaaccggtaccccggggtacccccgtcgtttaccggacccgttaaccgggg

SEQ ID NO: 369196 - DNA, 566 bp, Homo sapiens
  misc_feature: GZ8MTXP02HFDJT.44.73.G07.1.454.CMB.2.raw
  modified_base (294)..(294): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagcctctggattcatcttcaggacctatgccatgcacgtgggtcccnccaggcctccgaggcaaggggctgggagtgggtgcaattatatccagaagatggaattgaaagacacgtaacggagacctaccggaaggaaacgggcccgaattccacccgtctacccgaagaacgaactaaacttccaaagggaaaccaacactacgactaatctagacaaatacgaacaacctacaacaagtacgaagacacggctgttcttattattgacgtcgagacgcccccgtcgacggcccggttacccgcgttcgacgtaccgg

SEQ ID NO: 369197 - DNA, 693 bp, Homo sapiens
  misc_feature: GZ8MTXP02FTJ0O.44.73.G07.1.454.CMB.2.raw
  modified_base (253)..(253): a, c, t, g, unknown or other
  modified_base (297)..(297): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagcggcccagcctgggaactccctgagctctcctgtgcagcctntggattcatcttcaggtacctatcgccatgccacgtgggtcccnccaggcctccgaggcgaagggggctaggggaggtggggtggactaaagttatatccgaaggaagatagggaaatttggaaaggaccacgtaacgggaagaccgtccgggaaaggaacgggggcccgtaacgtttaccgaccccggttactacccgaaagaacgtaaacctaaacgttacccgaaacgggaaaccaaccaaacgttcgactaacttacccgtagaacctaaaattacgtaaaccctaaacccttacaaacgtaaacggtaggaaacggaccgaacgggtccttaggttaccttaaagtttaacgttagtcggtaccgaacggaaccgccccccgtacggaaccggtaccccgggtcccccgtacgttaccggtaccttaacccgggg

SEQ ID NO: 369198 - DNA, 572 bp, Homo sapiens
  misc_feature: GZ8MTXP02JJNC3.44.73.G07.1.454.CMB.2.raw
  modified_base (294)..(294): a, c, t, g, unknown or other
  modified_base (327)..(327): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagcctctggattcatcttcaggacctatgccatgcacgtgggtcccnccaggcctccaggcaaggggctgggagtggggngactaagttatatccaagaagatagggaattagaaagacacgtaacgggacgaccgtacggaaggaacgggccgtactccgacccgttcaccgagacgaacacttaccgaaggaaccacactgactatctgacaaatacgaacctaacctacaacaagtcggaagacgacggtctagtactattattgcgtcgacgaccgcccccgtaggaccgtacccggtcccgtacgttacgacgtaccggg

SEQ ID NO: 369199 - DNA, 591 bp, Homo sapiens
  misc_feature: GZ8MTXP02HQACV.44.73.G07.1.454.CMB.2.raw
  modified_base (257)..(257): a, c, t, g, unknown or other
  modified_base (298)..(298): a, c, t, g, unknown or other
  modified_base (371)..(371): a, c, t, g, unknown or other
  modified_base (377)..(377): a, c, t, g, unknown or other
  modified_base (381)..(381): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtctgggggagcgtggtccagcctgggagtccctgagactctctgtgaagcctntggatttagttcagtagttctggcatgcacgtggggtcccnccagggcctacccgagggccgaaggggggccggaggtgggtttggctaggttatagcatatgatggaactttnagtatnttangacagactccgtagacgggccattcaccatctccaagacacaacgttacccggaactacttctacgttaccgaaggtaaatcgtaactcgagtccctaaggacggagggccgaagggtacctccgggtcttacgttggttaaactttacgtcggtacgacgtaaggtagtaacgggggaagtcgggacaacggctaaggtactttaacgg

SEQ ID NO: 369200 - DNA, 516 bp, Homo sapiens
  misc_feature: GZ8MTXP02JD10R.44.73.G07.1.454.CMB.2.raw
  modified_base (254)..(254): a, c, t, g, unknown or other
  modified_base (327)..(327): a, c, t, g, unknown or other
  modified_base (385)..(385): a, c, t, g, unknown or other
  modified_base (438)..(438): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggccagactgttgacgacgacttagcctggtaccaanagaagcctggccaggctcccagactcctcatctatgatacttctagtagggcctctggcatccccagccccgnttcagtggcaggtgggtctggggacagacttcactctcaccatcaccagcctaagacnccctagaagtatttgctagtttatactgtactacacgtaagagtgcctcaatntcacttcgcctggaccaagtgatatacaaacgactgtaggctagcactactctgtctcactccttcccgctactctag

SEQ ID NO: 369201 - DNA, 599 bp, Homo sapiens
  misc_feature: GZ8MTXP02HLH5J.44.73.G07.1.454.CMB.2.raw
  modified_base (275)..(275): a, c, t, g, unknown or other
  modified_base (293)..(293): a, c, t, g, unknown or other
  modified_base (375)..(375): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagcggcccagcctgggaactccctgagactctcctgtgcagcctctggattcatctcaggacctangccatgcacgtgggtccnccaggcctccgaggcgaaggggctgggagtgggtgcaaattatatccaagaagataggaaattgaaagacacgtaacggganaccgtccggaagaaaggggcccgtaacgttccgaacccgtctaccgaagaacgaacaaacttaccgaacggaaaccaacgaactacgacaatctagacaaatacgtaacaaaccctacaacaagtagaaggacgacggtactacgttacttaacttagttacgtacgacgaacgaccgcccccgtcggaccgtacccggtaccccgcgttacgaaccgtaccgg

SEQ ID NO: 369202 - DNA, 605 bp, Homo sapiens
  misc_feature: GZ8MTXP02HLBA0.44.73.G07.1.454.CMB.2.raw
  modified_base (261)..(261): a, c, t, g, unknown or other
  modified_base (303)..(303): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagcgtgggttttcctcgttactcttttaagaggtgtccagtgtcaggtgcacctggtggagtcgtgggggagcgtggtccagccgtgggaggtccctgagactctcctgtgagcctntggtatttagttcagtagttctggcatgcacgtcggggtccnccagggcctccgaggcgaacggggccggaggtgggtggctagttatagctatagtgataggaaactttgaagtattattatcgcagaccttccggagaacgggccctaatccaaccatccaccgaagacgaactaacgtaccccggaaactactacgtacgtaaccgtaggaaaatgaactacacgtaccagggaagaacgggcccgaaaggtaccgtcggcttacgttagttaacttacgtggtcgacggtaaggtaggtaaccggggtaaagcggacgaggttaccaaggtactttaagg

SEQ ID NO: 369203 - DNA, 575 bp, Homo sapiens
  misc_feature: GZ8MTXP02JGF5E.44.73.G07.1.454.CMB.2.raw
  modified_base (296)..(296): a, c, t, g, unknown or other
  modified_base (337)..(337): a, c, t, g, unknown or other
  modified_base (354)..(354): a, c, t, g, unknown or other
  modified_base (359)..(359): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtctgggggagcgtggtccagcctgggagtccctgagactctcctgtgaagcctctggatttagttcagtagttctggcatgcactgggtccncaggctccaggcaaggggccgagtggtggcagtatagcatntgatggaacttcagatnttagngcagtactcgtagacgggcctatccactatcctacgagacgaactaacgttacccgaactacttctacgtaccgtaggaatgatcgagccgtaggaagggacggacggaacggtaccgtcgggtacttacgttagttactttacgtcggtacggacggtaggtaacggtaaccgggggaaaggtcggggacgaggtaccgtacggttactttaagg

SEQ ID NO: 369204 - DNA, 703 bp, Homo sapiens
  misc_feature: GZ8MTXP02GO2GY.44.73.G07.1.454.CMB.2.raw
  modified_base (300)..(300): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagccgtgggaggtccctgagactctcctgtgagcctctggtatttagttcagtagttctggcatgcattcgggtccnccaggcctccgaggcgaaggggccgaggtgggttggctagttatagctatatgattgggaacttctaagattattatgacgtagaccgtccggtaggaaacgggtcccgtattacccacctaattccctacccgaaggaacgtaacctaaacgtttacccccgggaaactacccgttacgttacgttaaccccgttagggtaaaaacttcggaacttacccgaaacgtcccgttagggaaaccgggtagggggaccgtaaacgggggtacccttaccgggggtccttaccggtttaggtttaacccgtttaacgtggggttacggaccggtaaggtaaagggttccgggggaaaagttccgggggactaacggggacctaaacggggttaccttttaaacggg

SEQ ID NO: 369205 - DNA, 541 bp, Homo sapiens
  misc_feature: GZ8MTXP02GZUJG.44.73.G07.1.454.CMB.2.raw
  modified_base (300)..(300): a, c, t, g, unknown or other
  modified_base (337)..(337): a, c, t, g, unknown or other
  modified_base (355)..(355): a, c, t, g, unknown or other
  modified_base (361)..(361): a, c, t, g, unknown or other
  modified_base (365)..(365): a, c, t, g, unknown or other
  modified_base (424)..(424): a, c, t, g, unknown or other
  modified_base (496)..(496): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtcgtgggggaggcgtggtccagcctgggaggtccctgagactctcctgtgaagcctctggatttagttcagttagttctggcatgcactgggtccnccaggctcaggcaaggggccgagtggttggcagttanagcatatgatggaacttntagatnttangcagtctcgtgaaacgggccattccacatctaccagacgactaacgttccccggaaacnctctgtaacctagggaaatgatcgacgcctggagacggcgaaggtacctcgggtctcgtaggttacttacgnggtcgacgtagagtaacggggaagtcggacaggcaggtctttaag

SEQ ID NO: 369206 - DNA, 509 bp, Homo sapiens
  misc_feature: GZ8MTXP02F2EAP.44.73.G07.1.454.CMB.2.raw
  modified_base (415)..(415): a, c, t, g, unknown or other
  modified_base (457)..(457): a, c, t, g, unknown or other
  modified_base (463)..(463): a, c, t, g, unknown or other
tcagacagtatatacacgaccggtgctcgatttagctctacgctcagggagctctgggagaggagcccagcactagaagtcggcggtgtttccattcggtgatcagcactgaacacagaggactcaccatggagtttgggctgagcgtgggtttcctcgttactctttaagaggtgtccagtgtcaggtgcacctggtggagtctgggggaggcgtggtccagcctgggaggtccctgagactctcctgtgaagcctctggatttagttcagtagttctggcatgcactgggtccgccaggctccaggcaaggggccggagtgggttggctagttatagcatatgatggaacttcagatatatgcagactcgtagaagggccgattcacatctccagagacaattcccggaaacnctactgtacctggaaaatgaatcagtcctgagaggcgagacncggctntgtatacgtgtcgcgagagtcgggaagtcgacgagcgacgacgtag

SEQ ID NO: 369207 - DNA, 521 bp, Homo sapiens
  misc_feature: GZ8MTXP02GDFNK.44.73.G07.1.454.CMB.2.raw
  modified_base (278)..(278): a, c, t, g, unknown or other
  modified_base (314)..(314): a, c, t, g, unknown or other
  modified_base (320)..(320): a, c, t, g, unknown or other
  modified_base (366)..(366): a, c, t, g, unknown or other
  modified_base (370)..(370): a, c, t, g, unknown or other
  modified_base (380)..(380): a, c, t, g, unknown or other
  modified_base (384)..(384): a, c, t, g, unknown or other
  modified_base (503)..(503): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtctgggggagcgtggtccagcctgggagtccctgagactctcctgtgaagcctctggtattttagttcagtagttctggcatgcactgggtccnccaggctccaggcaaggggccgagtggtgcagttanagcatngatggaacttctagatatatgcagactcgtgaaggccatcacatcncagnacatccgaanctcngtacctaggaaatcgatacgagcctagagaggcgaaggaccttcggcttcgtagttaacttacgtggtcgacgagtagtacgggaaagtcggcaagcgagaacttagtacgtcggggtntttacgcggtcggggacg

SEQ ID NO: 369208 - DNA, 592 bp, Homo sapiens
  misc_feature: GZ8MTXP02JYVMO.44.73.G07.1.454.CMB.2.raw
  modified_base (294)..(294): a, c, t, g, unknown or other
  modified_base (377)..(377): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggagagcggcccagcctgggaactccctgagactctcctgtgcagcctctggattcatcttcaggacctatgccatgcacgtggggtcccnccaggcctccgaggcgaaggggctgggagtggggtggctaattatatccagaagatagggaattcgaaagacactaacggganactccggaaggaaacgggcccgattccgaccgtctacccagaacgacaactccaaggaacacactgacatctagacaaatcgtaaccaacctacaacgaagtacgaacggaacgaaccggtctacggttactaagtttaacgttggtcgacggacggaccgccccccgtacggaccggtaccggtcccccgcgtttaccggaccgttacccgggg

SEQ ID NO: 369209 - DNA, 533 bp, Homo sapiens
  misc_feature: GZ8MTXP02HNPWL.44.73.G07.1.454.CMB.2.raw
  modified_base (281)..(281): a, c, t, g, unknown or other
  modified_base (319)..(319): a, c, t, g, unknown or other
  modified_base (326)..(326): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtctgggggaggcgtggtccagcctgggaggtccctgagactctcctgtgaagcctctggattttagtttcagtagttctggcatgcactgggtcccnccaggctccaggcaaggggccgagtggttggcagttanagcatangatggaacttctagatatatgcagactcgtggaaggccattcaccatctaccagagaccaattcccggaacactctagtacctaggaaatgatcagcctaggagaggcgaggactcggactcgtgtattacgtgtggcgaagtagtcggggaagtcggcacgcaggtcttagtacggttcgggcgtttacgacggttcggggaccgg

SEQ ID NO: 369210 - DNA, 553 bp, Homo sapiens
  misc_feature: GZ8MTXP02F5IMJ.44.73.G07.1.454.CMB.2.raw
  modified_base (293)..(293): a, c, t, g, unknown or other
  modified_base (332)..(332): a, c, t, g, unknown or other
  modified_base (460)..(460): a, c, t, g, unknown or other
  modified_base (470)..(470): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagcctctggattcatcttcaggacctatgccatgcacgtgggtccnccaggctccgaggcaaggggctggagtgggtgcaattanatcagaagatagggaaattgaaagacacgtaacgggaaggtacctccggaaagaaacggggcccgaattcgaacccgtctacccagaacgaacaacttaccaaggaacacactgacatctgcaaaatnaacaacctanacaaagtcgaaggacacggctagtactattaatgtgacgagacgcccccgtcgacgacccggtccccgtcttcgacttaccgg

SEQ ID NO: 369211 - DNA, 641 bp, Homo sapiens
  misc_feature: GZ8MTXP02HA6CP.44.73.G07.1.454.CMB.2.raw
  modified_base (277)..(277): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtctgggggagcgtggtccagcctgggaggtccctgagactctcctgtgagcctctggatttagttcagtagttctggcatgcacgtgggtccnccaggcctccgaggcgaaggggccgagtggtggcagttatgcatatgatggaacttgtagattatatgacagaccttcggtggaaacgggtccgtattccacctatcctacccagaacgtaacctaaacgttacccccggaaactaccgttacgtacgtaaccgtaagggaaaacttagacttacgaacggtacccgtagggacggacgggaccgggaacggaccgtccgggtacttcgttacggtaatttaccgtggtggacggtaggtacgtacgggggtaaaggtcgggacgaacggtcaacggtaacgttaagttacggttccggggtaccgttttaccggacggttcggggggaaccgg

SEQ ID NO: 369212 - DNA, 634 bp, Homo sapiens
  misc_feature: GZ8MTXP02GOHVX.44.73.G07.1.454.CMB.2.raw
  modified_base (293)..(293): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagcctctggattcatcttcaggacctatgccatgcactgggtccnccaggcctccgaggcgaaggggctgggacgtggggtggactaaagttatatccgaaggaaagagtagggaaattaggaaaagtaaccacgttaaacggggaagaaccgtacccgggaaggaaacggggcccgtaagttcccgaacccggtcctaccgaagaacgaaactaacttacccgaaacggaaaccaacaacgtacgactactctagaccaaaagtcgtaaaccaacctacaaacaacgtagacggacgacggtctagtcttaagttattgacgtacgacgaccgcccccgtacggaacggtacccggtccccgtacgttacggtacgttaaccggg

SEQ ID NO: 369213 - DNA, 643 bp, Homo sapiens
  misc_feature: GZ8MTXP02I0995.44.73.G07.1.454.CMB.2.raw
  modified_base (299)..(299): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagattgggttttcctcgttgctcttttaagaggtggccagtgtcaggtgcagctagtggagtcgtgggggagagcggcccagcctgggaacctcccgtgagactctcctgtcgcagcctcgtggattcatctcaggacctatgccatcgcacgtgggtcccncgaggcctccgaggcgaaggggctgggacggtgggtggactaagttatatccgaaggaaagtagtaaggtaattacggaaaagaacgtaacgtaacggggaacgtaacccgtaccgggaaaggaaacggggtacccgtaacttacccgaccggttacctaccggaaagaacgaacctaaacgtacccgaaaggaaaccacgacttaggacctatacgtagaacaaagtactaaaccaacctacgaaacaagagaacggactacggtacctgtacttaacttagttgtcgacgacgacccgcccgtacggacgtacccggtcccgtacgttacgacgttaccggg

SEQ ID NO: 369214 - DNA, 573 bp, Homo sapiens
  misc_feature: GZ8MTXP02GLY8A.44.73.G07.1.454.CMB.2.raw
  modified_base (260)..(260): a, c, t, g, unknown or other
  modified_base (362)..(362): a, c, t, g, unknown or other
  modified_base (399)..(399): a, c, t, g, unknown or other
  modified_base (409)..(409): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtccgtccgggggaacgagcccaccctctcttgcagggcccggccagactgttgacgacgacttagcctggtaaccaanagaagcctggcccaggcctcccagacctcctcatctatgatacttctaggtacgggcctcgtggccactccccagccccgtcttcaggtggcaggtgggtcnggggacagtacttcactctcacatcaccagcctagcncctagaagtntttgctagtttatactgtactacaaccgtaagacgtcgccctactattacttctacgtttccggccgttacgggaacctaaaggtcggtataatacgtaaaacgtaacgtggtagctcgacctacctacttcctgttccttctacttcctacccgctactctag

SEQ ID NO: 369215 - DNA, 574 bp, Homo sapiens
  misc_feature: GZ8MTXP02GEFEG.44.73.G07.1.454.CMB.2.raw
  modified_base (259)..(259): a, c, t, g, unknown or other
  modified_base (300)..(300): a, c, t, g, unknown or other
  modified_base (345)..(345): a, c, t, g, unknown or other
  modified_base (366)..(366): a, c, t, g, unknown or other
  modified_base (371)..(371): a, c, t, g, unknown or other
  modified_base (375)..(375): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagcctgggagtccctgagactctcctgtgaagcctntggtatttagttcagttagttctggcatgcactggggtccnccagggctccgagggcgaaggggccggagtcgggtggctagttanaggctatagtgatggaacttnagatnttangcaagacctccggtaggaacgggccgtattaccacctatcctaccgagacgactaacgttccccggaaactcctacgtacgtaaccgtaggtaaaatgaatcgaacgtcgtaggaggaggcgaggactcgggactcgtgtacttacgtgtcgacgaggtacggtaacgggtaagtcggactagaccgtagtctttaagg

SEQ ID NO: 369216 - DNA, 547 bp, Homo sapiens
  misc_feature: GZ8MTXP02JZAU3.44.73.G07.1.454.CMB.2.raw
  modified_base (263)..(263): a, c, t, g, unknown or other
  modified_base (281)..(281): a, c, t, g, unknown or other
  modified_base (318)..(318): a, c, t, g, unknown or other
  modified_base (343)..(343): a, c, t, g, unknown or other
  modified_base (489)..(489): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagcctgggagtccctgagactcgtcctgtgaagcctctggtatttagttcagttagttcnggcatgcacgtgggtccnccaggctccgaggcgaaggggccgagtggtgcagtangcatatgatgaacttgaagatatangacagtactcgtgaacgggctattcaccatcacaagacgaactaacgttccccggaaatacctctacgtacctaggaaactgaactacgagtcctaggagaggacgaaggcctcgggcttagtgttaacttcgtggacgacggagngtacggggaaatggacagcagtctaagttcgcggggtctttacgacggtcgggaccgg

SEQ ID NO: 369217 - DNA, 528 bp, Homo sapiens
  misc_feature: GZ8MTXP02GCBWH.44.73.G07.1.454.CMB.2.raw
  modified_base (293)..(293): a, c, t, g, unknown or other
  modified_base (457)..(457): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggaggagcggcccagccctgggaactccctgagactctcctgtgcagcctctggattcatcttcaggacctatgccatgcactgggtccnccaggcctccgaggcaaggggctgggagtggggtgcaattatatcagaagatggaattgaagacactaggagacctcgagaaagggccgaattcaccgtctaccagagacaattccgaagaacacactgcatctagacaaatgtaaccaacctacaactaaagngaaggacacggctagtactatttatgtcgcgagacgcccccgtgacgaccggtccccgcttcgactaccgg

SEQ ID NO: 369218 - DNA, 663 bp, Homo sapiens
  misc_feature: GZ8MTXP02H4GX3.44.73.G07.1.454.CMB.2.raw
  modified_base (280)..(280): a, c, t, g, unknown or other
  modified_base (327)..(327): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctccagattccaccggcgaaattgtgttgacacaatctccagccaccctgtctttgtctcgggggaacagccacctctcttgcagggccggcagactgttgacgacgacttagcctggtaaccaacagaagcctggccaggctcccagacctccncatctatgatacttctaggtacggcctgtggcatccccagccccgtnttcgaggtggcgtagggtcggggtctcggggacagtaccttcacttccaccacctactaccaaccgtacgtaccctaaggactcccgtaagtaaagttatttttacgactttaagttttaactttacgttacgttaccttaaaccgtaaccggttaagtaaacggtcggtacccttactaaactttacttaccgttaccgtttccggtacccgttacgggaaccgtaaaggttacggaattaacgtaacgtaaaacgtacgtacggtacggactacgacctaaccgtactcgttacgttaaccttactacttcccttacccgtacctactttcgag

SEQ ID NO: 369219 - DNA, 591 bp, Homo sapiens
  misc_feature: GZ8MTXP02HZ131.44.73.G07.1.454.CMB.2.raw
  modified_base (238)..(238): a, c, t, g, unknown or other
  modified_base (279)..(279): a, c, t, g, unknown or other
  modified_base (313)..(313): a, c, t, g, unknown or other
  modified_base (316)..(316): a, c, t, g, unknown or other
  modified_base (365)..(365): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagcctggaggtcctgagactctcctgtgaagcctntggattttagttcagtagttctggcatgcactggggtcccncagcacgaggacgagggcgagtggtgctagttanagntagtatagatagtaacttgtaagtattatatcgacgagtaccgttcggnggaacggtctacttacacctatccacgaagaacaaactaacgtacccgaactactacgtacgtaacgtaagtaaagtcgaactacgacgtacgaggacggacggacggacgtacgtacgtacgtacgtacgttacgttacgtagtagtacggagtaggtacggtaacggacggacgacgacgacgtaacgtacgttacgtacggtacgtacgtacggtacggacgg

SEQ ID NO: 369220 - DNA, 737 bp, Homo sapiens
  misc_feature: GZ8MTXP02IGEQS.44.73.G07.1.454.CMB.2.raw
  modified_base (187)..(187): a, c, t, g, unknown or other
  modified_base (212)..(212): a, c, t, g, unknown or other
  modified_base (298)..(298): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagattgggttttcctcgttgctcttttaagaggtggccagtgtcaggtncagctaggtggagtcgtgggggagngcggccagcctgggaacctcctgagactctcctgtgcagcctctggattcatcttcaggacctatcgccatgcacgtcgggtcccnccgaggcctccgaggcgaaggggctgggaggtggggtggactaaattatataccgaaggaaagtagtaggaaatttaggaaaacgtacctaacgtaaaccggggaagtaacccgttacccgggaagggaaaccgggtaccccggtaactttacccgaaccccggttaccgtacccgaaaggtaaccgtaaaccgtaaacctttacccgaaaacgggaaacccaaaccgtaaccgttacggaccctaacgttaccgttaacggaaccctaaaacgttaccgtaaaccctaaaacccttaccgaaacgtaaacggtacggaacggaaccgtaacggtccttaggttaccttaactttagttacgtcgaccgtacggacccgtcccccgtacggaaccggtaccccgggtccccgttaccgttacgtaaccgttacccgggg

SEQ ID NO: 369221 - DNA, 501 bp, Homo sapiens
  misc_feature: GZ8MTXP02F2DPP.44.73.G07.1.454.CMB.2.raw
  modified_base (297)..(297): a, c, t, g, unknown or other
  modified_base (331)..(331): a, c, t, g, unknown or other
  modified_base (349)..(349): a, c, t, g, unknown or other
  modified_base (354)..(354): a, c, t, g, unknown or other
  modified_base (357)..(357): a, c, t, g, unknown or other
  modified_base (402)..(402): a, c, t, g, unknown or other
  modified_base (466)..(466): a, c, t, g, unknown or other
  modified_base (476)..(476): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggtttcctcgttactcttttaagaggtgtccagtgtcaggtgcacctggtggagtctgggggaggcgtggtccagcctgggaggtccctgagactctcctgtgaagcctctggatttagttcagtagttctggcatgcactgggtccnccaggctcaggcaaggggccgagtggtggcagtnagcatatgatggaacttnagatntangcagctcgtagacggccgattcacatctcagagacaatcccgaanactctacgtacctggaaatgaatcagcctagacgtaggcgagacgtcggactcgtgtaacttcngtcgacgagngtcgggaagtggcaggtcagcttag

SEQ ID NO: 369222 - DNA, 628 bp, Homo sapiens
  misc_feature: GZ8MTXP02JZQR6.44.73.G07.1.454.CMB.2.raw
  modified_base (299)..(299): a, c, t, g, unknown or other
  modified_base (335)..(335): a, c, t, g, unknown or other
  modified_base (345)..(345): a, c, t, g, unknown or other
  modified_base (356)..(356): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgcttcttttaagaggtggccagtgtcaggtgcagctagtggagtcgtgggggaggagcggcccagcctgggaacctccctgagactctcctgtgcagcctctggattcattctcaggacctatcgccatcgcacgtgggtcccnccgaggctccgaggcgaaggggctgggagtgggtanaactaattanatccaagtaanagtaggaattagaaacgacacgtacggacgacgtaccggaaggaaacgggcctattccgacccgtctaccgaagacgactaactaccgaaaggaaccacgactacgctactacgtagactaaacgtacgtaaccaacctacaaacgtaacggtagacggacacggtacgtacgttacttaagtttacgttgtaccgtaccgaacgtaccccgaacccccgttacgggaccggtaccccggtccccgtacgtttacggacccgtttaccgggg

SEQ ID NO: 369223 - DNA, 539 bp, Homo sapiens
  misc_feature: GZ8MTXP02GACHJ.44.73.G07.1.454.CMB.2.raw
  modified_base (278)..(278): a, c, t, g, unknown or other
  modified_base (313)..(313): a, c, t, g, unknown or other
  modified_base (315)..(315): a, c, t, g, unknown or other
  modified_base (318)..(318): a, c, t, g, unknown or other
  modified_base (327)..(327): a, c, t, g, unknown or other
  modified_base (334)..(334): a, c, t, g, unknown or other
  modified_base (345)..(345): a, c, t, g, unknown or other
  modified_base (385)..(385): a, c, t, g, unknown or other
  modified_base (391)..(391): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagcttgggttttcctcgttactcttttaagaggtgtccagtgtcaggtgcactggtggagtcgtggggagcgtggtccagcctgggagtccctgagactctcctgtgaagcctctggtatttagttcagttagttcttgcatgcactgggtccncaggctccgaggcgaaggggcgagtggtgcagtangnatngatgacttnagatatngacagactcgnggaaggcctaattccactatcacagagacaatacccgaanctacgntacaggaaatgactacacgcctaggaggacggacgaggacctcggacttcgtagttatacgtgtacgacgagtacgtacggggaaagttggacaacgcaagtaacttaagttacggtcgggtactttacgacggttcggggaaccggg

SEQ ID NO: 369224 - DNA, 549 bp, Homo sapiens
  misc_feature: GZ8MTXP02JH3F7.44.73.G07.1.454.CMB.2.raw
  modified_base (300)..(300): a, c, t, g, unknown or other
  modified_base (487)..(487): a, c, t, g, unknown or other
  modified_base (540)..(540): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtcgtccgggggaacagccaccctctcttgcagggccggccagactgttgacgacgacttagcctggtaccaacagaagcctggccaggcctcccagacctcctcatctatgatacttntagtggcctgtggcactccccagccccgtacttcaggttcggcctaggtcggggtctcggggacagtaccttcactctcaccatccaccgagccctagacgcctagaagtatttgacttagtttattactcgtctaacgaacgtaagacgtcgcctacattactctacgttcgcctaggactaaagngatatacaacgtactgtggctgccactcgtctcgtaactctactccgttcccnctactcgta

SEQ ID NO: 369225 - DNA, 659 bp, Homo sapiens
  misc_feature: GZ8MTXP02IEAM2.44.73.G07.1.454.CMB.2.raw
  modified_base (334)..(334): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagagcggcccagccgtgggaactcctgagactctcctgtgcagcctgtggattcatctcaggacctatgccatcgcacgtcgggtcccgccaggcctccgaggcgaaggggctggggaggttgggngactaaagttatatccgaagaagagtaggaaattagaaagacacgtaacggagaccgtaccgaaggaaacggtcccgaacttccgaaccgttccgtaccgaaggaacgaactaaacttaccgaaacggaaccacacgtacgactactcgtacgaactaaacgtacgtaaaccaaccgtacaacgaaacggtagaacggaacgtaaccgggtacttacggttaccttaaacgtttagttacggtacgtaccgtaacgacccggtcccccgttacggaccggtacccccgggtaccccgtaccgtttaccggtaacccgtacccggg

SEQ ID NO: 369226 - DNA, 611 bp, Homo sapiens
  misc_feature: GZ8MTXP02I4QUK.44.73.G07.1.454.CMB.2.raw
  modified_base (325)..(325): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtcgtgggggaggcgtggtccagcctgggaggtccctgagactctcctgtgaagcctctggtatttagttcagttagttctggcatgcacgtcgggtccgccaggcctcccgaggcgaaggggccgaggtggtggcagttanagctagtatgataggtaacttcgtagatattatgactagtacctcgtggaacgggcctattccactatcctaccaagacgtaacaacgttaccccggaaactacgtactcgtaaccgtaggaaaattcgacttcgaacgtcccgtaaggaggacgggacgaggtaccgtacggtcctgtagttactacgtggtagacgagtacggttacggggaagtcgggcaacggcgtagtccgtaagttacggtccggggttacgtttcgaaccggggtttcggggaacccgg

SEQ ID NO: 369227 - DNA, 664 bp, Homo sapiens
  misc_feature: GZ8MTXP02GPVUO.44.73.G07.1.454.CMB.2.raw
  modified_base (282)..(282): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctccagattccaccggcgaaattgtgttgacacaatctccagccacctgtctttgtctccggggggaacagccaccctctcttgcagggccgccagactgttgacgacgacttagcctggtaccaacagaagcctggccaggcctcccagacctccncatctatgatacttcaggtacggcctgtggcactccccagccccgtcttcaggtggactaggtcggggtctggggacagtacttcgactctacaccagtccaaccgtagcctaagcgcctagaaactattttgacttagtttaatttactacgttactaaccgtaaccgtaaaagtaaggtacggtcccttaacctaaatttacttaccgttaaccggtttccgggtaaccccgttacggggaaaccctaaaaggtcgggaaacttaacgtaaaccaaaacggttaaccgtaggttcgggtactacggaacctaacctaacttccgttacgtttaacccgttactaccgtttacccgtcccctaccttacttaccttaaacg

SEQ ID NO: 369228 - DNA, 689 bp, Homo sapiens
  misc_feature: GZ8MTXP02H4P7N.44.73.G07.1.454.CMB.2.raw
  modified_base (294)..(294): a, c, t, g, unknown or other
  modified_base (330)..(330): a, c, t, g, unknown or other
  modified_base (340)..(340): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtctgggggagagcggcccagcctgggaactccctgagactctcctgtgcagcctctggattcatcttcaggacctatgccatgcacgtgggcccnccaggcctccgaggccgaaggggctgggaggtgggngactaattanatccgagaagataggaattggaaagacacgtaacggagaccgtaccggaagggaacggcccaacgtttacccgacccggttcccgtacccgaaaggaaccgtaaacctaaaacgttaccccgaaaacggggaaacccaaccaaccgttacggacctaacttacccgttagaaaccctaaaagtcgttaaaccaaaacccttaccaaacgaaaggttacggaaaggtacccgaaacgggtccttaggttaccttaactttaacgttggtacggtaccgacggtaacccgtccccccgttacggaaaccggaccccggttcccccgacgtttacggtaaccctaccggggg

SEQ ID NO: 369229 - DNA, 503 bp, Homo sapiens
  misc_feature: GZ8MTXP02IP96Q.44.73.G07.1.454.CMB.2.raw
  modified_base (257)..(257): a, c, t, g, unknown or other
  modified_base (296)..(296): a, c, t, g, unknown or other
  modified_base (331)..(331): a, c, t, g, unknown or other
  modified_base (353)..(353): a, c, t, g, unknown or other
  modified_base (357)..(357): a, c, t, g, unknown or other
  modified_base (461)..(461): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactctttaagaggtgtccagtgtcaggtgcacctggtggagtctgggggagcgtggtccagcctgggagtccctgagactctcctgtgaagcctntggatttagttcagtagttctggcatgcactgggtcccncaggctccaggcaggggccgagtgggtgcagttangcatatgatggaacttcagatnttangcagactcgtgaacgggccatcacatctcagacgacaattcccggacactctagtacctggaatgatcagctgagaggcgaggactcggctcgtagtacttacngtgacgagagtaacggggagtcgggacaggccaggctttaag

SEQ ID NO: 369230 - DNA, 623 bp, Homo sapiens
  misc_feature: GZ8MTXP02J4Y9O.44.73.G07.1.454.CMB.2.raw
  modified_base (357)..(357): a, c, t, g, unknown or other
  modified_base (383)..(383): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctggggttttcctcgttactcttttaagaggtgtccagtgtcaggtgcacctggtggagtctggggtaggcgtggtccagcctgggaggtccctgagactctcctgtgaagcctctggatttagttcagtagttctggcatgcactgggtccgcccacgggctcccacggcgaaacggggtcgggcgtgggttggtcgtacgtattagtanatactatatagtagtacgtacttatntaattatcgtacgacgtacgtacgtacggtacggacgtacgtactacctacctacctacgacgacgaacgtaaccgtaaccgtaaccgtacctacgtaccgtacgtaacgtacgtacgtacgtacgacgacgacgacggacggacggacggtacggtacgtcgtcgtacgttacgttacgttacgttacgtacgtacggtaacggtacggtacggtacggtacggacggtacgacgtacg

SEQ ID NO: 369231 - DNA, 629 bp, Homo sapiens
  misc_feature: GZ8MTXP02JL660.44.73.G07.1.454.CMB.2.raw
  modified_base (295)..(295): a, c, t, g, unknown or other
  modified_base (341)..(341): a, c, t, g, unknown or other
  modified_base (379)..(379): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagcggcccagcctgggaactctctgagactctcctgtgcagcctctggattcatcttcaggacctatgccatgccacgtgggtccnccaggcctccgaggcgaaggggctgggagtggggtgactaagttanatcaagaagagtaggaattgaagaacacgtaacggganaccgtaccggaagaacgggccgattccgaccgtctccaagacgacaacttaccaaggaacacactgacatccgtagaacctaaatacgtaaaccaaccctacaaaccgtaaggtacggaacggaacccgaacgggtccttaggttaaccttaagtttaacgtttcggttacggtacggtaacggaacccgtaccccccgtacggaacccgggtaccccggttacccccgtaccgtttacggtaaccccgg

SEQ ID NO: 369232 - DNA, 630 bp, Homo sapiens
  misc_feature: GZ8MTXP02F1FY8.44.73.G07.1.454.CMB.2.raw
  modified_base (294)..(294): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggagagcggcccagcctgggaactccctgacgactctcctgtgcagcctctggattcatcttcaggacctatcgccatgcactgggtccncaggctcgaggcaggggctgggagtggggtgctaattatatccaagagataggaattgaaagacacgtaacgggaagaccgtaccggaaggaacggggcccgtattccacccggtctacccgaagacgaactaacgttccaagggtaaccacactggacctatacgagtacaaaacgtcgtaaccaaacctacaaccgtaaaggtcggaaacggaaccgaccggtaccgttaggttaccttaagtttaacgttggttacgaccggacggtaacccgtcccccgtacgggtaacgtaccccgggtaccccgtaccggttacgaccgttaacccgggg

SEQ ID NO: 369233 - DNA, 541 bp, Homo sapiens
  misc_feature: GZ8MTXP02G9O7D.44.73.G07.1.454.CMB.2.raw
  modified_base (251)..(251): a, c, t, g, unknown or other
  modified_base (290)..(290): a, c, t, g, unknown or other
  modified_base (321)..(321): a, c, t, g, unknown or other
  modified_base (527)..(527): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggactcctgagactctcctgtgcagcctntggattcatcttcaggacctatgccatgcactgggtccncaggctccaggcaaggggctgggagtggggnggcaagttatatccagaagatggaaacttgaaagacacgtaacggagactccggaagaaagggcccgattccaccggtctccgagacgacaattccaaggaaccacgactagccatctgacaaatgtaaccaacctcaactaagcgaacgacaacggtctacgttctagtttatgtgacgacgtacgcccctgacgacggtccccngttacgacgtacgg

SEQ ID NO: 369234 - DNA, 562 bp, Homo sapiens
  misc_feature: GZ8MTXP02I9QQG.44.73.G07.1.454.CMB.2.raw
  modified_base (303)..(303): a, c, t, g, unknown or other
  modified_base (338)..(338): a, c, t, g, unknown or other
  modified_base (341)..(341): a, c, t, g, unknown or other
  modified_base (346)..(346): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (503)..(503): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtcgtgggggaggcgtggtccagccgtgggacggtccctgagactctctgtgaagcctcgtggtatttagttcagttagttctggcatgcacgtggtccncaggcctcgaggcgaggggcgagtggtgctagtanagnatagngatagaacttnagtatntangacagaccgtcgtagaacgggcctattccactatcctacgagacgactaacgttcccgaaatctcgtacgtacctaggaaatgactaccagactggaacggacgcgagtacctcggtccttagtagttaacttcggnggtacgacgtaggtacggtaacggggaagtcggacaggtaccgtacggttactttacgg

SEQ ID NO: 369235 - DNA, 615 bp, Homo sapiens
  misc_feature: GZ8MTXP02I97BP.44.73.G07.1.454.CMB.2.raw
  modified_base (287)..(287): a, c, t, g, unknown or other
  modified_base (329)..(329): a, c, t, g, unknown or other
  modified_base (334)..(334): a, c, t, g, unknown or other
  modified_base (394)..(394): a, c, t, g, unknown or other
  modified_base (398)..(398): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagccgtggggacgtccctggacgctctcctgtgacgcctctggtattttagttcagttgttctggcatcgcacgtcgggtcccncgaggcctccgaggcgaaggggccgagttggtggcagttagngcatngagtagaacttgaagattatacgtgcagtaccttcggaggaacgggcctaattccacgtntacnccgaagacgaactaacgttacccggaactacctctacgtacctaagggaactgactacgaacgcccgtaggaacggcggacgggtacggaccgtcgggtccttacgtagttaacgtttaccgtgtagggtaccgaggtaggtacggggaaagtgggacctaggcgtaagaactttaagtacggttcggggtactttacgacggggttcgggaaccgg

SEQ ID NO: 369236 - DNA, 609 bp, Homo sapiens
  misc_feature: GZ8MTXP02FS123.44.73.G07.1.454.CMB.2.raw
  modified_base (294)..(294): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagcggcccagcctgggaactccctgagactctcctgtgcagcctctggattcatcttcaggacctatgccatgcactgggtcccncgaggctccgaggcaaggggctgggagtgggtgcaattatatccgaagaagataggaattggaaagtacacgtacgggaagacctaccggaaggaaacggggcccgagttccaacccgtctacccgaagaacgaacaacttaccgaacggaacaacactacgacaatcctagacaaatcgtaaaccaacctacaacgaaagtacgaaggacgacggtaccttaggtaccttaagttacgttagtacgtacgaacgtaccgaacccccgttacggaccgtacccgggtcccccgagttaccgaccgttaacccggg

SEQ ID NO: 369237 - DNA, 669 bp, Homo sapiens
  misc_feature: GZ8MTXP02G96AX.44.73.G07.1.454.CMB.2.raw
  modified_base (294)..(294): a, c, t, g, unknown or other
  modified_base (328)..(328): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactcctgagactctcctgtgcagcctctggattcatcttcaggacctatgccatgcacgtgggtcccnccaggcctccgaggcaaggggctgggaggtgggngactaaattatatccgaaggaatagtaggaaattaggaaaacgacacgtaacggaacgacctaccgggaaaggaaacggggtcccgtaagttaccgaacccgttcgtacccgaaggaacgaactaaacgttacccgaaacggaaaccaaccgtaacgtacgactaaactcgtagaacctaaaagtacgtaaaccaaacctacgaaaccgtaacgtaggaaacggaaccgaacgggtacttacggttaccttaacgtttaacgttcgtacgaaccgtacgaacccgtcccccgtacggaaccgtaccccggtccccgtacgtttaccggaaccgttaccggg

SEQ ID NO: 369238 - DNA, 545 bp, Homo sapiens
  misc_feature: GZ8MTXP02GAA6K.44.73.G07.1.454.CMB.2.raw
  modified_base (291)..(291): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggagagcggcccagcctgggaactccctgagactctcctgtgcagcctctggattcatcttcaggacctatgccatgcactgggtccnccaggcctccaggcgaaggggctgggagtggggtgacaattatatccagaagataggaattcgaagacacgtaacgggagacctccggaagaacgggccgatcgaccgtctaccagagacaacttcaaggaacacactgcatctagacaaatcgtaaccacctacacaagtcgaggacacggctgtactattaattgtacgacgtagacgcccccgtacgacggtaccggtccccgacgtttcgacgttaccgg

SEQ ID NO: 369239 - DNA, 595 bp, Homo sapiens
  misc_feature: GZ8MTXP02IK0SI.44.73.G07.1.454.CMB.2.raw
  modified_base (259)..(259): a, c, t, g, unknown or other
  modified_base (300)..(300): a, c, t, g, unknown or other
  modified_base (341)..(341): a, c, t, g, unknown or other
  modified_base (368)..(368): a, c, t, g, unknown or other
  modified_base (552)..(552): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagcctgggagtccctgagactctcctgtgaagcctntggattttagttcagttagttctggcatgcacgtgggtccnccaggctccgaggccgaaggggccgagtggttggcagttanagcatatgatggtaacttcttagattnttatggacagacctcggtaggaaacgggcccgattccaacctatcctacccgaaagaccgtaactaaacgttcccccgggaaactaccttcgttacgttaaaccccttaggggaaaacttggaacttccgaacgccctaggagaagggccgtagggactcgggacttcgtaggtaactttacgnggtacgacgtagaggtaacgggagtcggacgagcgtagtctag

SEQ ID NO: 369240 - DNA, 553 bp, Homo sapiens
  misc_feature: GZ8MTXP02J2O3X.44.73.G07.1.454.CMB.2.raw
  modified_base (282)..(282): a, c, t, g, unknown or other
  modified_base (299)..(299): a, c, t, g, unknown or other
  modified_base (335)..(335): a, c, t, g, unknown or other
  modified_base (338)..(338): a, c, t, g, unknown or other
  modified_base (353)..(353): a, c, t, g, unknown or other
  modified_base (360)..(360): a, c, t, g, unknown or other
  modified_base (509)..(509): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagcctgggagtccctgagactctcctgtgaagcctgtggtatttagttcagttagttcnggcatgcactgggtccncaggctcgaggcgaaggggccgagtggtgcagttanagnatatgatggaacttnaagattntatcgacagactcggtagaacgggcctaattccaccctatcctaccgaggacaactaacgttaccccggaaatccgttctacgtacccgtaggaaacttgaactcgagccgtagacggaggcgagacctcggactcgtagtacttacgngtcgacgaggagtaacggggaagtcggacacgcaaggtcttaag

SEQ ID NO: 369241 - DNA, 525 bp, Homo sapiens
  misc_feature: GZ8MTXP02IW7SJ.44.73.G07.1.454.CMB.2.raw
  modified_base (316)..(316): a, c, t, g, unknown or other
  modified_base (382)..(382): a, c, t, g, unknown or other
  modified_base (397)..(397): a, c, t, g, unknown or other
  modified_base (444)..(444): a, c, t, g, unknown or other
  modified_base (456)..(456): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtctgggggaggcgtggtccagcctgggaggtccctgagactctcctgtgaagcctctggattttagttcagtagttctggcatgcactgggtccgccaggctccaggcaaggggccgagtggtggcagttanagcatatgatggaacttctagatattatgcagacctccgtggaagggccattcaccatctccaganacaactcccggaaanactctcgtacctggaaatgatcagcctagagaggcgacggactcggntcgtgtattacngtgcgagagtcggggaatcggcagcgaagcgttagttacgtcggggtctttacacggttcgggggaccg

SEQ ID NO: 369242 - DNA, 700 bp, Homo sapiens
  misc_feature: GZ8MTXP02HXF53.44.73.G07.1.454.CMB.2.raw
  modified_base (150)..(150): a, c, t, g, unknown or other
  modified_base (296)..(296): a, c, t, g, unknown or other
tcagacagtatatacacgaccggtgctcgatttagctctacgctcagggggagacgagcccagcactggaagtcgccggtgtttccattcggtgatcatcactgaacacagaggactcaccatggattttgggctgagatgggttttccncgttgctcttttaagaggtggccagtgtcaggtgcagctagtggagtcgtgggggagagccgcccagcctgggaactccctgacgactctcctgtgcagcctctggattcattcttcgaggacctatcgccatgcacgtgggtccncgaggcctccgaggccgaaggggctgggaggtggggtgactaagttatataccgaaggaaagtagttagggaaatttaggaaaacgtaaccgtaacgttaaacgggacgtaacccgttaccggggaaaggaaacggggtccccgtaattacccgaacccggttaccgtacccgaaggaacggtaaacctaaacgtttacccgaaacgggaaacccaaccgtaacgtagacctaattaccgttagaaacctaaacgtacgtaaaccaaacccgtacaaacgtaaggtacggaacggtaacgaccggtacgttacgttacttaactttagttacggtacgacgtaacggacccgtcccccgtaggaaccggtacccggtccctacgttacgtaccgttacccgggg

SEQ ID NO: 369243 - DNA, 783 bp, Homo sapiens
  misc_feature: GZ8MTXP02G2559.44.73.G07.1.454.CMB.2.raw
  modified_base (187)..(187): a, c, t, g, unknown or other
  modified_base (210)..(210): a, c, t, g, unknown or other
  modified_base (294)..(294): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagattgggttttcctcgttgcttcttttaagaggtggccagtgtcaggtncagctagtggagtcgtggggagngcggcccagcctgggaacctcctgagactctctgtgcagcctctggattcatcttcaggacctatgccatgcacgtgggtcccncaggcctcgaggcaaggggctgggagtggggtgactaagttatatccgaagaagtagtagggaaatttaggaaaacgtaactaacgttaaacggggaaactaaaccgtacccgggaaagggaaacgggggtacccctaaagtttacccgaaaccccggttaccttaccccgaaaggtaaacggaaaccttaaaacgttacccccggaaagggaaaacccctaaacgaacccttacggaccctaaaagtttcccctaaggaaccttaaaaactcggttaaaaccccaaaacccttaccgaaaaccaaaagggttccggaaacgggaaaaccgaccgggttacttacggtttaccttaaacggttttaaatttcgggtacggtacccggtaaaaggaccccggtaacccccccgttacgggaaaaccgggttaacccccgggggttacccccggccctttttaaccggggaacccgtttaaaccccggggg

SEQ ID NO: 369244 - DNA, 532 bp, Homo sapiens
  misc_feature: GZ8MTXP02I06KU.44.73.G07.1.454.CMB.2.raw
  modified_base (285)..(285): a, c, t, g, unknown or other
  modified_base (388)..(388): a, c, t, g, unknown or other
  modified_base (398)..(398): a, c, t, g, unknown or other
  modified_base (478)..(478): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccggggaacagccaccctctcttgcagggccggccagactgttgacgacgacttagcctggtacccaacagaagcctggcccaggcctcccagactcctnatctatgatacttctagtaggcctctggcatccccagccccgcttcagtggcaggtgggtctggggacagtacttcactcctcaccatccaccagccctagcncctagaagtntttgctagtttattactcgttactactaccgtaagagtcggcctacaattattctacttccgcctgggaccaagtgatanacaaacgtactgtgctgacactatctagtcttcacttcctcccgctactctacg

SEQ ID NO: 369245 - DNA, 521 bp, Homo sapiens
  misc_feature: GZ8MTXP02JG44A.44.73.G07.1.454.CMB.2.raw
  modified_base (253)..(253): a, c, t, g, unknown or other
  modified_base (292)..(292): a, c, t, g, unknown or other
  modified_base (332)..(332): a, c, t, g, unknown or other
  modified_base (340)..(340): a, c, t, g, unknown or other
  modified_base (477)..(477): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagcctntggattcatcttcaggacctatgccatgcactgggtccncaggcctccaggcaaggtgctgggagtgggtgctaaattnatcagaanatggaattgagaacacgtaacggagactcgaaggacgggccgattccaccgtctccagacgacaattccaaggaacacactgcatcagacaaatgtaacaacctcaacagtagagacacggctgtactattattcgngcgagaaccgcccctacggacgtaccggtcccgtcttacgaccg

SEQ ID NO: 369246 - DNA, 549 bp, Homo sapiens
  misc_feature: GZ8MTXP02HFQBS.44.73.G07.1.454.CMB.2.raw
  modified_base (295)..(295): a, c, t, g, unknown or other
  modified_base (375)..(375): a, c, t, g, unknown or other
  modified_base (537)..(537): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgcttcttttaagaggtggccagtgtcaggtgcagctagtggagtcgtgggggagagcggccagcctgggaactccctgagactctcctgtgcagcctctggattcatcttcaggacctatcgccatgcacgtgggtcccncaggctccgaggcaaggggctgggagtggggtgactaagttatatccgaagaagatgggaattcgaaagacactaggganacctccgaggaaacgggccattcaccgtctaccagacgactaattccaaggaacacactgacatctagacaaatgtaaccaacctacaacaagtagacggacacggtctagtacttagttagtgtcgacgacgtaccgccccctaggacgaccggtccccgnttcgactaccgg

SEQ ID NO: 369247 - DNA, 645 bp, Homo sapiens
  misc_feature: GZ8MTXP02HCV9Y.44.73.G07.1.454.CMB.2.raw
  modified_base (235)..(235): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagagcggcccagcctgggaacctccngagctctctgtgcagcctctggattcatctcagacctatcgccatcgcacgtcgggtcccgccaggcctccgaggcgaaggggctgggaggtgggaggactaattatatacgaagaagtatagggtaattacggaaagactacgtaacgggacgaaccgtaccgggaaaggaaaccggggtccgtaacttccgaacccggttacctacccgaaggaacgaaacctaaacgttaccgaaacggaaaccactaacgtacgactaataccgtagaacctaaaagtactaaaccaacctacaaacgaaggtagaacggacgacggtacttcgttacttaacgtttagtggttacgacgtacgacccgtccccgtacggaccggtacccggtcccgtcgtacgtaccgtaccggg

SEQ ID NO: 369248 - DNA, 631 bp, Homo sapiens
  misc_feature: GZ8MTXP02JSXCB.44.73.G07.1.454.CMB.2.raw
  modified_base (301)..(301): a, c, t, g, unknown or other
  modified_base (337)..(337): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagcggcccagccgtgggaactccctgagactctcctgtgcagcctctggattcatccttcgaggacctatcgccatcgcacgtgggtcccnccgaggcctcgaggcgaaggggctgggagtgggtanaactaattatataccgaagaagagtaggtaattagaaagaccacgtaacgggactacgaccggaaggtaacgggccgtagttccgacccgtcgtaccgagaacgacaactaccgaagaaccacacgtcgacatctacgactaaactacgtaaaccaacctacaacgtaaggacgaacggacgacggtcttacgttacgttaatttaagttcggtacgaccgaacgtacccggccccccgtacggtaacccggtacccggtaccccgtaccgtttacgaccggtttaacccgggg

SEQ ID NO: 369249 - DNA, 650 bp, Homo sapiens
  misc_feature: GZ8MTXP02GRW9U.44.73.G07.1.454.CMB.2.raw
  modified_base (253)..(253): a, c, t, g, unknown or other
  modified_base (295)..(295): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaacctcctgagactctcctgtgcagcctntggattcatcttcaggacctatcgccatgcacgtgggtcccncaggcctccgaggcgaaggggctgggagtgggtgactaaattatatccgaagaagagtaggaattggaaagacacgtaacgggacgaccgtaccggaaaggaaacgggcccgtaattccgaacccggttcacccgaagaacgaactaacgttaccgaaaggaaccacacttagactatccgtagaacctaaaagttcaaacctaacctacaacgtaaaggtacggaaacggaacgaaccgggtacttacggttaacctttatttaaacgttggtacgaccggtaacgaccccgtaacccccgtacggaaccggtacccggtcccccgtacgtttaccggaaccgttaacccgggg

SEQ ID NO: 369250 - DNA, 527 bp, Homo sapiens
  misc_feature: GZ8MTXP02HU6AU.44.73.G07.1.454.CMB.2.raw
  modified_base (322)..(322): a, c, t, g, unknown or other
  modified_base (346)..(346): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccacctctcttgcagggccgccagactgtgacgacgacttagcctgctaccaacagaagcctggccaggctcccagactcctcatctatgatacttctagtagggcctctggcatcccagcccgnttcagtggcaggtggtctgggacngacttcactctcacatcaccagcctagacgcctagaacgtatttgctagttttatactgtactacacgtaagagtcgacctactaatacttcactttcggccttagggaacctaagtcgaatactactaaaacgactggtcgctacgcaccatcctaagtcttactactcctccgctactc

SEQ ID NO: 369251 - DNA, 599 bp, Homo sapiens
  misc_feature: GZ8MTXP02FFKGR.44.73.G07.1.454.CMB.2.raw
  modified_base (291)..(291): a, c, t, g, unknown or other
  modified_base (337)..(337): a, c, t, g, unknown or other
  modified_base (359)..(359): a, c, t, g, unknown or other
  modified_base (386)..(386): a, c, t, g, unknown or other
  modified_base (546)..(546): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagcccaccctgtctttgtcgtccggggaacagccaccctctcttgcagggccggccagactgttgacgacgacttagccctggtaccaacagaacgcctgggcccaggcctcccagacctccctnatctatgatacttctaggtagggcctcgtggcatccccagccccgnttcaggtggcaggtcggggtcnggggaccagacttcactcctcaccacnccacacgcctagacgtctagaagttatttgactttagtttacttacgtgtacctaacgaacgtaaagtacgtcgacctactaattacttacctaccgttaccggacccgtagggaaacctaaaggtacgaataacgtaacgaaaacgtactggacgtacncgaccacctagttcttacgtcttactaccttccccggtcccactacttcgtaa

SEQ ID NO: 369252 - DNA, 722 bp, Homo sapiens
  misc_feature: GZ8MTXP02F9KIE.44.73.G07.1.454.CMB.2.raw
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagccgtgggaggtccctgagctctcctgtgaagcctcgtaggtatttagttcaggttagttctggcagtgactacgtgggtcccgccgaggcctaccgagggccgaaggggcccggtaggtgggttggactagttatagctatagtgatggtaaacctttgaagtattattatcgactaagaccgtccggtagggaaccggggtaccctattacccaaccacttcccgtaccgaaagaccggaacctaaaccgtttacccccgggaaataccgtttaccgtaccgttaaacccgtaagggtaaaattcggtaaacgtaccgaaccggtcccgttaagggaacgggaaacggggaccggaaacggggtacccgtccccggggttactttacggttacgtttaacgtttaccgggtaggtaccgggaacgggtaacggtaaacggggtaacggggaaacggttacgggaccgacggtaaccgtaacggttacgtttaacgg

SEQ ID NO: 369253 - DNA, 650 bp, Homo sapiens
  misc_feature: GZ8MTXP02ICNSG.44.73.G07.1.454.CMB.2.raw
  modified_base (300)..(300): a, c, t, g, unknown or other
  modified_base (341)..(341): a, c, t, g, unknown or other
  modified_base (355)..(355): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagtattgggttttcctcgttgcttcttttaagaggtggccagtgtcaggtgcagctagtggagtcgtgggggagagcggccagccgtgggaacctcctgagctctcctgtgcagcctcgtggattcatcttcaggacctatcgccatcgccacgtgggtcccnccgtaggcctccgaggcgaaggggcttagggaggttggggnggactaaagtttanatccgaagaagtatagggtaatttaggaaaacgtaacgacgttaacggacgtaacccgtaccgggaaggaaacgggccgtacgttaccgacccgtctacccgaagacgtaactaaacgttaccgaacggaaaccacacgttacgactactacgttagacctaaagtacgtaaccaaacctacgaacgaacggttagaacggacgacggtacttaggttacctaatttacgtgtacgaccgtacgacccgtccccgtacgaccgtaccggtccccgtacttacgacgtaacccggg

SEQ ID NO: 369254 - DNA, 579 bp, Homo sapiens
  misc_feature: GZ8MTXP02FRVZP.44.73.G07.1.454.CMB.2.raw
  modified_base (255)..(255): a, c, t, g, unknown or other
  modified_base (286)..(286): a, c, t, g, unknown or other
  modified_base (369)..(369): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagcccaccctctcttgcagggccggccagactgttgacgacgacttagcctggtaccaanagaagcctggccaggcctcccagacctcctnatctatgatacttcagtacggcctcgtggcactccccagccccgcttcaggtggcaggtgggtctggggacagacttcactcncaccatccacagcctagacgtcctagaatatttgacttagtttattacgtcgtacacgtcctaccgacgaaaggtacgtcggtacctacctaattacttactaccgtttccgggacccgtacgggtaaccgtaaaggttacggaactaacgtaaccaaaacggtacgtggtacgcgtacgacactatctgtacttcacttcctccgctac

SEQ ID NO: 369255 - DNA, 698 bp, Homo sapiens
  misc_feature: GZ8MTXP02G1CSI.44.73.G07.1.454.CMB.2.raw
  modified_base (253)..(253): a, c, t, g, unknown or other
  modified_base (294)..(294): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagcggcccagcctgggaactccctgagctctcctgtgcagcctntggattcatcttcaggacctatgccatgcacgtgggtcccnccaggcctccgaggcgaagggggctggggaggtggggtggactaattatatccgagaagatagggaattagaaagacacgtaacgggagaaccgtccggaaggaaacgggccgtaagttccgaacccggttctacccgaaggaacgaaactaaacgttacccgaaacgggaaaccaaccgactacgacctaagtccttaggaactaaaagttacgtaaacccaaacccttacgaaacgtaaaggtacggaacgggaaccgaaccggggtccttacgggttacctttaagttttaaacgttcgggttacgggaaccggtacggtaaccccgtccccccgttacggaaccggtaacccccggggttcccccgtaccggtttaccggaacccggtttaacccggggg

SEQ ID NO: 369256 - DNA, 635 bp, Homo sapiens
  misc_feature: GZ8MTXP02JXNBZ.44.73.G07.1.454.CMB.2.raw
  modified_base (284)..(284): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagcctgggagtccctgagctctcctgtgagcctgtgggtctcattcgatagtatttggttnctacgtggggtcccgcaggcctccgaggccgaagggggccggaggtcggggtggcaggtcagtcgtaccgacgagtggggaatggaaggtaagttacttacgcaagacctccggtaggaacggggccctattccaccgacttcctaccgaagacgaactaacttaccaaagtaaatatgacttaggtatttagactaaaagtagaaacgagacgtaggagtaggttacgaacgtacgtaacgttcttagtttaattcgtggtcggtacgggacgggggtacccttaacggaaaacggggtaaacggggttacgggaaacgtacgtaaacgtaaacctaacgttactttaag

SEQ ID NO: 369257 - DNA, 573 bp, Homo sapiens
  misc_feature: GZ8MTXP02IIJDD.44.73.G07.1.454.CMB.2.raw
  modified_base (247)..(247): a, c, t, g, unknown or other
  modified_base (255)..(255): a, c, t, g, unknown or other
  modified_base (277)..(277): a, c, t, g, unknown or other
  modified_base (330)..(330): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagagcggcccagcctgggaactccctgagctctcctgngcagcctntggattcatcttcaggacctangccatgcacgtgggtccgccaggctccgaggcgaaggggctgggaggtggggngactaattatatccagaagagtaggattagaagacacgtaacggagactaccgaggaacgggccgtattcaccgtactcagagaacacttacaaggaaccacactacgctaatctagactaaatacgtaaccacctacacgaaagtgaagacgacggtctgttacttatttagtagttacgacgtacgaccgaaccccgtacggaccggtacccggtccccgtcgttacgtaccgtaaccggg

SEQ ID NO: 369258 - DNA, 694 bp, Homo sapiens
  misc_feature: GZ8MTXP02GYYFL.44.73.G07.1.454.CMB.2.raw
  modified_base (152)..(152): a, c, t, g, unknown or other
  modified_base (253)..(253): a, c, t, g, unknown or other
  modified_base (293)..(293): a, c, t, g, unknown or other
  modified_base (372)..(372): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttccncgttgcttcttttaagaggtggccagtgtcaggtgcagctagtggagtcgtgggggagagcggccagcctgggaactccctgagctctcctgtgcagcctntggattcatctcagacctatcgccatgcacgtcgggtccncgaggcctcgaggcgaaggggctgggaggtgggtggactaagttatagtaccgaagaagtagtaggtaattaggaaaanaccgtagaacggacgaccgtacgaacggacgggacgtacgtaccgaccgtacgacgaagaagtaacgtaactaacgaaacgaaccacgacgtacgactaactacgtaacgaacctaaacgtaaccgtaaaccctaaacctaaccgaaagtaaacggtacggaaacgggaaccgaaacggttcgttaacgttactttaaagtttacggttacggtaccggaccggtaaccggtacccccggtaacccccggtaacccgggtaacccgggttacccccggggtacccccgttacgtttaacccgggtaacccggttaaccgggg

SEQ ID NO: 369259 - DNA, 720 bp, Homo sapiens
  misc_feature: GZ8MTXP02FRRWI.44.73.G07.1.454.CMB.2.raw
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtcgtccgggggaacacgcccaccctctcttgcgagggccggccagactgttgacgacgacttagcctggtaccaacagacgcctggccaggcctcccagacctcctcatctatgatacttcaggtacggcctcgtcggctactccccgacgccccgtctttcgaggttcggcgtagggttcggggtccgtaggggaacctaacgggtacctttccaaccttcccgtaccacccctactcccaaacccgtacgcccccgttaaagaccggtcccttaaggtaaacgttacgtttttagacttaaggttttaactttacgtcgtttactaaccgtaacgtaaggaacgttccggtaccttacaacttacttcgttaccgtttccggccccgttagggaaccctaaaggtaggtaattaacgtaaaccgtaaaacggtaaacgttcgggttacggaccgttacggacccttaaccctaacttccgtttacgttaacctttacctaaccttcccggtttcccctaccgtacgtttcttaacg

SEQ ID NO: 369260 - DNA, 642 bp, Homo sapiens
  misc_feature: GZ8MTXP02JNEUQ.44.73.G07.1.454.CMB.2.raw
  modified_base (255)..(255): a, c, t, g, unknown or other
  modified_base (329)..(329): a, c, t, g, unknown or other
  modified_base (337)..(337): a, c, t, g, unknown or other
  modified_base (349)..(349): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggccagcctgggaacctcctgagactctcctgtgcacgcctcnggattcatctcagacctatgccatcgcacgtcgggtccccgaggcctccgaggcgaaggggctgggaggtgggngactaatntatcgaagaagntaggaattagaaagactacgtaggactacgtacggaaggacgggcctatcccgacgtcctaccgaagaacgaactactaccgaacgaaacctacaacgttcgactatcgaacgaactaaacgttacgtaaaccaaccttacaaacggtaaagtcggaaacggaccgtaaccggtcgtttacgtaccttaagtttaacgttcgggtacgaaccggtaacgacccgttccccccgagggtaaaacccgggtccccgttacccccggatttaccgggaacccgtttaacccggggg

SEQ ID NO: 369261 - DNA, 631 bp, Homo sapiens
  misc_feature: GZ8MTXP02JV1ON.44.73.G07.1.454.CMB.2.raw
  modified_base (305)..(305): a, c, t, g, unknown or other
  modified_base (352)..(352): a, c, t, g, unknown or other
  modified_base (507)..(507): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggattttgggctgagatgggttttcctcgttgctcttttaagaggtggccagtgtcaggtgcagctagtggagtcgtgggggagagcgccagccgtgggaacctccctgacgactcctcctgtgcacgcctcgtggtattcatcttcgaggacctatgccatcgaccgacgtgggacccnccgaggcctaccgaggacgaaggggctgggaggtgggtgactaattntactacgaagaagtgtaggatagaaacacgtaccgtaaggacgaccgtaccggaaggaacgggccgtattccgaccgtctaccgagaacgactacgtacccgaaggaacctacacgtcgacatccgtagaactaatacgtaaaccctaaccgtanaacgaaacgtaggaacgacgtacggtacctagttacttacttagttcggttaccgacggtaacgtaccccgaacccgtacggacccggtacccggtccccgtacgtttacgacccgtaccgggg

SEQ ID NO: 369262 - DNA, 637 bp, Homo sapiens
  misc_feature: GZ8MTXP02GNLPI.44.73.G07.1.454.CMB.2.raw
  modified_base (285)..(285): a, c, t, g, unknown or other
  modified_base (326)..(326): a, c, t, g, unknown or other
  modified_base (334)..(334): a, c, t, g, unknown or other
  modified_base (535)..(535): a, c, t, g, unknown or other
tcagacagtatatacacgaccggtgctcgatttagctctacgctcagggccgctgtgctctcggcggtgtttccattcggtgatcagcactgaacacagaggactcaccatgggagtttgggctgagcttgggttttcctcgttactcttttaagaggtgtccagtgtcaggtgcacctggtggagtcgtgggggaggcggtggtccaggcctgggaggtccctgagactctcctgtgaagcctgtggtatttagttcagttgttctggcatgcacgtgggcccncaggctccgaggcgaaggggccgagttgggtggctagttanagctagtntgagtaggaaactttcgtaagtacttaatttatacggacaacggtaccttccggtaggggaacgggcctaattcccacctaatcctaccgaagaacaacctaacgttaccccgaactactacgtacgttaaccaaggtaaatcgactacgacgcctaggaggagggaccgaaggtccgtcggcttcgtgttaacgttacgngtagcggaacggtaggtacggggaagcggacaaggccgtaagtcgtttaaacgttcgggtaccggggttacgtttaccgaccggggttcgggggaacccggg

SEQ ID NO: 369263 - DNA, 624 bp, Homo sapiens
  misc_feature: GZ8MTXP02H49AZ.44.73.G07.1.454.CMB.2.raw
  modified_base (194)..(194): a, c, t, g, unknown or other
  modified_base (254)..(254): a, c, t, g, unknown or other
  modified_base (295)..(295): a, c, t, g, unknown or other
  modified_base (332)..(332): a, c, t, g, unknown or other
  modified_base (342)..(342): a, c, t, g, unknown or other
  modified_base (353)..(353): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagnggagtctggggggagagcggcccagcctgggaactcctgacgactctcctgtgcagcctntggattcatctcaggacctatgccatcgcacgtggggcccnccgaggcctccgaggcgaagggggctgggaggtgggngactaattanatcgaagaagngtaggtaataggaaacgtacacgtaaacggacaaccgtccgaagggaacggccctacgttaccgacccgtctaccgaacggacgaactaacgttaccgaaggaaccacaacgcgacctatacgttacgactaaaatacgtaaccaaacctacaaaccgtaaggtacgaacgggacgaaccggtcttacgttacttacgtttagtggtacgacgtacggacccgccccgtcggaaacggcccggttccccgtacgtacgtaccgtaccgggg

SEQ ID NO: 369264 - DNA, 694 bp, Homo sapiens
  misc_feature: GZ8MTXP02H3KSL.44.73.G07.1.454.CMB.2.raw
  modified_base (258)..(258): a, c, t, g, unknown or other
  modified_base (484)..(484): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagagccggcccagccgtgggaacctcctgagactctcctgtgcagcctntggattcatcttcaggacctatgccatgcacgtgggtcccgccaggctccgaggcaaggggctagggagtggggtgactaattatataccgagaaagtataggtaattacggaaagacaacgttacgggaagtacctaccggaaggaagggcccgattacccgaaccggtcctacccgaaggacgaaactaacttaccgaaacggaaaccacgaacttacggctanaccttagacctaaaatacgttaaaccaaaaccctacaaaccgtaaacggttaggaacggtaaaccgaaccggggtacttacggtttacccgttaaattttaccgttacggttacggaccggtaacggtaaacccgcccccccggttacggaaacccgggtaccccggttaccccccggtaccgtttacgggtacccgtttaaacccgggg

SEQ ID NO: 369265 - DNA, 533 bp, Homo sapiens
  misc_feature: GZ8MTXP02GFL7Q.44.73.G07.1.454.CMB.2.raw
  modified_base (294)..(294): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtgggagtcgtgggggagagcggccagcctgggaactccctgagactctcctgtgcagcctctggattcatcttcaggacctatgccatgcacgtgggtccncgaggctccaggcaaggtgctgggagtgggtgactaagttatatacgagaagataggaattagaagaacactacgggagacgtacgaagacgggacgactcgaccgtctccagacgacaataccgagaacacactgcatcagacaaagtactaacaactacaacagacgagacacgtctcgtatacgttatcgtgcgacgaacgccccgtacgacggccgtaccgcgttacgtaaccgg

SEQ ID NO: 369266 - DNA, 718 bp, Homo sapiens
  misc_feature: GZ8MTXP02IO0WQ.44.73.G07.1.454.CMB.2.raw
  modified_base (297)..(297): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgcttcttttaagaggtggccagtgtcaggtgcagctagtggagtcgtgggggagagcggccagcctgggacctcctgagactctcctgtgcagcctgtggattcatctcaggtacctatcgccatcgcacgtcgggtcccncgaggcctccgaggcgaaggggctggggaggtgggtgactaagttactatccgaagaaacgtgtagggtaaattaggaaagaccgtaacgtaacgggacgtacccgtacccgggaagggaaacggggtcccgtaactttcccgaacccggttctacccgaaggaaacgaaaccgtaaacgttacccgaaacgggaaaccaaccgtaacttacgacctaactaccgtagaaacctaaaacgttaccgtaaaaccaaacccttaccgaaacgtaaacggtaggaaaccggaaccgtaaccgggtacttacggtttactttaaactttaagttcggttacggaccgtaaccgtacccgtaacccccgttacggaacccggtaccccggttaccccgtacgtttaccggaacccgttacccgggg

SEQ ID NO: 369267 - DNA, 597 bp, Homo sapiens
  misc_feature: GZ8MTXP02FY1UP.44.73.G07.1.454.CMB.2.raw
  modified_base (252)..(252): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggccagcctgggaactccctgagactctcctgtgcagcctntggattcatcttcaggacctatgccatgcacgtgggtcccgccaggcctccgaggcgaaggggctgggaggtgggtggactaattatataccgagaagattagggaattaggaaacgacgactaacgggacgacctccggaaggaacggggcctagttccaccgtctaccgagacgaacaacgttaccaacggtaacaacacgtcgactataccgtagactaaaatacgtaacccaaccttacaacgtaaagtacgaacggacgacggtactagtcttaacgttagttgtacgacgacgaccgtccccgacgtacggtacccgtcccggtactcgtactaccggg

SEQ ID NO: 369268 - DNA, 616 bp, Homo sapiens
  misc_feature: GZ8MTXP02FJOK9.44.73.G07.1.454.CMB.2.raw
  modified_base (255)..(255): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagcggcccagcctgggaactccctgagactctcctgtgcagcctntggattcatcttcaggacctatgccatgccacgtcggggtcccgcaggcctccgaggcgaagggggctgggaggtggggtggactaaattatatcgaagaagatggaatgaaagacacgtaacggagacgtccgaaggaaacgggccgatcacccgtctaccagacgacaacttaccgaaggaacacactcgacaatcgtagactaaaatacgtaaacctaaacctacaaacgtaaacgtaggaacggaaaccgaaccgggtcgttaggttaccttaagttagttgtacggtacgacggacccgaacccccgtacggaccggtacccgggtcccccgtcgttaccggaccgttacccgggg

SEQ ID NO: 369269 - DNA, 505 bp, Homo sapiens
  misc_feature: GZ8MTXP02FFQ28.44.73.G07.1.454.CMB.2.raw
  modified_base (252)..(252): a, c, t, g, unknown or other
  modified_base (274)..(274): a, c, t, g, unknown or other
  modified_base (291)..(291): a, c, t, g, unknown or other
  modified_base (342)..(342): a, c, t, g, unknown or other
  modified_base (368)..(368): a, c, t, g, unknown or other
  modified_base (449)..(449): a, c, t, g, unknown or other
  modified_base (476)..(476): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtggggagagcggcccagcctgggaactccctgagactctcctgtgcagcctntggattcatcttcaggacctangccatgcactgggtccncaggcctccgaggcaaggggctgggagtggggtgcaattatatccagaagntagggaattgaaagacacgtacgganactcgaagaagggccgattcaccgtctccagagacaattcaagaacacactgcatctgacaaatgtacaacctcaacaagngagacacgctgtctatatgtgcgagcnccccgtgacgcgtcccgactcgactacgg

SEQ ID NO: 369270 - DNA, 725 bp, Homo sapiens
  misc_feature: GZ8MTXP02IKCAM.44.73.G07.1.454.CMB.2.raw
  modified_base (282)..(282): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccacctctcttgcagggccgccagactgtgacgacgacttagcctggtaaccaacgagaagcctggccaggctcccagacctccncatctatgatgcatccaaacgtagggtcacgtcggaccaaccccgagacgtaggttcaggtggctagggtcggggtaccgtggggacacgtacttcgaccttcgtccgaccgtacaacgtaccaaagttcgtaaaccgacgtacccgtaggtaaacgtttagttttacggactttaaggtttttactttacgttacggtactacgtacgtacgttacccgtttcccgtaccggacgggttcccgccgttaccggtaccgggtttccgggggaccggggggtaaccgtaagggggtacgggacgtaagtaccgaacggtaaaccgtaacggtagggtcggtaccgttacgggaccctaaaccgttacgttcccggtttcggtttacccgttttaaacctacccggtttccccctttcccccggaacccgtttactttaacccgg

SEQ ID NO: 369271 - DNA, 561 bp, Homo sapiens
  misc_feature: GZ8MTXP02HLFB8.44.73.G07.1.454.CMB.2.raw
  modified_base (296)..(296): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagagcggcccagcctgggaactccctgagactctcctgtgcagcctctggattcatcttcaggacctatgccatgcacgtgggtcccnccaggcctccgaggcgaaggggctgggaggtggggtggctaattatatccgagaagataggaattagaaagacacgtaacggagacctccggaagaacgggccatcaccgtctaccagagacatccaagaacacactgacatctagacaaatagtaaccaacctacaacgaagtacgaaggacacggtactgttactattagttgtcgcgtaacgaccgtcccccgtcggacgtacccggtccccgtcgttacgacgttaccggg

SEQ ID NO: 369272 - DNA, 609 bp, Homo sapiens
  misc_feature: GZ8MTXP02GNFOV.44.73.G07.1.454.CMB.2.raw
  modified_base (253)..(253): a, c, t, g, unknown or other
  modified_base (294)..(294): a, c, t, g, unknown or other
  modified_base (514)..(514): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggccagcctgggaactccctgagactctcctgtgcagcctntggattcatcttcaggacctatgccatgcacgtgggtcccncaggctcgaggcgaggggctgggagtgggtgactaagttatagtccaaggaagtagtagggtaattaggaaagaaccacgtaaacgggagaccgtaccggaaaggaaacgggcccgtacttaccgaacccgttcaccgaagaagaacaacgttaccaaggaaccacaacgtacgaccaagtctacgacaaactacgtaacccaacctacgaaacgtaagngaacggacacggtactgtaccttagttagtagtcgacgagacccgtaacccccgtacggacgacccgggtccccacgtttacgaccgttaccggg

SEQ ID NO: 369273 - DNA, 669 bp, Homo sapiens
  misc_feature: GZ8MTXP02HUABY.44.73.G07.1.454.CMB.2.raw
  modified_base (253)..(253): a, c, t, g, unknown or other
  modified_base (330)..(330): a, c, t, g, unknown or other
  modified_base (374)..(374): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctccagattccaccggcgaaattgtgttgacacaatctccagccaccctgtctttgtctccgggggaacagccacctctcttgcagggccggccagactgttgacgacgacttagcctggtaaccaanagaacgcctggcccaggcctcccagactcctcatctatgatacttctagtagggcctgtggcactcccagccccgtnttcaggtggctaggtgggtctcggggacagtcttcactcctacnccatccaaccacgtccctagacgtccctagaaacgtattttgacttagttttaatttacgtcgttactaacgtaaccggtaaagtaacggtcgtacccttacctaaatttactttaccttaaccgtttcccgggtacccgtacggggtaaaccctaaaagggttacggtaaacttaaacgtaaccgtaaaaaccggttaaacgttcgggtacgggtacctacggacccgtaaacctacgttccttacggttcctttacctaacgttccctttaccccgccctaacttccttaacg

SEQ ID NO: 369274 - DNA, 517 bp, Homo sapiens
  misc_feature: GZ8MTXP02FRKW6.44.73.G07.1.454.CMB.2.raw
  modified_base (279)..(279): a, c, t, g, unknown or other
  modified_base (284)..(284): a, c, t, g, unknown or other
  modified_base (305)..(305): a, c, t, g, unknown or other
  modified_base (311)..(311): a, c, t, g, unknown or other
  modified_base (313)..(313): a, c, t, g, unknown or other
  modified_base (317)..(317): a, c, t, g, unknown or other
  modified_base (325)..(325): a, c, t, g, unknown or other
  modified_base (333)..(334): a, c, t, g, unknown or other
  modified_base (344)..(344): a, c, t, g, unknown or other
  modified_base (363)..(363): a, c, t, g, unknown or other
  modified_base (376)..(376): a, c, t, g, unknown or other
  modified_base (394)..(394): a, c, t, g, unknown or other
  modified_base (396)..(396): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtctgggggagcgtggtccagcctgggaggtccctgagactctcctgtgaagcctctggatttagttcagtagttcttgcatgcactggggtcccncagcncgaggcgagggcgagtggtgntagtangnatangatgactnagatatannacagactcgngaggcatcacatcacaganactaactccgaanctcacgtacagaaatgananacgacagagaggacggacggacgcggcgtctagtattagtgtgacgagagtacgggtaaggtacggacgacgacgacgtaacgtacgttacgtcggtacggttacgtacggtacgggacgg

SEQ ID NO: 369275 - DNA, 780 bp, Homo sapiens
  misc_feature: GZ8MTXP02FZJO2.44.73.G07.1.454.CMB.2.raw
  modified_base (292)..(292): a, c, t, g, unknown or other
  modified_base (318)..(318): a, c, t, g, unknown or other
  modified_base (420)..(420): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagcgttgggtttcctcgttacttcttttaagaggtgtccagtgtcgaggtgcaccgtggtggagtcggtgggggagcgtggtccagccgtgggacggtccctgagactctcctgtagacgcctgtggtattttagtcagttagttcgnggctagtcgcctacggtcgggtcccnccgagggcctaccgaggaccggaagggggccgtaggttcgggttggacttaaggttactaggactattagagagtaggtaaacctttgaaagtatttagttncggactaacgtaccgttcggtagggaaacgggtccgtaattacccaacctaattccctaaccgaaagaaccgtaaacctaaaccgttcccccggaaaaactccgttaccgttacggtaaacccgttaaagggtaaaacttcgaacgttaccgaaccggtcccgttaaggggaacggaacggggaccgggtaaaacgggtacccgttacccggggtaccctttacgtttaacgggtttaaactttaacccgggttcgggttacgggaaaaccggttaaggggtaaacggttaacccgggggttaaaaggtcggggaaacccgtaaggggaccctaaacggggttaccctttttaaaacggg

SEQ ID NO: 369276 - DNA, 550 bp, Homo sapiens
  misc_feature: GZ8MTXP02GNM05.44.73.G07.1.454.CMB.2.raw
  modified_base (330)..(330): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggccagactgttgacgacgacttagcctggtaccaacagaagcctggcccaggcctcccagacctcctcatctatgatacttctagtaggcctgtggcatccccagccccgtnttcgagtggcaggtgggtctggggacagtacttcactctcaccatccaccagccctagacgccctagaagtatttgctagtttattactgtactacgaaccgtaagagtcgacctacaattacttctacgtttccggcccttagggaacctaaggtggatagtacgaaacgtactgtaggctgcaccgatctgtcttcacttccctcccgctactctacg

SEQ ID NO: 369277 - DNA, 681 bp, Homo sapiens
  misc_feature: GZ8MTXP02GRHKR.44.73.G07.1.454.CMB.2.raw
  modified_base (293)..(293): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaacctcctgagctctcctgtgcagcctctggattcatcttcaggacctatgccatgcacgtgggtcccncaggcctccgaggcaaggggctgggaggtggggtgactaattatatccgaagaagagtaggaattggaaaagacacgtaacgggagaccgtccggaaaggaacgggcccgtaagtccgaacccgtactacccgaaggaacgaacctaaacgttaccgaaacggtaaaccaccgacgtacgactaactcttaggaacctaaacggttaacgtaaaccctaaacccgttacaaaccgtaaaggttacggaaacgggaaccgaaccgggtacgttacggtttaccttaaacgtttaagtttcggtacgtaccggaacggacccggtcccccgttaccggaccggtaccccgggtcccccggtacgtttaccggtaaccgtttaacccgggg

SEQ ID NO: 369278 - DNA, 637 bp, Homo sapiens
  misc_feature: GZ8MTXP02IOS64.44.73.G07.1.454.CMB.2.raw
  modified_base (297)..(297): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgcttcttttaagaggtggccagtgtcaggtgcagctagtggagtcgtgggggagagccggcccagcctgggaacctccctgagactctcctgtgcagcctctggattcatcttcaggacctatgccatgcactcgggtccncaggcctccgaggcgaaggggctagggagtggggtggacaagttatataccgagaaagataggggaaatttggaaagaacgaacgtaacgggagacctacccggaaggggaaacgggcccgtaagttccgaacccgtctacccgagaacgaacaaacttaccgaacggaaccacactgacatctgacaaacgtacaacctaacctacaaacgtaagaggaaacgtaccgacgggtcttacggttacttaacgtttaagttggttcgacggacgaacccgtcccccggtacggtaaccggtacccgggtcccccgtacgtttaccgaccgtttaaccgggg

SEQ ID NO: 369279 - DNA, 643 bp, Homo sapiens
  misc_feature: GZ8MTXP02G57UA.44.73.G07.1.454.CMB.2.raw
  modified_base (309)..(309): a, c, t, g, unknown or other
  modified_base (323)..(323): a, c, t, g, unknown or other
  modified_base (359)..(359): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagagccggccagactgttgacgacgacttagcctggtaccaacagaagcctggccaggctcccagactcctcatctatgatacttctagtagggcctnggcatcccagcccncttcagtgcaggtggtctgggacagacttcactctnaccatccaacctagccctaagactccctagaacgtatttgctaagtttattactgtctaacacgtaagaaagtcgacctacctaaattcttacgtaacgtttccgacccgttaggggtaacccaaaaggttcgggtaaacgttaataacccgtaaaaacggtaaaacccgttagggttacgggaaccgttacggtaccctaaacccgtaactttaccgttaaccgggtttcctttacccggtaaactttccccctttacccccggttaccctaacctttaccgg

SEQ ID NO: 369280 - DNA, 710 bp, Homo sapiens
  misc_feature: GZ8MTXP02GYW2L.44.73.G07.1.454.CMB.2.raw
  modified_base (306)..(306): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagccggcccagccgtgggaactccctgagactctcctgtgcagtcctcgtggattcattcttcaggacctatcgcctatcgccacgtcgggtcccncgaggctccgaggcgaaggggctgggagtgggtgactaattatataccgaagaagtagtagggaattaggaaagaccgacgtaacgggataccgtaccggaaggaaacggggcccgtacttacccgaacccggtcctacccgaagtaacgaacctaacgttacccgaaaggaaccaacgtactacggtactaacgtacgtacggaacctaaaacgttaaccgtaacccaaacccttacgaaaccgtaaaaggtcggaaacgggaccgtaaccgggtacgttacggtttaccttaaaggtttacgttacggttacggaccgtaacggtaacccggaacccccgttacggaaccggtacccccggggttcccccgtacggttaccgtaacccggtttaacccgggg

SEQ ID NO: 369281 - DNA, 762 bp, Homo sapiens
  misc_feature: GZ8MTXP02HNZJG.44.73.G07.1.454.CMB.2.raw
  modified_base (196)..(196): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacngccaccctctcttgcagggccgcagactgtgacgacgacttagcctggtaccaacagaagcctggcccaggcctcccagacctcctcattctatgacttacttcgtaggtacgggcccttcgtcggcactcccccacggccccgtctttcgaggttcggacgtagggttcggggtctaggggaccaggtacccttcactcctaccaccctatcccaaccacgtacccgtaaggacgtacccgtaaggtaaacgttagtttttcgacgtttaagttttttaactttacgttcggttacccttaaaccgtaacccggttaaaggtaacggttcggtaacccccttactaaacgttttactttacccttaccggtttttacccgggaccccgtttacggggaaacccgtaaaagggttcgggtaaacttaacgtaaaccgaaaaaccggttacgtttacggggttaccggtaccgttacggaccctaaccccgttatttcccgttacggtttaacccttacccttaaccttttccccgtttaccccgttactaacgtttcgtttaaacg

SEQ ID NO: 369282 - DNA, 533 bp, Homo sapiens
  misc_feature: GZ8MTXP02FF9V2.44.73.G07.1.454.CMB.2.raw
  modified_base (292)..(292): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggagagcggcccagcctgggaactccctgagactctcctgtgcagcctctggattcatcttcaggacctatgccatgcactgggtccnccaggcctccgaggcaaggggctgggagtggggtgcaagttatatccgagaagatggaattgaaagacactaacggagactccgaagaagggccgattcaccgtctaccagagacaattccaaggaacacactgcatctgacaaatgtaaccaacctacaacaagtagagacacggctgtctattacttgtcgcgacgacgccccgtcggacgaccggtccccgcgttacgacgtaaccgg

SEQ ID NO: 369283 - DNA, 516 bp, Homo sapiens
  misc_feature: GZ8MTXP02GDW8D.44.73.G07.1.454.CMB.2.raw
  modified_base (329)..(329): a, c, t, g, unknown or other
  modified_base (386)..(386): a, c, t, g, unknown or other
  modified_base (480)..(480): a, c, t, g, unknown or other
  modified_base (484)..(484): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggccagactgttgacgacgacttagcctggtaccaacagaagcctggcccaggcctcccagactcctcatctatgatacttctagtagggcctctggcatccccagccccgnttcagtggcaggtggtctggggacagacttcactctcaccatcaccagccctagacncctagaagtatttgctagtttattactgtactacacgtaagagtgcctacatatcactttcgcccgtaggaccaagtgatatacaaacgactgngtcngacacctatctgtctcatcctccgcactctag

SEQ ID NO: 369284 - DNA, 614 bp, Homo sapiens
  misc_feature: GZ8MTXP02FTH4X.44.73.G07.1.454.CMB.2.raw
  modified_base (287)..(287): a, c, t, g, unknown or other
  modified_base (308)..(308): a, c, t, g, unknown or other
  modified_base (348)..(348): a, c, t, g, unknown or other
  modified_base (371)..(371): a, c, t, g, unknown or other
  modified_base (383)..(383): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcaccgtggtggagtcgtgggggagcgtggtacagccgtgggacggtccctgagtactctcctgtgacgcctgtggtatttagttcagttagttcnggctatgctacgtgggtcccncaggcctccgaggcgaaggggccgagtgggtgctagttanagctatagtgagtggtaactttnaagtattattangactaacgtacgtaccggtagggaaacgggtccctaattcccactatccctacgaagacgtaactaacgttccccgaaatccgtacgtacgtaaccgtaggaaactgaactcaacggtcctagggacggtacgggaccgaaggtccgtacggtcttcgttagttaacttacgtggtacgaacgtaggtacggtaacggggaagtcggacgagtaccgtaggtactttaagg

SEQ ID NO: 369285 - DNA, 606 bp, Homo sapiens
  misc_feature: GZ8MTXP02HLS1P.44.73.G07.1.454.CMB.2.raw
  modified_base (282)..(282): a, c, t, g, unknown or other
  modified_base (300)..(300): a, c, t, g, unknown or other
  modified_base (338)..(338): a, c, t, g, unknown or other
  modified_base (340)..(340): a, c, t, g, unknown or other
  modified_base (345)..(345): a, c, t, g, unknown or other
  modified_base (358)..(358): a, c, t, g, unknown or other
  modified_base (365)..(365): a, c, t, g, unknown or other
  modified_base (368)..(369): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagcctgggacgtccctgagactctctgtgaagcctctggtatttagttcagtagttcgngcatcgctacgtcggccncgagcctcgaggacgaaggggcgaggtggtgctagtangnatagngactagtaacttnaagtatntannacagtactcggagacggctactacactatcacgagacaactaacgtacccgaactactacgtacgtaaccgtaagtaaactcgaactacgacgtccgtaggaacggacggtacggaacggtaccgtccggtacgtttacgttaacgttaacgttaacggttacggtacggtacggtaacggtaacggtaacggggtaacgggtacggacggaacggacggtaacgttaacgttaacg

SEQ ID NO: 369286 - DNA, 623 bp, Homo sapiens
  misc_feature: GZ8MTXP02F9VBI.44.73.G07.1.454.CMB.2.raw
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtcgtccgggggaacagccaccctctcttgcagggccggccagactgttgacgacgacttagcctggtaccaacagaagcctggcccaggctcccagcctcctcatctatgatacttctagtagggcctcgtggccactccccagccccgtcttccgaggttcggcaggtcggggtctcggggacaggtacttcacctcctacacccatcccaacccacgccctaggacgccctagaagtattttgacttagtttattactgttactacgaacgtaagagtcggacctacctaattcttactaccgtttccggaccccgttacgggaaccctaaaggtacggtaatacgtaacgaaaacgtaacgtcggtaggaccgtacggacctacctacgttcgttcgttccttccgtacttcccttaccccgtactacttaccgttag

SEQ ID NO: 369287 - DNA, 587 bp, Homo sapiens
  misc_feature: GZ8MTXP02GXK6D.44.73.G07.1.454.CMB.2.raw
  modified_base (257)..(257): a, c, t, g, unknown or other
  modified_base (296)..(296): a, c, t, g, unknown or other
  modified_base (364)..(364): a, c, t, g, unknown or other
  modified_base (368)..(368): a, c, t, g, unknown or other
  modified_base (390)..(390): a, c, t, g, unknown or other
  modified_base (393)..(393): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagccgtgggagtccctgagctctctgtgagcctntggatttagttcagtagttctggcatgcacgtgggtccnccaggctccgaggcaagggggccgagtgggttggctaggttatagcatactgatggaacttgtagatnttangcagctcgtgaacggcatcacntcncagacactaattacccggaactacgtactcgttaaccctagggtaaaactggaacttccgaacgtcccgtagggaacggtaacggcggaacgggtaacctcccggggtaccttacgttaggttaaactttaacggtggtacgacggagtaacggtcggggaaaggtcggacgacgtaccgaggtactttaacgg

SEQ ID NO: 369288 - DNA, 642 bp, Homo sapiens
  misc_feature: GZ8MTXP02F24L3.44.73.G07.1.454.CMB.2.raw
  modified_base (231)..(231): a, c, t, g, unknown or other
  modified_base (252)..(252): a, c, t, g, unknown or other
  modified_base (291)..(291): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtggggagagcggcccagcctgggaactccngagactctcctgtgcagcctntggattcatctcagacctatcgccatgcacgtcgggccncgaggcctaccgaggcgaaggggctgggagtggggtagactaattatataccgaaagagagtaggtaaattaggaaaacgacacgtaacgggaagtaccgtacggaaggaaacggggcctaattcccgaacccgttccaccgaagaacgaaactaacttaccgaacggaaccaactacgtcgactaacttcgagaactaaaagttaccgtaaacctaaccctacgaaaccgtaaaggtcggaaacggtaccgaccggtacgttagttacttaagttacgttggacgaccgaacgtacccgtccccgtacggaacccggtcccggtaccccgtcgttacgaaccgttccggg

SEQ ID NO: 369289 - DNA, 684 bp, Homo sapiens
  misc_feature: GZ8MTXP02IS1HS.44.73.G07.1.454.CMB.2.raw
  modified_base (305)..(305): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagagcggcccagcctgggaacctcctgagactctcctgtgcagcctcgtggattcatccttcgaggtacctatcgccatcgccacgtcgggtcccncgaggcctccgaggcgaaggggctgggaggtggggtagactaaatttagtataccgaaggaaagtagtaggaaatttaggaaaacgacctacgtaacgggaaacgtaccgtacccgggaaagggaaacgggcccgtaacgtttacccgacccgttccgtacccgaaggaacgtaacctaaacgttacccgaaacggaaaccaaccacgttacgactaactactagaactaaatacgtaaacctaaaccctacaaaccgaaaggtacgaacggaaccgacggtaccttaggttacttaactttagttagtacgacgacgtacccgcccccgttacgaccggtacccggtacccccgtcgttacggtacccgttaccgggg

SEQ ID NO: 369290 - DNA, 704 bp, Homo sapiens
  misc_feature: GZ8MTXP02G0WJB.44.73.G07.1.454.CMB.2.raw
  modified_base (307)..(307): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagagccggcccagccgtgggaacctccctgacgctctctgtcgcagcctgtggtattcatcttcaggtacctatcgccagtcgccacgttcgggcccncgacgcctccgaggcgaaggggctgggaggtgggtacgactaaagttactataccgaagtaagagtaggaattaggaaaactaccgtaacgtacggacgtaccgtaccgggaaggtaacgggccgtaacgttcccaaccgttcaccgagaacgtaactaacgtaccgaaaggtaaaccacgtactacgactaacttcgtacgaactaaacttacgttaaacccaaaccgttactaaacgaacggttacggaaacggtaaccgtaccggttacgtttacgttaactttaaggtttacttacgggttacgaaccggtaacgtacccgtaacccccggtacggtaacccgggttaccccggttcccgttacggttaccggtaacccggtttaaccggggg

SEQ ID NO: 369291 - DNA, 620 bp, Homo sapiens
  misc_feature: GZ8MTXP02HM7RF.44.73.G07.1.454.CMB.2.raw
  modified_base (187)..(187): a, c, t, g, unknown or other
  modified_base (233)..(233): a, c, t, g, unknown or other
  modified_base (246)..(246): a, c, t, g, unknown or other
  modified_base (248)..(248): a, c, t, g, unknown or other
  modified_base (295)..(295): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagattgggttttcctcgttgctcttttaagaggtggccagtgtcaggtncagctagtggagtcgtgggggagagcggccagcctgggaacctccngagctctcctgtncngcctctgattcatctcaggcctatgccatcgacacgtcgggtacccncgaggtcctccgaggcgaaggggtctgggaggtggggtgactaagttatagaccgaaggaagtagtagggtaaattacggaaaacgacgaccgttaacggaacgtaccgtaccggaagggtaacggggacccgtacttaccgacccgttaccgaaccgagaaccgtaacgtaaccgttacccgaaacggtaaacacctactacgacctatcgttagactaagtaacctacaacctacaaacgtagagacgtacgcgtactcgtattacttagtcgtacgcgacgaccgccccgacggacgtaccgtcccgctacgactacccggg

SEQ ID NO: 369292 - DNA, 567 bp, Homo sapiens
  misc_feature: GZ8MTXP02FGNCQ.44.73.G07.1.454.CMB.2.raw
  modified_base (254)..(254): a, c, t, g, unknown or other
  modified_base (297)..(297): a, c, t, g, unknown or other
  modified_base (449)..(449): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctggggagagcggccccagcctgggaactccctgacgactctcctgtgcagcctnggattcatcttcaggtacctatgccatcgcacgtggggtcccnccaggcctccgaggccgaaggggcctggggagtggggtagcaagttatatccaaggaagatggaaattgaacgacacgtacggagactccgaagaaacggggcctattaccaccgtctacagacgacaaacttaccgaacggaacactacgnacatctagacaaactgtaacccaacctacaaacgtaagagaacggacacggtactagtactattaacgttgcgacgacgaccgcccccgtgacgaccggtccctcgtacgactccggg

SEQ ID NO: 369293 - DNA, 655 bp, Homo sapiens
  misc_feature: GZ8MTXP02GWPDD.44.73.G07.1.454.CMB.2.raw
  modified_base (196)..(196): a, c, t, g, unknown or other
  modified_base (392)..(392): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtatccgggggaacngccaccctctcttgcgagggccggccagactgttgacgacgtacttacgcctggtaacccaagagaacgccgtggccaggcctccagacctctcatctatgatacttctaggtacggcctcgtggccactccccagtccccgtcttcgagtcggctaggtcgggtcgacggggacaggtaccttcgacttcctacnccactccaccacgccttaagacgtcctagaagttagttttacgcttagtttaactttactcggttacttaaccgtaacgttaaaggtacgttacgggtacccttaccgtaacttacgttaccttaccgtttacccggtacccgtacgggtaacctaaaggtacggtaatacgtaaacgaaacgtaaacgtcggtaacgcgtacgctaaaccgtctcgtacttccttaccgtactttcccctaacccgtcctacgtttactacg

SEQ ID NO: 369294 - DNA, 601 bp, Homo sapiens
  misc_feature: GZ8MTXP02ITV2I.44.73.G07.1.454.CMB.2.raw
  modified_base (242)..(242): a, c, t, g, unknown or other
  modified_base (284)..(284): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtcgtgggggaggcgtggtccagccgtgggaggtccctgagactctcctgtgaagcctntggtattttagttcagtagttctggcatgcacgtgggtcccncaggcctccgaggcgaaggggccgagtggtggctagttatagcagtatgagttaggaacttcgtaagtattattagtcgacagtaccttccggtgggaaacgggccgtaattcccaacctattccaccagacgaacctaacgttaccccggaactacttctacgtaaccgtaggaaaactgactcaacgcctaggagagggcgaaggcctggcttcgtagttacttacgtgtagcggagtaggtacgggggaaagtgggaccaggcaggtaactttacgttacgccggggttctttaccgacgggtcggggaaccgg

SEQ ID NO: 369295 - DNA, 607 bp, Homo sapiens
  misc_feature: GZ8MTXP02GHVZS.44.73.G07.1.454.CMB.2.raw
  modified_base (257)..(257): a, c, t, g, unknown or other
  modified_base (275)..(275): a, c, t, g, unknown or other
  modified_base (289)..(289): a, c, t, g, unknown or other
  modified_base (301)..(301): a, c, t, g, unknown or other
  modified_base (362)..(362): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctccagattccaccggcgaaattgtgttgacacaatctccagccaccctgtctttgtcgtccggggaacagccacctctcttgcagggccgccagactgttgacgacgacttagcctggtaccaacagaacnctggcaggctccagctcncatcatgatacttntagtaggcctgnggcactccccagtccccgcttcagtggcagtgggtgtcggacgagacttcactctcacacncaccacgacctagaagcctagagtaatttgtagtagttttaatttaacgttacgttactaacgtaacgtaaacggtaacgtacgtaccctaacttaacttacttacgttaccgttaccggtaccggtaacggtaaacggtaaagtaagtaactaacgtaaacgtaaaacgtacgtacgtcgtacgacgacctactacttacttacttaacttacttaccttacccgtaccgtacctactacgtac

SEQ ID NO: 369296 - DNA, 576 bp, Homo sapiens
  misc_feature: GZ8MTXP02H1ZKM.44.73.G07.1.454.CMB.2.raw
  modified_base (296)..(296): a, c, t, g, unknown or other
  modified_base (329)..(329): a, c, t, g, unknown or other
  modified_base (400)..(400): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagcggcccagcctgggaacctccctgagactctcctgtgcagcctctggattcatcttcaggacctatgccatgcacgtgggtcccnccaggcctccgaggcaaggggctgggagtgggngctaattatatcaagagatggaattgaaagacacgtacggagacctcggagaacgggcctagtcaccgtcncagagacaacttccaagaacacactcgacatctagacaaatacgtaaccaacctacaacaaaggtcgaacggacgacggtactacgttacttagtttagttcgtacgaccggtaacggtacccgcccccgtcggaaccggtacccggtacccccgtcgtttacggaccgtaccggg

SEQ ID NO: 369297 - DNA, 782 bp, Homo sapiens
  misc_feature: GZ8MTXP02GYDCU.44.73.G07.1.454.CMB.2.raw
  modified_base (357)..(357): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccgccagactgtgacgacgacttagcctggtaccaacagaagcctggccaggcctcccagacctcctcatctatgatcttctaggtacgggcctcgtggcctactccccagccccgtcttcgagtcggctagggtcgggtcnggggacaggtaccttcacttcctaccgacctacttccaaacccgtacgtaccccttaaggaacggcccgtttaaggaacgtttaacgtttttcgaacgtttaaggtttttaactttaccgttacggtttaccttaaaccgttaacccgggttaaaaggtacggttaccggtaccccttaaccgtaaatttaccgtttaccgttaaccggttttacccggggaccccgttaacgggggtaaaccctaaaaggggttcggtaacttaaaccgtttaaacgaaaaccccgggttaaacgttacgggttacggtaaccgttcgaaccccggtaaaccctactttcccggtttaacgtttccccgtttaaccgttaacccgtttaccccctttcccccggttacccttaaacgtttccccttttaaacgg

SEQ ID NO: 369298 - DNA, 624 bp, Homo sapiens
  misc_feature: GZ8MTXP02IEEHC.44.73.G07.1.454.CMB.2.raw
  modified_base (253)..(253): a, c, t, g, unknown or other
  modified_base (374)..(374): a, c, t, g, unknown or other
  modified_base (387)..(387): a, c, t, g, unknown or other
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccggggaacagccaccctctcttgcagggccggccagactgttgacgacgacttagcctggtaccaanagaagcctggcccaggcctcccagacctcctcatctatgatacttctagtagggcctctggccatccccagccccgctttcgagtggctaggtggggtctggggacagtacttcactctcnccatccaacccanccctagacgccctagaacgtatttttgcttaagtttatttacgtgttactactaaccgtaagaacgtcggtaccctacaatttattaccgtacgtttccgggaccccttagggaaccctaaaaggtggtaacttaacgtaaccgtaaaaaccgtaacgtggttcggaccttcgacctaacccgtatttcctcgttaacctttacaacgtttcccttccccgtaccaagtttcctaag

SEQ ID NO: 369299 - DNA, 705 bp, Homo sapiens
  misc_feature: GZ8MTXP02JGJK2.44.73.G07.1.454.CMB.2.raw
  modified_base (262)..(262): a, c, t, g, unknown or other
  modified_base (285)..(285): a, c, t, g, unknown or other
  modified_base (364)..(364): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagtcttgggttttcctcgttactcttttaagaggtgtccagtgtcaggtgcaccgtggtggagtcgtgggggagcgtggtccagccgtgggacgtcctgagactctcctgtgagcctntggtatttagttcagtagttcgngcatgctacggtcggtccgacgaggcctacggaggaccggaacggggtccggtaggttcgggtaggacgttaaggttanagacgtaagttacgtaggtaagttacggtaaacctttgtaaagttatttagtttacgacggaccgtaccggtaccgttcgggtaacgggaaaccgggtacccttaattaccccgaacgtacgtaccctaacgaaggtaaccgtaaaccgttaaaccgttaccccggaaaccttccgttaccgtacggtaaaccgtaaggtaaactgtaaccgtacgaccgtcgtaaggacggacgggacgaacgggtactccggtacttacgttagttaacgttacggtcggtacgacgtaaggtacgggtaacggggaagtcggactacgacggtaagttacgtttaagg

SEQ ID NO: 369300 - DNA, 710 bp, Homo sapiens
  misc_feature: GZ8MTXP02F1BWC.44.73.G07.1.454.CMB.2.raw
  modified_base (241)..(241): a, c, t, g, unknown or other
  modified_base (284)..(284): a, c, t, g, unknown or other
  modified_base (335)..(335): a, c, t, g, unknown or other
  modified_base (340)..(340): a, c, t, g, unknown or other
  modified_base (405)..(405): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagcttgggttttcctcgttactcttttaagaggtgtccagtgtcaggtgcacctggtggagtcgtgggggagcggtggtccagcctgggaggtccctgagactctcctgtgagcctntggtatttagttcagttagttctggcatgctacgtgggtcccncaggcctccgagggaccgaagggggccgaggttgggtggactaaggtttanacggnaattagtgtaagttggaactttagtaagtatttaattacaggacctaaggtacccgttaccgggnggggaaacggggacccttaactttacccgaaccacttcccgtaccgaaagtaaacgtaacccgttaaacgttacccccgggaaaacttcccgtttaccgtacggtttaaacccgtagggtaaaacttcggaacttcccgaaacggtccgttaaggggaaggacgggggtacgaacgggtacccgtcggtacctttacgtaggtttataccggtggacgtacggtaaggtacggtacgggggtaaagcgggcaagcgtaatcgttaagttaccggtcggtactttcgaacggggttcgggaccggg

SEQ ID NO: 369301 - DNA, 651 bp, Homo sapiens
  misc_feature: GZ8MTXP02IZ7YE.44.73.G07.1.454.CMB.2.raw
  modified_base (152)..(152): a, c, t, g, unknown or other
  modified_base (302)..(302): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttccncgttgctcttttaagaggtggccagtgtcaggtgcagctagtggagtcgtgggggaggacgcggcccagcctgggaactccctgacgactctcctgtgcagcctctggattcagtctcaggacctatcgccatcgcacggtcgggtcccnccgaggcctaccgaggcgaaggggctgggaggtggggtaggactaattatagaccgaggaagatagggtaattaggaaacgacgacgtacgggaagaccgtacgaaggaacgggccgtaattccgacccgtctaaccgagtaacgaactaacgttaccgaaggaaccacgacgtcgacctatctagaactaaagttacgtaaccaaccgtcaaaccgaagtaggaacggacgtacgggtacttacggttacttaacgtttagttacggtcgaccgtaacggtacccgtaacccccgtacggtaacccggtacccggtccccgtacgttaccggaccgtttacccggggg

SEQ ID NO: 369302 - DNA, 706 bp, Homo sapiens
  misc_feature: GZ8MTXP02H5VIR.44.73.G07.1.454.CMB.2.raw
  modified_base (186)..(186): a, c, t, g, unknown or other
  modified_base (194)..(194): a, c, t, g, unknown or other
  modified_base (305)..(305): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagattgggttttcctcgttgctcttttaagaggtggccagtgtcaggtncagctagnggagtcgtgggggagagcggcccagcctgggaactcctgagctctcctgtcgcagcctcgtggatcatcttacaggacctagtcgaccctagtcgcctacgtgggtccccnccgaggcctacgaggcgaaacggggtctaggggtaggtggggtaggactaaagttcgtaagtccgaaaggtaaagtagtaagggtaattagggaaaacgtaaccgaacggttaaacgggaacgtaaccgtaccggggaaacggggtaaaacgggtccctaaacgtttcccgacccggttaccgaccccgtaaaggaacgtaactaaacttaccgaaacggaaccacgacgtagacctaactcgtacgaactaaaacgtcgtaaaccaaacccttagaaacccgtaaaggtacggaaacggaccgaacgggtactaacggttcttaaattagttcggtacggaccgtacgaacccgtcccccgtaagaccggtcccgtacccgtcgtacgttacgtaccggg

SEQ ID NO: 369303 - DNA, 614 bp, Homo sapiens
  misc_feature: GZ8MTXP02JCIAW.44.73.G07.1.454.CMB.2.raw
  modified_base (298)..(298): a, c, t, g, unknown or other
  modified_base (368)..(368): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgacgactctcctgtgcagcctctggattcatcttcacggacctatcgccatgcacgtcgggtccnccaggctcgaggcgaaggggctgggagtgggtgactaattatatccgagaaagatagggaattaggaaanacacgtaacggagtaacctcggaaggaaacgggccgtattaccgaaccgttccgtaccgacgtaacgaaccaaacgttaccgaacggaaccacgaactgactatctagactaaagtacgtaacaacctacaacgaacgtaggaacgacgaacggtctacgttacgttacttaagttggtacgacggtaccgaaccgcccccgtacggtaaccgtacccggtaccctcgtttacggaaccttccggg

SEQ ID NO: 369304 - DNA, 804 bp, Homo sapiens
  misc_feature: GZ8MTXP02I9LSO.44.73.G07.1.454.CMB.2.raw
  modified_base (168)..(168): a, c, t, g, unknown or other
  modified_base (259)..(259): a, c, t, g, unknown or other
  modified_base (300)..(300): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagnggtggccagtgtcaggtgcagctagtggagtcgtgggggaggagccggcccagccctggggaacctccctgagactctcctgtgcagcctntggattcatctcaggacctatcgccatgcacgtgggtcccnccaggcctaccgaggcaagggggtctcggggaggttcggggtggactaaagtttatacgtaccgaaaggaaagtattaggggtaaaactttgggaaaaacgtaaccggtaacgttaaaccgggggaacgtaacccgttacccgggggaaaggaaaaccggggggtaccccgtaaagtttacccgaaacccgtttaccgtacccgaacggaaacggtaaactaaaccgtttacccgaaacgggtaaaccaacctaaccgttacggaaccctatttaccccgaggtaaccctaaaaggtttacccgtaaaaccaaacccttaccgtaaaaccgaaaggttacggaaacgggaacccgaccggggttaccctagggttaccttaacgttttaaaggtttcggtacggtaacggaaccggttaacccggaacccccccggtaggtaacccgggtaacccccgggttcccccgtaacggtttacccggaaaaccgtttacccccggggg

SEQ ID NO: 369305 - DNA, 735 bp, Homo sapiens
  misc_feature: GZ8MTXP02IVSVY.44.73.G07.1.454.CMB.2.raw
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccacctgtctttgtctccggggaacagccaccctctcttgcagggccggcagactgtgacgacgacttagcctggtaccaacagaagcctggccaggcctcccagacctcctcatcctatgataccttctaggtacggccttctcggcctacgtccccacgccccgtcttaccgagtcggacgtagggtcgggtcgtcggggactaggtacttacgaccttccttaccacctagttacccaacccgacgtccccgttaaaggaccgtaccccttaagggtaaacgtttactttttagacgtttaacgtttttaaactttaccgttcgtttaacccgttaaccgtaaacccgggttaaaagtaacggttcggtaacccctttacgtaaactttactttacccttaccggtttaccccgggaccgttacgggaaacccgtaaagtgggtaaataacgtaacgaaaaccgtaacgttcgggtacggtacctaggacctaacccgtacgttaaccgttcgttccgtttactaaccggtttccccttcccgtaaccttactaccgtttaacg

SEQ ID NO: 369306 - DNA, 620 bp, Homo sapiens
  misc_feature: GZ8MTXP02FM3MS.44.73.G07.1.454.CMB.2.raw
  modified_base (266)..(266): a, c, t, g, unknown or other
  modified_base (311)..(311): a, c, t, g, unknown or other
  modified_base (366)..(366): a, c, t, g, unknown or other
  modified_base (370)..(370): a, c, t, g, unknown or other
  modified_base (397)..(397): a, c, t, g, unknown or other
  modified_base (399)..(399): a, c, t, g, unknown or other
  modified_base (512)..(512): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcaccgtggtggagtcgtgggggaggcgtggtccaggccgtgggacgtccctgagactctccgtgtgaacgcctntggtatttagttcagtagttcgtggctatgctacgtcgggtcccnccgagggcctaccgagggcgaacgggggccggtaggttgggttcggctaggttanacgntatagtgataggaacttcgtaagattntntgactagaccgttccggtagaaacggggtccctaattcccgaacagttcccacgaagaacgtacctaaacgttcccgaaaatccttactacgtaccgtaggtaaatgtaaacncgacgtcgtaggacggacggaccggaggtccgtcgcgttacgtacgttacgttcgtggtacgacggtagtacgggtaacgggtagcggacacgacgtagtacttaagg

SEQ ID NO: 369307 - DNA, 704 bp, Homo sapiens
  misc_feature: GZ8MTXP02FVPJI.44.73.G07.1.454.CMB.2.raw
  modified_base (297)..(297): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctgttgctcttttaagaggtggccagtgtcaggtgcagctagtggagtcgtgggggagagcggcccagcctgggaacctccctgagactctcctgtcgcagcctctggattcatcttcaggcctatcgccatgccagtcgggtcccncgaggctcgaggcgaaggggctgggagtggggtgactaatatatccaaggaagagtagggtaaacttaggaaaacgtaccgaacgttaacggggaacgaaccgttacccgggaaagggaaacggggtcccgtaaacgttcgtaacccggttcctacccgaagaacgtaaacgaaccttacccgaaaggaaaccaacgtacgtacgaccacttaccgacgtactaaaacgtacgttaaacccaaaccgttaccaaccgtaaaaggtacggaaggaaccgaaccgggtaccttaggttaccttaaacgtttagtttacgggtacgttaccgacggtacccggtaaccccccgttacggaaccggttaacccgggcccccgttacgttacgtaacccgtttaacccgggg

SEQ ID NO: 369308 - DNA, 741 bp, Homo sapiens
  misc_feature: GZ8MTXP02GH1BC.44.73.G07.1.454.CMB.2.raw
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagccggcccagcctgggaactccctgagactctcctgtgcagcctctggattcatcttcaggacctatcgccatgccacgtgggcccgccaggcctaccgaggcgaaggggctggggacggtgggtggactaaagttatatccgaaggaagtagtaggaaattggaaagtaccacgtaacggacgtaccgtaccggaaggaaacgggggtccctaacgtttcccgaaacccggttcctaacccgaaggtaaacccggtaactaaaccgtttaacccaagggaaaccctaacgtaaccgttaccggacctaaacgttccgtagtaaaccctaaaacgttcgtaaaacccctaaacccgttacgaaaccgtaaaggttacggaaacggtaccgtaaccgggactttacggttaccttaaacgttttaggttacgttacggaccggtaacgtaccccggtaaccccccgttacggggtaaccggtacccccgggttccccggtaccgtttacgggaaccccgtttaacccggggg

SEQ ID NO: 369309 - DNA, 623 bp, Homo sapiens
  misc_feature: GZ8MTXP02HIPEW.44.73.G07.1.454.CMB.2.raw
  modified_base (288)..(288): a, c, t, g, unknown or other
  modified_base (335)..(335): a, c, t, g, unknown or other
  modified_base (541)..(541): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagcttgggttttcctcgttactcttttaaggaggtgtccagtgtcaggtgcaccgtggtggagtcgtgggggagcgtggtccagccgtgggacgtccctgagctctctgtagacgcctgtggtattttgttcaggttagttctggcagtgccacgtgggtcccnccgaggcctaccgaggcgaacggggccgtaggttggtgctaagttanagctattagcgagtaggtaaccttggtaatattacttagcgactagtaccgttcggtagggaacgggtacctattcccaactcactaccgaagtaccgaacgtaaaccgttacccggaactacgttacgtacggtaacctaggaaatgactacgacgtccgtaggaggacggacggaacgcgtccggattacgtagttacttacgngtcgacggtagtaggtacgggacggcggactacgacgtagtaacgttacgttacggtcggtacgtacggacggtacgggacg

SEQ ID NO: 369310 - DNA, 680 bp, Homo sapiens
  misc_feature: GZ8MTXP02ICCAL.44.73.G07.1.454.CMB.2.raw
  modified_base (299)..(299): a, c, t, g, unknown or other
  modified_base (336)..(336): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgcttcttttaagaggtggccagtgtcaggtgcagctagtggagtcgtgggggagagcggcccagcctgggaacctccctgagcctctcctgtgcagcctcgtggattcatcttcaggacctatcgccatgcacgtgggtcccncgaggctccgaggcgaaggggtctgggacggttgggnggtactaattatataccgaagaagagtaggtaattagaaacgacgacgtaacggagacctaccgggaaggacggggccctacttccgacccgtctacccgagaacgaacctaacttaccgaaacggtaaaccacaccgtgacctacgtcgtaggaactaaacgtaccgtaaaccctaaccttacaaacgtaaggtaacggaacggaccgaccgggttacttacggttacctttaacgtttaggttacgttacggaaccggttaaccggaacccggtaacccccgtacggtaaccggtacccccggttaccccgtccgtttaccggaaccggttaaccccggggg

SEQ ID NO: 369311 - DNA, 560 bp, Homo sapiens
  misc_feature: GZ8MTXP02FWSOQ.44.73.G07.1.454.CMB.2.raw
  modified_base (259)..(259): a, c, t, g, unknown or other
  modified_base (300)..(300): a, c, t, g, unknown or other
  modified_base (338)..(338): a, c, t, g, unknown or other
  modified_base (344)..(344): a, c, t, g, unknown or other
  modified_base (355)..(355): a, c, t, g, unknown or other
  modified_base (360)..(360): a, c, t, g, unknown or other
  modified_base (364)..(364): a, c, t, g, unknown or other
  modified_base (419)..(419): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggtggagtcgtgggggagcgtggtccagcctgggagtccctgagactctcctgtgaagcctntggtatttagttcaggtagttctggcagtgcacgtggcccnccaggcctcgaggcgaaggggccgagtgtggcagttangcatangatggaacttnagatnttangacagacctcgtaggaacggcatccacatctccagacactaacgttccccgaaancttctacgtacctaggaaatcgaatcgacgccgttagacggtaggacgaggtacgtcgggcttcgtcggttaattacgtggttacgacgggaagttacgggaacgggaaggttcgggacacggccgtaaggctttaaaggg

SEQ ID NO: 369312 - DNA, 565 bp, Homo sapiens
  misc_feature: GZ8MTXP02IK7PS.44.73.G07.1.454.CMB.2.raw
  modified_base (277)..(277): a, c, t, g, unknown or other
  modified_base (284)..(284): a, c, t, g, unknown or other
  modified_base (319)..(319): a, c, t, g, unknown or other
  modified_base (322)..(322): a, c, t, g, unknown or other
  modified_base (327)..(327): a, c, t, g, unknown or other
  modified_base (329)..(329): a, c, t, g, unknown or other
  modified_base (337)..(337): a, c, t, g, unknown or other
  modified_base (351)..(351): a, c, t, g, unknown or other
  modified_base (439)..(439): a, c, t, g, unknown or other
  modified_base (443)..(443): a, c, t, g, unknown or other
tcagacagtatatacacgaccggtgctcgatttagctctacgctcaggggggagacgagcccagcactggaagtcgccggagtttccattcggtgatcatcactgaacacagaggactcaccatggactttgggctgagattgggttttcctcgttgcttcttttaagaggtggccagtgtcaggtgcagctagtggagtctggggagacgcggcccaggcctgggaactccctgacgactctcctgtgcagcctctggattcatctcagtaccctntcgacancgcgtcgtcggccgcagctacgaggtacgacgggnagngtggngntagtatanacagagagaagtanagacgactacgaacgaacgtaccgacgaacgggaccgacgtacacgtactacacgacgtacgaataccacgaaacgacactacgacanactntacactactaactaactaacaacaacgaagagacgacgtacgtacgtactattactacgactacgacgaaccgtacccgtaaccgtacccgaccgaccgtaccgtaccgtacgtacgtacgg

SEQ ID NO: 369313 - DNA, 621 bp, Homo sapiens
  misc_feature: GZ8MTXP02HEQ7K.44.73.G07.1.454.CMB.2.raw
  modified_base (295)..(295): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccagcctgggaactccctgagactctcctgtgcagcctctggactcatctcaggacctatcgccatgctacgtcgggtccnccaggctcgaggcgaagggctggaggtggtggctaattagtatcaaggaagagtaggaacgttagaaagactacgttaacggggaacgtacctccgggaaaggaaacggggacccgtaattacccgtaacccgttccgaccgaagtaacgaaactaacgttacccgaaacggaaacacaacgtgacctagtctagactaatacgtaaccaacgttacaacgaagtcgaacgacacggtactcgtacttaacgttgttagtacgacgtacgtacccgccccgtcgtaaccggtcccgggttacccctcggttacgaccgttaccggg

SEQ ID NO: 369314 - DNA, 758 bp, Homo sapiens
  misc_feature: GZ8MTXP02FRYPA.44.73.G07.1.454.CMB.2.raw
  modified_base (168)..(168): a, c, t, g, unknown or other
  modified_base (210)..(210): a, c, t, g, unknown or other
  modified_base (246)..(246): a, c, t, g, unknown or other
  modified_base (253)..(253): a, c, t, g, unknown or other
  modified_base (295)..(295): a, c, t, g, unknown or other
  modified_base (327)..(327): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagnggtggccagtgtcaggtgcagctagtggagtcgtgggggagngcggcccagcctgggaactccctgagctctcctgtncagcctntggattcatcttcaggacctatgccatgctacgtgggtcccnccgaggctccgaggcaaggggctagggtcggnggggtggacaatttacgataccgaagagatggaaattaggaaacgacgtacgtaacggggaagtacccgtaccgggaaagggaaacgggggtcccgtacgtttacccgaaccccggttaccttacccgggaaacgaacggaaaacccctaaacgtttaacccggaaaacggggtaaacccctaaacaaccgttacggaacccaagtttaccctaggaacccgtaaaaattacggttaaaacccaaacccgttacaaacccgtaaagggttacggaaccgggaaacgaacccgggggtctttacggtttaaccgttaaggtttaaacttcggttacggtaacccggtaacgggaccgtaacccccgtaccgggggaaacccgtcccgggggttaccccccgtggtttacccgaaaccggtttaccccggggg

SEQ ID NO: 369315 - DNA, 765 bp, Homo sapiens
  misc_feature: GZ8MTXP02FXH55.44.73.G07.1.454.CMB.2.raw
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagcggcccagcctgggaacctccctgacgctctcctgtcgcagcctcgtggattcattcttcgacggtacctatcgaccagtcgcctacggtcggggtccccgccgacgggtccctcccggaggggaccggaaggggggtccgtaggggaggggttcgggggttacggaacttaaagtttaactacggttaccgaaaaggtaaaggtacgttaaggggtaaattaacggaaaacgtaaccgtaaccggtaacggggaacgtaacccgtaccggggaaagggaaaccgggggtccctaacgttacccgtaacccggttacctacccgaacggaacgtaactaaacgttaacccggaaacggaaaccaaaccgacgttacgacctactacgtacgtaactaaaagtacgtaaacccaaccctacgtaaacgaaaggtaggaaacggtaacgacgggtacctagttacttaacgtttagttaggtacggtacgaacggtacccgtaacccccgtacggaaccggtaccccggtcccgtacgtacggtaccgtacgggg

SEQ ID NO: 369316 - DNA, 804 bp, Homo sapiens
  misc_feature: GZ8MTXP02JAP64.44.73.G07.1.454.CMB.2.raw
  modified_base (257)..(257): a, c, t, g, unknown or other
tcagacagtatatacacgaccggtgctcgatttagctctacgctcagggggggagacgagcccagcactggaagtcgccggtgtttccattcggtgatcatcactgaacacagagactcaccatggactttgggctgagattgggttttcctcgttgcttcttttaagaggtggccagtgtcaggtgcagctagtggagtcgtgggggagagcggcccagcctgggacctccctgagacctctcctgtcgcagcctntggattcacttcttcgacggtacctatcgcccatgcacgtcgggtccgccagggcctacccgaggtaccgaagggggtcctaggggacggggtggggttcgggaacttaaagttatacgtacgaaaggtaaagagttaagggtaacttaggaaaacggacctacgtaaacggggaacgtacccgtaaccggggaaaggggtaaacccggggtccgtaaacgtttcccgtaaaccccggttaccgtaccgaacggtaaacccggtaaacttaaaccgttacccgaaaacgggaaacccaccgaaccgttacggaccaactttacgtacgtaactaaaatttacccggtaaaaccctacccttaaacgaacgtaaaacgggttaccggaaacggggttaaaccgaacccgggtagtttacgttaaccgtttacgtttttaaaggtcggttaccggtaccggtaaccggtacccgtaaccccccggttggtaaacccggttcccccgggggtacccccttcggttacccggtaacgtttaaccccggggg

SEQ ID NO: 369317 - DNA, 627 bp, Homo sapiens
  misc_feature: GZ8MTXP02GSQ80.44.73.G07.1.454.CMB.2.raw
  modified_base (236)..(236): a, c, t, g, unknown or other
  modified_base (240)..(240): a, c, t, g, unknown or other
  modified_base (257)..(257): a, c, t, g, unknown or other
  modified_base (260)..(260): a, c, t, g, unknown or other
  modified_base (276)..(276): a, c, t, g, unknown or other
  modified_base (283)..(283): a, c, t, g, unknown or other
  modified_base (313)..(313): a, c, t, g, unknown or other
  modified_base (539)..(539): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagcttgggttttcctcgttactcttttaagaggtgtccagtgtcaggtgcaccgtggtggagtcgtgggggagcgtggtccagccgtgggacgtccctgagctctctgtgancctntggtatttagttcagtntcngcatgcacgtgggccncaggccnccgaggcgagggcgagtcggtgctagttanagctagtataggtagtacgtaaacttcgaaggtattacgttagtcggactaacgtaccggttacggagggaacgggtcctaacttaccaccgtatccgtaccgaagtacgaaacctacgtacccggaaatcgttacgtcggtaactaaggtaactcacgtcgaacggtcctaggggaacggacggtcgtaacggtcctcgggtctttacggtaattacgttacggnggtacggtacggacgtacgggtacgggagtcgacgacgtacgacgttaacgttacggtcgggttcggtcgtacggacgggtacggacg

SEQ ID NO: 369318 - DNA, 709 bp, Homo sapiens
  misc_feature: GZ8MTXP02FMBKK.44.73.G07.1.454.CMB.2.raw
  modified_base (257)..(257): a, c, t, g, unknown or other
  modified_base (277)..(277): a, c, t, g, unknown or other
  modified_base (298)..(298): a, c, t, g, unknown or other
tcagacagtatatacacgaccggtgctcgatttagctctacgctcagggggggagacaagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagcggcccagccgtgggaactccctgagactctcctgtgcagccctntggattcatctcagtacctntgccatgccacgtcgggtccnccacggctcccgaggaccgaaggggctagggaggttggggtgacctaaattagtagtccaaggaaagtattaggggtaaacttaggaaaaacgaccgaaccgtaacgggaaacgtaacccgtaccgggaaagggaaacggggtcccgtagttacccgacccgtacctaccgaacgtaaacgaaccaaacgttaccgaaacggtaaaccaaaccgtactagacctaacgtccgttaggaacaaaacgttactaaacccaaccgtacaaccgtaacggaggaaacggaccgacggtacgttacgtacctttaaacgtttacgttaggtacggaccgacgtaaccccgcccccggttacggaaccggttacccccggtcccccggttacgttaccggtaccgttaaccccgggg

SEQ ID NO: 369319 - DNA, 624 bp, Homo sapiens
  misc_feature: GZ8MTXP02JZTK6.44.73.G07.1.454.CMB.2.raw
  modified_base (171)..(171): a, c, t, g, unknown or other
  modified_base (258)..(258): a, c, t, g, unknown or other
  modified_base (310)..(310): a, c, t, g, unknown or other
tcagacagtatatacacgaccggtgctcgatttagctctacgctcgagggggggagacgagcccagcactggaagtcgccggtgtttccattcggtgatcatcactgaacacagaggactcaccatggactttgggctgagattgggttttcctcgttgcttcttttaagnggtggccagtgtcaggtgcagctagtggagtcgtgggggaggagcggcccagccgtgggaactcctgagactctcctgtgcagcctntggacttcatcttcaacggtacctatcgacctatgaccgacgtcgggtcccnccgaggcctccgaggccgaaggggcctggggaggtgggtaggactaagttatataccgaagagtaagtaggaaagttacgaaagaaccaacggtaaacggacaacgtccggaaaggtaacgggaccgtacttacccgaaccgtcctacgaagaagacaacttaccgaagaaccacgtactacgacagtacagtaactaaagtactaaccaacctacaacgtaaagcgacgaacgacgactacggtatacttatcgcgtaccgacgccgtaacccccgtacggaccgtcccggtcccacgtttacgacgttccgg

SEQ ID NO: 369320 - DNA, 638 bp, Homo sapiens
  misc_feature: GZ8MTXP02FJESJ.44.73.G07.1.454.CMB.2.raw
  modified_base (155)..(155): a, c, t, g, unknown or other
  modified_base (240)..(240): a, c, t, g, unknown or other
  modified_base (257)..(257): a, c, t, g, unknown or other
  modified_base (260)..(260): a, c, t, g, unknown or other
  modified_base (278)..(278): a, c, t, g, unknown or other
  modified_base (318)..(318): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagcttgggttttcctcgttactcttttaagnggtgtccagtgtcaggtgcacgtggtggagtcgtgggggagcgtggtccagcctgggagtccctgagacctctcctgtgagcctntggtatttgttcagttntcnggcatgcacgtcgggccncgagctccgaggccgaaggggcgagtggttggctagttanagctaagtatggatcggaactttcgtaagaacttattagtcgtactaacggtaccttccgggtagggaaaccgggcccgtaattacccgaacctgtcctaaccgagtaacgaaacctacgttaccccgaaatccttgtacgtacgtaaggaaactgaactgacgtctagggacgtaggacggagaccgtgcttacgtgttaacttacgtgtacgacgtaaggtcgggtaacggggaagtcgggaacacggcgttaacggtcgtttaagttaacggtcccgggggttactttacccggacgggggtcggggaaacccgggg

SEQ ID NO: 369321 - DNA, 702 bp, Homo sapiens
  misc_feature: GZ8MTXP02HTQF2.44.73.G07.1.454.CMB.2.raw
  modified_base (211)..(211): a, c, t, g, unknown or other
  modified_base (316)..(316): a, c, t, g, unknown or other
  modified_base (390)..(390): a, c, t, g, unknown or other
tcagacagtatatacacgaccggtgctcgatttagctctacgctcaggggggagacgagcccagcactggaagtcgccggtgtttccattcggtgatcatcactgaacacagaggactcaccatggactttgggctgagattgggttttcctcgttgcttcttttaagaggtggccagtgtcaggtgcagctagtggagtcgtgggggagngccggcccagccgtgggaacctccgtgacgactctcctgtgcagcctcgtggtatttccatccttcgacggtacctagtcgcctatcgcgtacgtggggtccccnccgaggcctccgaaggccgaacgggggctgggaggttggggaggactaaaagttatactaccgaaaggaaagtntaggggtaaattcggaaaacgactacggtaaacgggagaccgtacgggaacggaaacgggtcccgacttccgaccgtcctaccaaggtaacgtacaacgttaccgaaacggaaccaccacgtcgactacttactacgaactaaacgtaccgtaaacctaaaccctaccgaaacgtaacggtacgggacggaacccgaacgggtcttacgttatttacgtttagttacgtacggtcgtaacggacccgtaacccccgtacggaacccggtccccggttaccccggtacctttacggtacccgttaaccggggg

SEQ ID NO: 369322 - DNA, 743 bp, Homo sapiens
  misc_feature: GZ8MTXP02JML6F.44.73.G07.1.454.CMB.2.raw
  modified_base (244)..(244): a, c, t, g, unknown or other
  modified_base (266)..(266): a, c, t, g, unknown or other
  modified_base (365)..(365): a, c, t, g, unknown or other
  modified_base (379)..(379): a, c, t, g, unknown or other
tcagacagtatatacacgaccggtgctcgatttagctctacgctcaggggagctctgggagaggagcccagcactagaagtcggcggtgtttccattcggtgatcagcactgaacacagaggactcaccatggagtttgggctgagctgggttttcctcgttactcttttaagaggtgtccagtgtcaggtgcaccgtggtggagtcggtgggggagcggtggtccagccgtggggaggtcccngagactctcctgtgaacgcctntggtatttgttcagtagttctggcagtcgctacgtggtcccgaccagggcctcccgaggccggaaagggggccggtaggtgggttggccgtaaggttanacggcgtaatacgngagttggaacctttgagttaatgtaagtcgacctagtaccgtccggtaagggacgggtaccctattacccaccctattcccggttaaccgaggtaaaccggtaaaccttaaaccggggtttaccccgaaaccttagttacccgtaacgggtttaccaaggggttaaaatcccggtaaaggtccaaacggttcccgtaaggggaggtaaacggggccggtaaacgtcccgtcggggtttacctgttacggggttaaaccttgttggggtaccgaaccggttaacggtaaaagggttccccgggggaaaagttccggggaaaacccttgggggaaacctacccgggggttattttaaacccggggg

SEQ ID NO: 369323 - DNA, 660 bp, Homo sapiens
  misc_feature: GZ8MTXP02FJN8H.44.73.G07.1.454.CMB.2.raw
  modified_base (305)..(305): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggcccaggcctgggaactccctgagactctcctgtgcagcctctggattcatcttacaggtacctatcgccagtgaccacgttcggggtcccnccgaggtcctaccgagggcaacgggggctggggaggtgggggtagactaaattagtatccgaaaggaagtataggggtaaactttaggaaaacgacctacggtaacgggtaagaacccgttccgggaaagggaaaccggggtccgtaacgttccgacccgtccgtacccgaagtaacgaactaacgtaccgaacggacaacactacgacagttccgagacaaacgttagaaacccaaaccgtacaacgtaacggtacggaacgtacgaaccggtacttagttacttacgttaagttcgtacgtcgacgaccgccccgtagaccggtacccgtcccgtcgtacgtacgtaaccggg

SEQ ID NO: 369324 - DNA, 679 bp, Homo sapiens
  misc_feature: GZ8MTXP02IE6XS.44.73.G07.1.454.CMB.2.raw
  modified_base (258)..(258): a, c, t, g, unknown or other
tcagacagtatatacacgaccggtgctcgatttagctctacgctcaggggggaggaactgctcagttaggacccagagggaaccatggaagccccagctcagcttctcttcctcctgctactctggctcccagattccaccggcgaaattgtgttgacacaatctccagccaccctgtctttgtagtccgggggaacagcccacctctcttggcagggccggccagactgttgacgacgacttagcctggtaaccaanagaagcctggccaggcctcccagacctctcatctatgattacttcgtaggtcgggcctcgtggcactcccagccccgtcttcaggtcggactaggtcggggtacctggggactaggtacctttaccaacttccttaccaccctacttaccgaaacccctaacggtacccccgttaagggacgttaccccgtaaggtaaacgttaacgtttttacggacctttaaggtttttaacttacgttacgttacctaacgtaaccggtaaaacgtacgtacggtaccttacgtaaattacgttaccttacggtttccgaccgtagggtaaacctaaaggtcggtaatacgtaaccgaaaacgtacgtcggtaggactacgactactacttctcgtcttcactttcctacccgtctacgttactaacg

SEQ ID NO: 369325 - DNA, 675 bp, Homo sapiens
  misc_feature: GZ8MTXP02FHHW5.44.73.G07.1.454.CMB.2.raw
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggccagactgttgacgacgacttagcctggtaccaacagaacgcctggcccaggctcccagacctcctcatctatgatacttctaggtagggcctcgtggcatccccagccccgcttcaggtcggcaggtcggggtctacggggacaggacttcactcctcaccgatacccaccagtaccctaggaccgcccgtagtaaagttacttttgacgttagttttaatttacgtagttacctaaactacccgggtaaaagtaacggttacggtaccccttaccaaactttatttacccgttaaccgtttttacccgggcccccgtttaagggggtaaccctaaaacgggtttagggaaacttaactaaccgaaaaaccggtaacgttaggtacgggtcctacggtaccaacctactcgttacgttcctactacttcccggttaccccactactccggttaag

SEQ ID NO: 369326 - DNA, 750 bp, Homo sapiens
  misc_feature: GZ8MTXP02FR5DN.44.73.G07.1.454.CMB.2.raw
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtcgtccggggaacacgccacctctcttgcgagggccgccagactgtgacgacgacttagcctaggtaccaacgagaacgcctggaccgacggcctcccagtacctcctacatctatgtactacgttacgtaggtacgggcctcgtaggcctaccttaccccgaccggtcccctacgttacgacgggttcgggacctagggtcgggggttacctcgggggtaacctacgttacttctaaccccttctacctacctactacccaaaccgaccggtacccttaaggaaaccgtcccgtaaagtaaaggttacttttacggactttaaacgttttacttagtaccttacgttaaacgtaaccgggtaaagacggtacgtaccccttaaagtaacttaacgtttaccctaaccggtttcccggacccccgggtaaggtaaccccgtaaaaggttacggtaactttaacgaaactaaaacccggtaagttcggtacgtccgacgtaccctaacgttacttccgtacgttaaccttacaccgttttcccctcccggtacttactacccgtttaag

SEQ ID NO: 369327 - DNA, 540 bp, Homo sapiens
  misc_feature: GZ8MTXP02FHBHB.44.73.G07.1.454.CMB.2.raw
  modified_base (201)..(201): a, c, t, g, unknown or other
  modified_base (208)..(208): a, c, t, g, unknown or other
  modified_base (299)..(299): a, c, t, g, unknown or other
  modified_base (337)..(337): a, c, t, g, unknown or other
  modified_base (344)..(344): a, c, t, g, unknown or other
  modified_base (360)..(360): a, c, t, g, unknown or other
  modified_base (363)..(363): a, c, t, g, unknown or other
  modified_base (365)..(365): a, c, t, g, unknown or other
  modified_base (372)..(372): a, c, t, g, unknown or other
tcagacagtatatacacgaccggtgctcgatttagctctacgctcaggggaggctctgggagaggagcccagcactagaagtcggcggtgtttccattcggtgatcagcactgaacacagaggactcaccatggagtttgggctgagctgggttttcctcgttactcttttaagaggtgtccagtgtcaggtgcacctggnggagtcngggggagcgtggtccagcctgggaggtccctgagactctcctgtgaagcctcgtggatttagttcagtagttctggcatgcactgggtccncaggcctccgaggcaaggggccgagtggtggcagttanagcatangatggaacttcagatntangnagctcgngacggcattcacatctccagacgaacaattcccggaaactactctcgtaacctagggaaatgatcacgcctagaggacggcgagggacctcggctcgtaggttacttacgtggtacggccgaaggtaggtaaccggggaagtcgggacaggtccaaggctttaaacgg

SEQ ID NO: 369328 - DNA, 647 bp, Homo sapiens
  misc_feature: GZ8MTXP02JPZQI.44.73.G07.1.454.CMB.2.raw
  modified_base (152)..(152): a, c, t, g, unknown or other
  modified_base (251)..(251): a, c, t, g, unknown or other
  modified_base (296)..(296): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttccncgttgcttcttttaagaggtgccagtgtcaggtgcagctagtggagtcgtgggggaggagccggccagccgtgggaactcccgtgacgactctcctgtncagcctctgattcatctcagcatcgccatcgctacgtgggtcccncgtagcctacgaggcgaagggtcgagggaggtggggtacgtactaaagttagtacgttacgaaggaaagtactaggggtaaatttaaggaaagacctacggtaacgggaaggaccctacggggaaaggacggggtacctacgttcccgacccggttccacggagaagaacctaacgttacccgaaggaacccaactaccgtacgactactactacgtactaaagtactaacctaccaacgaagtaacgacggaacgacgtacgtacgttaggttacttagttagtacgtacgccgtacgacccgtaacccggacgtaccggtacccgtcccgtacgtaccggtaacgtcgg

SEQ ID NO: 369329 - DNA, 748 bp, Homo sapiens
  misc_feature: GZ8MTXP02H6F0Q.44.73.G07.1.454.CMB.2.raw
tcagacagtatatacacgaccggtgctcgatttagctctacgctcaggggggagacgagcccagcactggaagtcgccggtgtttccattcggtgatcatcactgaacacagaggactcaccatggactttgggctgagtattgggttttcctcgttgcttcttttaagaggtggccagtgtcaggtgcagctagtggagtcgtgggggagacgccggcccaggccgtagggaacctcccgtagacgtaccttctcctggtcgcacgtcctcgtaggtacttcattcttacgacggtaccttagtcgacctagtgacctacggtcgggtccccgaccgtaggcctaccggaagggcggtaagggggtcctaggggtaggttggggtacgaacttaaagttaacgtacgtccgaaagtaaacggtagtaacggggtaattaaggaaaacgtaccgtaacggttaaacgggaacgtaaccgtaccggggaaggaaacggggtcccgtaacgttccgacccgttacgaccgaagaacgtaaactactacgaacggaaacctacgactacgctacgtacgttagaacgtaaagtacgtaaacccaacctaacaacgtaaacgggtacgaaacggacgtaaccggtacgttagttaccgtttaatttacggttagttacggaccgtacggacccgtaacccccgtacggaacccggtacccggtacccgtacgttaccggtaaccgtaccggg

SEQ ID NO: 369330 - DNA, 652 bp, Homo sapiens
  misc_feature: GZ8MTXP02GC9YF.44.73.G07.1.454.CMB.2.raw
  modified_base (231)..(231): a, c, t, g, unknown or other
  modified_base (245)..(245): a, c, t, g, unknown or other
  modified_base (252)..(252): a, c, t, g, unknown or other
  modified_base (295)..(295): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggagagcggccagcctgggaactccngacgctctcctgtncagcctntggattcggatctcagcctatcgccatgccacgtcgggtcccncacggctaccgaggcgaaggggctggggacggtgggtgactaattagtactccgaaggaagtagtaggtaaattaggaaacgtacgaacgtaacgggaacgtaccgtacgggaaacgggtaaacgggccgtaacgttcccgacccggttcctacccgaaagtaccgtaaactaaccgttaccgaaacggaaaccaaccgacgttacgacaacttacgtacgaactaaacgttacgtaaaccctaacctacgaaactaaaggtacggaacgtacgacggtacttcgttacttagttaacgtgacgtacgacgaccgccccgtacggaccgacccggtcccgtacgtccgactaccggg

SEQ ID NO: 369331 - DNA, 574 bp, Homo sapiens
  misc_feature: GZ8MTXP02FGCZQ.44.73.G07.1.454.CMB.2.raw
  modified_base (238)..(238): a, c, t, g, unknown or other
  modified_base (279)..(279): a, c, t, g, unknown or other
  modified_base (320)..(320): a, c, t, g, unknown or other
  modified_base (327)..(327): a, c, t, g, unknown or other
  modified_base (337)..(337): a, c, t, g, unknown or other
  modified_base (346)..(346): a, c, t, g, unknown or other
  modified_base (369)..(369): a, c, t, g, unknown or other
  modified_base (372)..(372): a, c, t, g, unknown or other
  modified_base (377)..(377): a, c, t, g, unknown or other
tcagacagtatatacacgaccggtgctcgatttagctctacgctcagggccgctgtgctctcggcggtgtttccattcggtgatcagcactgaacacagaggactcaccatggagtttgggctgagctgggttttcctcgttactcttttaagaggtgtccagtgtcaggtgcacctggtggagtcgtgggggagcgtgtccagcctgggagtccctgagactctcctgtgaagcctntggtatttagttcagtagtctggcatgcacgtggggtcccnccaggcctccgaggcaagggggccgagtggttggcagttanagcatangatggacttnagatattangcagctcgtgaacgggcatcacntcncaganactagtcccgacactcagtacctaggaatcgatccgagccgtagaggacggacggagtcccgtcggacttacgtagttaacgttagtcggtacggacggtaaggtacgggtacggggtaggtcggacgtacggactacgtaacgttacgttaccgggtcggggtttacctttacggaccggggtcggggaaccgggg

SEQ ID NO: 369332 - DNA, 707 bp, Homo sapiens
  misc_feature: GZ8MTXP02FI1YG.44.73.G07.1.454.CMB.2.raw
  modified_base (194)..(194): a, c, t, g, unknown or other
  modified_base (350)..(350): a, c, t, g, unknown or other
tcagacagtatatacacgaccggtgctcgatttagctctacgctcagggggggagacgagcccagcactggaagtcgccggtgtttccattcggtgatcatcactgaacacagaggactcaccatggactttgggctgagatgggtttccctcgttgctcttttaagaggtggccagtgtcaggtgcagctagnggagtcgtggggagagcggcccagccgtgggaacctccgtagacgactctcctgtcgcacgctcgtggaattcgatccttcaggtacctatgccatcgcacgtcgggtccaccgacggcctaccggaggccgaaggggctaggggagtcgggggtntaccgtaaattactagtaccaaggtaagacgtaggtaataggaaaagactaacgtacggagtaaccgtaccgaaggaacgggccgtaagtacctacccgtactacccgaaggtactaaccgtaacttacccggaaacggtaaacctaccgaacgttaccgggataaccgttacgtacgaaacccttaaaagttaccgtaaaacccttaaaccgaccgtaaaccgtaaagtacgaacggtacgaacggtaccgtaaaggttactttagttacggttacgtcggtacggtaccgtaccggtaacccccgtcggtaacggttacccggacccgtacggttacgaaccggtttaacccggg

SEQ ID NO: 369333 - DNA, 724 bp, Homo sapiens
  misc_feature: GZ8MTXP02HQQSJ.44.73.G07.1.454.CMB.2.raw
  modified_base (334)..(334): a, c, t, g, unknown or other
tcagacagtatatacacgaccggtgctcgatttagctctacgctcagggggaggaactgctcagttaggacccagaggggaaccatggaagccccagctcagcttctcttcctcctgctactctggctcccagattccaccggcgaaattgtgttgacacaatctccagccaccctgtctttgtcgtaccgggggaacagcccaccctctcttgcgagggccgcagactgttgacacgtacttagcctaggtaccaaacagaagtccctgggcctacgggcctcccagacctccacattactagtctactactttcgaaggtacgggccttcgnggctacgtccccacgccccgtacttcgagttcggctaggtgggccgtcgggacacgtcttcaccttccttcacctagtaccaacccgtagtccctaggacctacccgtaggtaaactttagttttacggacctttaaaggttttacctttaaaccgtcgggtttaaaccctaacggtaacccgttaaaggtaacggttaccggtacccctttacaaaacggtttttctaaacccgtttccgggttttaaccccggccggtttaaacgggggaaaccttaaaggggtattaacgtaactaaacgggaaactaccggtaggtcggtaccagttacccaacgttcttaccttcgtcgttaaccttacttacccctaccgacttacgttactag

SEQ ID NO: 369334 - DNA, 644 bp, Homo sapiens
  misc_feature: GZ8MTXP02GTFKB.44.73.G07.1.454.CMB.2.raw
tcagacagtatatacacgaccggtgctcgatttagctctacgctcagggggggagacgagcccagcactggaagtcgccggtgtttccattcggtgatcatcactgaacacagaggactcaccatggactttgggctgagatgggttttcctcgttgctcttttaagaggtggccagtgtcaggtgcagctagtggagtcgtgggggaggagccggccccaggccgtagggaacctcccgtgacgactctcctgtcgcagtccctcgtggattccgaccttacgacgttacctagtggactagtcgccacgtcgggtccgccgaggcctaccggaggccggaaaggggtccgtaggggtacggtggggtcgccgtaactttagtaagtaggtatagaagtaggtaaataaagttaaacttatagtgcaggtaccctacgggacgtaaacgggcctacgttccaaaccgtactcctacccgaagaactaaacctacgtacccaaaacgaaccgtccgacttaagtactctaagacctaaatacgaactaggtccaggtaagcgacggaacgacgacggtcgtgtacgtaatacgtagtccgaggtaagcgtaaattacgttactagtaaccctacgtaccgttcg

SEQ ID NO: 369335 - DNA, 544 bp, Homo sapiens
  misc_feature: GZ8MTXP01DZPWO.17.29.C07.1.454.CMB.2.raw
  modified_base (431)..(431): a, c, t, g, unknown or other
tcagcgtagactagcacgaccggtgctcgatttagagtgctacgaagggaaaggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatctctgcactggatccagcagtgacgttggtagttataattatgtctctggtaccaacagtacccaggccaaagcccccaaaatcatgatttatgaggtcagtaatcggcctcgtaggggttctaatccgcttctctggctaccaagtctggcaaacacggcctcctgaccatctctgggctccaggctggaggacgagggtgattagttactgggcagcctanatatagagtgctagctactcgtcgttacgttcgggcgggttacggaaccgtagccgttcggacccgtccgtacgggtccgacggacccgaacggtcccgttcccggtcccccg

SEQ ID NO: 369336 - DNA, 520 bp, Homo sapiens
  misc_feature: GZ8MTXP01C4VPS.17.29.C07.1.454.CMB.2.raw
  modified_base (254)..(254): a, c, t, g, unknown or other
  modified_base (299)..(299): a, c, t, g, unknown or other
  modified_base (311)..(311): a, c, t, g, unknown or other
tcagcgtagactagcacgaccggtgctcgatttagagtgctacgaagggaaaggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttgtagttataattatgtcnctggtaccaacagtacccaggcaaagcccccaaatcatgatttangaggtcagtaancggcctctagggttctaactccgcttctcgtgctaccaagttcgtggaccaacaccggccctccctagaccctatctctcgggctccgaggctggaggtacgaggtagattatactgggactagctacaatatacgagtgctagcactcgtcgtattcgggcggttggaaccagcgttcgaccgtcaggtcagccgagccttcgccccg

SEQ ID NO: 369337 - DNA, 535 bp, Homo sapiens
  misc_feature: GZ8MTXP01DQVWR.17.29.C07.1.454.CMB.2.raw
  modified_base (407)..(407): a, c, t, g, unknown or other
  modified_base (414)..(414): a, c, t, g, unknown or other
  modified_base (422)..(422): a, c, t, g, unknown or other
tcagcgtagactagcacgaccggtgctcgatttagagtgctacgaagggaaagggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcatcatcttctgcactggatccagcagtgacgttggtagttataattatgtctcctggtaccaacagtacccaggcaaagcccccaaatcatgatttatgaggtcagtaatcggcccttcaggggtttctaatccgcttctctggctaccaagtctggcaaacacggcctcctgacccatctctgggctccagctgagacgagggtntattatngcatctanatatagaagtcgctagctactcgtcgttagttcgggtcggttacgggaaccaagttcgttcggttacccgttcgtaggtccgacggacccgaacggtccgttcccgtcccccg

SEQ ID NO: 369338 - DNA, 533 bp, Homo sapiens
  misc_feature: GZ8MTXP01ALADP.17.29.C07.1.454.CMB.2.raw
  modified_base (302)..(302): a, c, t, g, unknown or other
tcagcgtagactagcacgaccggtgctcgatttagagtgctacgaagggaaagggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcatcatcttctgcactggatccagcagtgacgttgtagttataattatgtctcctggtaccaacagtacccaggacaaacgcccccaaatcatgatttangagtcagtaatcggcctcgagggtttctaatccgcttctcgtgctaccaagtctggacaacacggcctcctgacccatctcgtgggctccgagcgtggacggacggagggtgatttacttactggggacagtctacgaatagtagaagtggcagcactctgtagttcgggcggttggaccaagccgttgacccgtcgtaggtccacgcccgaacggtccttccggcccccg

SEQ ID NO: 369339 - DNA, 680 bp, Homo sapiens
  misc_feature: GZ8MTXP01CCFTV.17.29.C07.1.454.CMB.2.raw
tcagcgtagactagcacgaccggtgctcgatttagagtgctacgaagggaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttatattatgtctctggtaccaacagtacccaggaccaaacgcccccaaactcatgtatttatgaggtcagtaactcggcctcgtaggggtttctaagttcccgtcttctcgtcggctaccaagtctggacaacgacggccctccgtgacctatctcgtcgggcctccgagggtcctgggaacgggtacggaggggttagtaagtttagtttaaccgtcggggtactaggtaccctactaagttaagtaacggtaaaggttcggacgacggtaccctaccgttccggtcgggtttaacgtttccgggggacccggggttagggggaaacccctaaacgggttcccgttacgggttaccccggtttccgggtacgggttaacccgaaccgggtaccccgaaaccggggttccccgttaacccgggtttccccccccgg

SEQ ID NO: 369340 - DNA, 655 bp, Homo sapiens
  misc_feature: GZ8MTXP01BRTS1.17.29.C07.1.454.CMB.2.raw
  modified_base (303)..(303): a, c, t, g, unknown or other
tcagcgtagactagcacgaccggtgctcgatttagagtgctacgaagggaaagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctctggtaccaacagtacccaggcaaacgcccccaaactcatgatttangagtcagtatcggccctgaggggtttctaatccgcttctctggcctaccaagtctcgggaccaaccgaccggtcccctccctcgaccctattcctccgttcggggccttcccgagggtcgtgggagggacgggaggggttgtaatttattacgtggggctaggtcctactaataacgtaggtaaaggttgggacacggtactaaccttcggttccggttaacgtttccgggggccgggttacgggggaaccctaaagggttcccggttcggttaccccgggttaacccgtaacgggttcccgaaccgggtaccccggttaaacggggtccccgttcccgggtccccccccgg

SEQ ID NO: 369341 - DNA, 590 bp, Homo sapiens
  misc_feature: GZ8MTXP01ELWNN.17.29.C07.1.454.CMB.2.raw
  modified_base (305)..(305): a, c, t, g, unknown or other
  modified_base (407)..(407): a, c, t, g, unknown or other
  modified_base (436)..(436): a, c, t, g, unknown or other
tcagcgtagactagcacgaccggtgctcgatttagagtgctacgaagggaaagggggggtctcaggaggcagcgctctcaggacatctccaccatggcctgggctctgctgctcctcaccctcctcactcagggcacagggtcctgggcccagtctgccctgactcagcctgcctcgtgtctggtctccgtggacagtcgatcatcattcttctgcactggatccagcagtgacgttgtagttataattatgtctcctaggtaccaacacgtacccaggacaaacgcccccaaatcatgatttangagtcagtatcgcctgtaggttcatccgcttctcgtgctacaagtcgtgcaacgcggcctccagaccatctcgtcgggctccgagctacgaggacgagggtntaagtttatacgtgggactaggtacctanaagtagtaggaagttcgggactacgacctacgttcggtcgtttaacgggttccggggtccggggttacgggaacccgaaagggttccgttaccggacccggttaaccggtacgttccgacgaccccggttaagtcccgttcccggttccccccg

SEQ ID NO: 369342 - DNA, 604 bp, Homo sapiens
  misc_feature: GZ8MTXP01CJKEM.17.29.C07.1.454.CMB.2.raw
  modified_base (389)..(389): a, c, t, g, unknown or other
  modified_base (459)..(459): a, c, t, g, unknown or other
tcagcgtagactagcacgaccggtgctcgatttagagtgctacgaagggaaagggggggtctcaggaggcagcgctctcaggacatctccaccatggcctgggctctgctgctcctcaccctcctcactcagggcacagggtcctgggcccagtctgccctgactcagcctgcctcgtgtctggtctcctggacagtcgatcatcatcttctgcactggatccagcagtgtacgttgtagttataattatgtctctggtaccaacagtacccaggcaaacgccccaaatcatgatttatgaggtcagtaactcggccctcgtaggggtttctaactccgtcttctctggctaccaagtctaggccaaacgtccggccctcctcgaaccnctctcgtcgggcctcgacggcgtggagggacggagggttacgtaattagttacctggggctaagtcctanattaagtaggtaagtggacaggtccaacgttcgtccggttaagttccggggccgggttacgggaaaccgaacgttccgttcgacccggttccgtacggggttccacgggtaccccgaacggggtcccttccgggttcccccccgg

SEQ ID NO: 369343 - DNA, 623 bp, Homo sapiens
  misc_feature: GZ8MTXP01BBCSS.17.29.C07.1.454.CMB.2.raw
  modified_base (257)..(257): a, c, t, g, unknown or other
  modified_base (311)..(311): a, c, t, g, unknown or other
  modified_base (403)..(403): a, c, t, g, unknown or other
tcagcgtagactagcacgaccggtgctcgatttagagtgctacgaagggaaaggggggggtctcaggaggcagcgctctcaggacatctccaccatggcctgggctctgctgctcctcaccctcctcactcagggcacgagggtcctgggcccagtctgccctgactcagcctgcctcgtgtcgtgggtctccgtggacagtcgatcatcattcttctgcactggactccagcagtgtacgtttggtagttatattntgtctctgtaccacacgtaccagaccaaaccgaccccaaatcatagtatttagngtagtcaagtaacgtccggtccttagtagggtttctagtcccgtcttctctcgcctacaacgtcgagaccaacgcccgtcctcctcgacctntcctcgtggctcgagcgtggacggtacgtagggtactattagtcgtagggctagacctatagtaagtagtaaggtcggactaccggtctaccgttcggtaacggttccggttcgggggtccggacgggtaaaccctacggttcccgttcgggttaacccgttccggtaaccggtccgaaccggtacccgttaacggtccccgttcccgggttccccccgg

SEQ ID NO: 369344 - DNA, 543 bp, Homo sapiens
  misc_feature: GZ8MTXP01BRQQ1.17.29.C07.1.454.CMB.2.raw
  modified_base (297)..(297): a, c, t, g, unknown or other
tcagcgtagactagcacgaccggtgctcgatttagagtgctacgaagggaaagggggggtctcaggaggcagcgctctcaggacatctccaccatggcctgggctctgctgctcctcaccctcctcactcagggcacagggtcctgggcccagtctgccctgactcagcctgcctcgtgtctggtctcctggacagtcgatcatcatcttctgcactggatccagcagtgacgttgtagttatattatgtctctggtacaacagtacccaggcaaacgccccaaactcatgatttangaggtcagtaatcggcctcaggggtttctaatccgtcttctctcggctaccaagtctggacaacacggcctaccctgacccatctctgggctcaggctgaggacgaggtgtattattactgggcagctcatatagagtggcagacactcgtcgttaacgttcgggcggttcggggaccaaggttcgttcggacccgttccggtaacggttccgacgccccgaaacgggtccttccggtccccccgg

SEQ ID NO: 369345 - DNA, 519 bp, Homo sapiens
  misc_feature: GZ8MTXP01AYBN3.17.29.C07.1.454.CMB.2.raw
  modified_base (212)..(212): a, c, t, g, unknown or other
  modified_base (300)..(300): a, c, t, g, unknown or other
  modified_base (380)..(380): a, c, t, g, unknown or other
  modified_base (410)..(410): a, c, t, g, unknown or other
  modified_base (445)..(445): a, c, t, g, unknown or other
  modified_base (454)..(454): a, c, t, g, unknown or other
tcagcgtagactagcacgaccggtgctcgatttagagtgctacgaagggaaagggggggtctcaggaggcagcgctctcaggacatctccaccatggcctgggctctgctgctcctcaccctcctcactcagggcacagggtcctgggcccagtctgccctgactcagcctgcctcgtgtctggtctcctggacagtcgatcatcatcttcngcactggatccagcagtgaaacgttgtagttataattatgtctctggtaccaacagtacccaggcaaacgccccaaatcatgatttangaggtcagtaatcggccttgaggggtttcaatccgcttctctggcctaccaagtctggacaacacggcctcctgaccctntctctgggctccaggctgaggacgagggtntagttatacgtgggcagctacattagagagtcggntagctactntcgtagttcgggcggttcggacaagcgttgaccgtcgtgtcgacgccgaaggtccgcgtcccccg

SEQ ID NO: 369346 - DNA, 495 bp, Homo sapiens
  misc_feature: GZ8MTXP01BXHOG.17.29.C07.1.454.CMB.2.raw
  modified_base (295)..(295): a, c, t, g, unknown or other
  modified_base (300)..(300): a, c, t, g, unknown or other
  modified_base (318)..(318): a, c, t, g, unknown or other
  modified_base (327)..(327): a, c, t, g, unknown or other
  modified_base (347)..(347): a, c, t, g, unknown or other
  modified_base (364)..(364): a, c, t, g, unknown or other
  modified_base (389)..(389): a, c, t, g, unknown or other
  modified_base (400)..(400): a, c, t, g, unknown or other
  modified_base (409)..(409): a, c, t, g, unknown or other
  modified_base (468)..(468): a, c, t, g, unknown or other
tcagcgtagactagcacgaccggtgctcgatttagagtgctacgaagggaaagggggggtctcaggaggcagcgctctcaggacatctccaccatggcctgggctctgctgctcctcaccctcctcactcagggcacagggtcctgggcccagtctgccctgactcagcctgcctcgtgtctggtctcctggacagtcgatcatcatcttctgcactggatccagcagtgacgtttgtagttataattatgtctctgtaccaacagtaccagcaaacgccccaaatcatgattangagtnagtatcgcctgtaggttntatcgcttnctgctacaagtctggcaacnccgcctcctgaccatcncgtggctcaggctgaggacgtaggngtattatacgnggcagctanatagtagagtgctagcactctgtaagttcgggcggttgaccgagccgttgaccgttcgngtcgcgcccaggtccgttccgtccccg

SEQ ID NO: 369347 - DNA, 714 bp, Homo sapiens
  misc_feature: GZ8MTXP01AHIP2.17.29.C07.1.454.CMB.2.raw
  modified_base (217)..(217): a, c, t, g, unknown or other
  modified_base (311)..(311): a, c, t, g, unknown or other
tcagcgtagactagcacgaccggtgctcgatttagagtgctacgaagggaaaggggggggtctcaggaggcagcgctctcaggacatctccaccatggcctgggctctgctgctcctcaccctcctcactcagggcacagggtcctgggcccagtctgccctgactcagcctgcctcgtgtcgtgggtctccgtggacagtcgatcatcattcttcngcactggatccagcagtgtacgttggtagttataattatgtctcctaggtaccaacacgtacccaggaccaaacgccccaaatcatgtatttangaggtactagtaacgtccggtccttacgtaggggtttactaacgtccgtacttcgtcgtcggctaaccgtaagtcgtacggaccaaccgacccgggtccctcccgtacgtaaaccctctccgttccggtcggggtccctaccggtacgggtaccggtagggaacgggtacgggtaggggttacgtaagtttacgttaacgttcggggactaggtccttaacgtaaagtttaagaaggtaacggttcgggaccacggtaccttaaccgttcggttaaccggttaacgggtttccggggtacggggttaccgggaaccgtaacggttcccgttaccggttacccggttccggttacggaaccgaacccgacccggttaaccggtcccgttcccggttccccccgg

SEQ ID NO: 369348 - DNA, 791 bp, Homo sapiens
  misc_feature: GZ8MTXP01CYK0E.17.29.C07.1.454.CMB.2.raw
  modified_base (216)..(216): a, c, t, g, unknown or other
tcagcgtagactagcacgaccggtgctcgatttagagtgctacgaaggggaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttcngcatggatccagcagtgtagttgtagttataattatgtctctaggtaccaacacgtaccaggaccaaacgacccccaaactcatgtatttagtgtaggtacagtaactccggccgttacgtaggggtttactaacgtcccgtctttcgtcgtcggtcctaacccgtaagttccgtacggacccaaacccgtaccgggtcccccttaccccgtacggtaacccctaacgtttcccgttccggttcgggggtcccttacccggaacggggtccgttacggggaaacggggtaaccggggttaaacgggggttagttaaacgtttttaacgtttaaccggttacggggtaccgtaaacgggtaccgttaacctaaagtttaaacggttaaacgggtaaaaggggtttccggggaactaaacgggtcctaaccgtttccgtttaaccgggttaacggtttaccgggggtaccggggttacggggaaacccgtaacggttaccgttccgggttaaccccgttccggtaacgggtccgaccggaccccgttaacgggtccccgttcccggttcccccccgg

SEQ ID NO: 369349 - DNA, 659 bp, Homo sapiens
  misc_feature: GZ8MTXP01A4B8T.17.29.C07.1.454.CMB.2.raw
  modified_base (263)..(263): a, c, t, g, unknown or other
  modified_base (381)..(381): a, c, t, g, unknown or other
  modified_base (436)..(436): a, c, t, g, unknown or other
tcagcgtagactagcacgaccggtgctcgatttagagtgctacgaagggaaaggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcatcattcttctgctacgtggactccagctaaggtggtagtttggtaagtttaataattntgttctcctaggtaaccaacgacgtaccgagacaaacgaccccaaatcatcgtatttagagtacggtacaagttaacgtccggtacccttaggttacgggtttactacgtccgtcttntcgtggtccctaacgaagttcctaggaccccaacgtccccggtcctaccccgtanaacccgtcttcgtcggtcgggctccgaggtccgtagggacggacgggtaggtatacgtttaatcgtagggctacgtcctaataagtacgtaagtacggagccgagcctagtcctaaggttacgttcggggcggttaccgggactaacgggttccgttacggttacccggtaagtaccggtaacgaccgtacccggttaacggtccccgttaaccggtccccgg

SEQ ID NO: 369350 - DNA, 604 bp, Homo sapiens
  misc_feature: GZ8MTXP01BAEGJ.17.29.C07.1.454.CMB.2.raw
  modified_base (212)..(212): a, c, t, g, unknown or other
  modified_base (426)..(426): a, c, t, g, unknown or other
  modified_base (443)..(443): a, c, t, g, unknown or other
tcagcgtagactagcacgaccggtgctcgatttagagtgctacgaagggaaaggggggggtctcaggaggcagcgctctcaggacatctccaccatggcctgggctctgctgctcctcaccctcctcactcagggcacagggtcctgggcccagtctgccctgactcagcctgcctccgtgtctggtctcctggacagtcatcatcatcttngcactggatccagcagtgacgttgtagttataattatgtctcgtaggtaccaacacgtacccaggaccaaacgcccccaaatcaatgtatttatgaggtcagtaacgtccggtccgtgtaggggtttcaatcccgtctttctctggcctaaccgtaagttcgaggaccctaaacgcccggtccctaccctagacctactcgtctcgggctccgngtctggaggacgtaggntattatacgtggactagtcctatatagtagtaagcggtacagtcgtaccttggtcgttaagggttccggggtacggttcgggaacctaaggttcccgttcgttacccgggttaacctaggggtaacaccggccgttaacggtcccgttccgtcccccccgg

SEQ ID NO: 369351 - DNA, 502 bp, Homo sapiens
  misc_feature: GZ8MTXP02IM83H.17.29.C07.1.454.CMB.2.raw
  modified_base (300)..(300): a, c, t, g, unknown or other
  modified_base (380)..(380): a, c, t, g, unknown or other
  modified_base (404)..(404): a, c, t, g, unknown or other
  modified_base (424)..(424): a, c, t, g, unknown or other
tcagcgtagactagcacgaccggtgctcgatttagagtgctacgaagggaaagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaatcatgatttangaggtcagtaatcggccctgaggggtttctaatcccgcttctctggctccaagtctggcaacacgccctcctgaccatcnctggctcagctgaggacgagggtnattatactgctagctcatanagaagtggcagcactctcgtattcggcggtgggaccaagcctgacccgtcgtagtcacgcccaaggccttcgcccccg

SEQ ID NO: 369352 - DNA, 497 bp, Homo sapiens
  misc_feature: GZ8MTXP02FK085.17.29.C07.1.454.CMB.2.raw
  modified_base (465)..(465): a, c, t, g, unknown or other
tcagcgtagactagcacgaccggtgctcgatttagagtgctacgaagggaaaggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttgtagttataattatgtctctggtaccaacagtacccaggcaaagcccccaaactcatgatttatgaggtcagtaatcggccctcaggggtttctaatccgcttctctggctccaagtctggcaacacggcctcctgacccatctctgggctccagctgagacgagggtgattatactgcagctcatatagaagtggcagcactctcgtattcggcggtgggaccaagcngaccgtctaggtcagcccaaggctcgcccccg

SEQ ID NO: 369353 - DNA, 498 bp, Homo sapiens
  misc_feature: GZ8MTXP02F8W1R.17.29.C07.1.454.CMB.2.raw
tcagcgtagactagcacgaccggtgctcgatttagagtgctacgaagggaaaggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaatcatgatttatgaggtcagtaatcggccctgaggggtttctaatccgcttctctgctccaagtctggcaacacgcctcctgaccatctctggctccagctgaggacgtagggtgagttattactgcagctacatatagaagtggacagcactctcgtagttcggcgtgggaccaagctgaccgtctagtcacgcccaggctcgccccg

SEQ ID NO: 369354 - DNA, 518 bp, Homo sapiens
  misc_feature: GZ8MTXP02HIOU3.17.29.C07.1.454.CMB.2.raw
  modified_base (301)..(301): a, c, t, g, unknown or other
  modified_base (408)..(408): a, c, t, g, unknown or other
tcagcgtagactagcacgaccggtgctcgatttagagtgctacgaagggaaagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctctggtaccaacagtacccaggcaaacgccccaaatcatgatttangagtcagtaatcgcctgagggtttctaatccgcttctctgctccaagtctggcaacgacgtccctccctagacccatctctggctcccagctagaggacgaggggtnaatttattaactgactagctacatagtagagtggcagcctactctcgtagttcgggcggacgggaaccacgcgtacgaccgtcgagtcacgaccgacgccttccgccccg

SEQ ID NO: 369355 - DNA, 514 bp, Homo sapiens
  misc_feature: GZ8MTXP02JVLST.17.29.C07.1.454.CMB.2.raw
  modified_base (213)..(213): a, c, t, g, unknown or other
  modified_base (301)..(301): a, c, t, g, unknown or other
  modified_base (375)..(375): a, c, t, g, unknown or other
  modified_base (425)..(425): a, c, t, g, unknown or other
  modified_base (437)..(437): a, c, t, g, unknown or other
tcagcgtagactagcacgaccggtgctcgatttagagtgctacgaagggaaaggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttcngcactggatccagcagtgacgttggtagttataattatgtctcctggtaccaacagtacccaggcaaagcccccaaatcatgatttangaggtcagtaatcggcctcgtaggggtttctaatccgtcttctctggctaccaagtctggcaacacggcctccngaccatctctgggctccgagctgagacgagggtgattatactgcagctanatagagagtgcngactctcgtcgtagtcggcggtacggacacgtcgtacgtaccgtcgtacgccgacgaccgacggtcctccgtccccg

SEQ ID NO: 369356 - DNA, 518 bp, Homo sapiens
  misc_feature: GZ8MTXP02JDZK6.17.29.C07.1.454.CMB.2.raw
  modified_base (303)..(303): a, c, t, g, unknown or other
  modified_base (323)..(323): a, c, t, g, unknown or other
tcagcgtagactagcacgaccggtgctcgatttagagtgctacgaagggaaagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttgtagttataattatgtctcctggtaccaacagtacccaggcaaacgcccccaaactcatgatttangaggtcagtaatcggccctnaggggtttctaatccgcttctctggctccaagtctggcaacacggcctcctgaccatctctgggctccgagctggaggacgagggtgattattactgcagctacatatagaagtggacagcacgtctcgtacgttcggcggtagggaccagaccgtgaccgtcgtacggtcacgacccgaaggcctcgtcccccg

SEQ ID NO: 369357 - DNA, 517 bp, Homo sapiens
  misc_feature: GZ8MTXP02HWPBE.17.29.C07.1.454.CMB.2.raw
  modified_base (412)..(412): a, c, t, g, unknown or other
tcagcgtagactagcacgaccggtgctcgatttagagtgctacgaagggaaagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttgtagtataattatgtctctggtaccaacagtacccaggcaaacgcccccaaactcatgatttatgaggtcagtaatcggcctcgaggggtttctaatccgctttctctggctccaagtctggcaacacggcctccctgacccatctctgggcctccaggctggaggacgagggtnaagttattactgctagctacgatatagaagtggcagcatctcgtagttccggcggtgggaccaagctcgaccgtcgtacggtcacgccaacggcctcgtcccccg

SEQ ID NO: 369358 - DNA, 534 bp, Homo sapiens
  misc_feature: GZ8MTXP02HDTJT.17.29.C07.1.454.CMB.2.raw
  modified_base (305)..(305): a, c, t, g, unknown or other
  modified_base (434)..(434): a, c, t, g, unknown or other
tcagcgtagactagcacgaccggtgctcgatttagagtgctacgaagggaaagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaacgcccccaaactcatgtatttangagtcagtaatcggccctcgtaggggtttctaatccgtcttctctcggctaccaagtctcggctaaccgaccggtccctccccgtggaccctatctcgtcgggctccgaggtctggaggacggagggtnatttatactgcagctacgatagtagagtggcagcactcgtcgtacgttcggcggtacggacacgctcgaccgtcgtaggcacgccgagcctcgtcccccg

SEQ ID NO: 369359 - DNA, 614 bp, Homo sapiens
  misc_feature: GZ8MTXP02JBX3B.17.29.C07.1.454.CMB.2.raw
  modified_base (261)..(261): a, c, t, g, unknown or other
  modified_base (294)..(294): a, c, t, g, unknown or other
  modified_base (440)..(440): a, c, t, g, unknown or other
tcagcgtagactagcacgaccggtgctcgatttagagtgctacgaagggaaaggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcatcatcttctgcactggatccagcagtgacgttgtagttatattatgtctctgtaccanagtaccaggcaaacgccccaaatcatgatttangagtcagtaatcggccctgtagggttctaatccgtcttctcgtggtctccgaacgtcgtaggaccaaaccgtaccggtccctcccgtgaaccctctcttccgtcggggtcctaccgaaggtccgtggaacggacggtaaggggtanaatttactacgtgctagtcctagattaagtagtaacgtggacacgactacgtcgttaacggtacgtttccgggacggttaggggaaaccctacggtaccgttacggtaaaccccgttccgtaacgggtaccaaccgggtaccccgaacgggtcccgttaccccggtccccccgg

SEQ ID NO: 369360 - DNA, 501 bp, Homo sapiens
  misc_feature: GZ8MTXP02GBNK5.17.29.C07.1.454.CMB.2.raw
  modified_base (301)..(301): a, c, t, g, unknown or other
  modified_base (376)..(376): a, c, t, g, unknown or other
  modified_base (428)..(428): a, c, t, g, unknown or other
  modified_base (432)..(432): a, c, t, g, unknown or other
  modified_base (448)..(448): a, c, t, g, unknown or other
  modified_base (492)..(492): a, c, t, g, unknown or other
tcagcgtagactagcacgaccggtgctcgatttagagtgctacgaagggaaaggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaatcatgatttangaggtcagtaatcggcctcgaggggtttctaatccgcttctctggctccaagtctgggcaacaccggccttcccngacccatcctctgggctccagctgaggacgagggtagattatactgcagctnatanagaatggcagcactcncgtattcggcggtggacagctgacgtcgtaggcacgccaacgcncgtcccccg

SEQ ID NO: 369361 - DNA, 506 bp, Homo sapiens
  misc_feature: GZ8MTXP02I51FK.17.29.C07.1.454.CMB.2.raw
  modified_base (393)..(393): a, c, t, g, unknown or other
  modified_base (410)..(410): a, c, t, g, unknown or other
  modified_base (422)..(422): a, c, t, g, unknown or other
tcagcgtagactagcacgaccggtgctcgatttagagtgctacgaagggaaaggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtaccaggcaaagcccccaaatcatgatttatgagtcagtaatcggcctgaggggtttctaatccgtcttctctcggctccaagtctggacaacaccggcctccctgacccatctctgggctccngctcggaggcgagggtnattatactgacngctcatagtagaagtgcagcactctcgtattcggcggtaggacagccgtgaccgtccgtaggtcacgccgaacgctcgcccccg

SEQ ID NO: 369362 - DNA, 532 bp, Homo sapiens
  misc_feature: GZ8MTXP02JU2GA.17.29.C07.1.454.CMB.2.raw
  modified_base (302)..(302): a, c, t, g, unknown or other
tcagcgtagactagcacgaccggtgctcgatttagagtgctacgaagggaaagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcattcttctgcacgtggatccagcagtgacgttgtagttatattatgtctctggtaccaacagtaccaggcaaacgcccccaaactcatgatttangaggtcagtaatcggcctgaggggtttctaatccgcttctctgctccagtctggacacgacgcctcctgaccatctctggctccgagctggacggacgagggtcattaattcgtagcagctcatagtagagtgcagcactctcgtagtttccgggcggtacggggaccaagtccgtacgacccgtaacgttacgggaccacggcccgaacggtccgttccgtccccccgg

SEQ ID NO: 369363 - DNA, 581 bp, Homo sapiens
  misc_feature: GZ8MTXP02FQDFY.17.29.C07.1.454.CMB.2.raw
  modified_base (213)..(213): a, c, t, g, unknown or other
  modified_base (297)..(297): a, c, t, g, unknown or other
  modified_base (399)..(399): a, c, t, g, unknown or other
  modified_base (406)..(406): a, c, t, g, unknown or other
  modified_base (449)..(449): a, c, t, g, unknown or other
tcagcgtagactagcacgaccggtgctcgatttagagtgctacgaagggaaagggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcatcatcatcttntgcactggatccagcagtgacgttgtagttatatatgtctctgtacaacacgtaccaggacaaacgccccaaatcatgtattangagtacagtaactcggtcctcgtaggggtttctaactcgtcttctctcggctctagtctagcaacgccgtcctcctagacctactcttcgtcgggcctccgnggtacgnggacggacggtagggtagtatttagttactagtcacgtactanaatagtagaacgtgacgagctacgttactacggttacgttcgggtacgggttaacgggaccaacgtaccgtacggtacccgtaacggttaacgtccggacgaccccgaaggtccccgtaccggtccccccgg

SEQ ID NO: 369364 - DNA, 559 bp, Homo sapiens
  misc_feature: GZ8MTXP02FIYGS.17.29.C07.1.454.CMB.2.raw
  modified_base (213)..(213): a, c, t, g, unknown or other
  modified_base (301)..(301): a, c, t, g, unknown or other
  modified_base (412)..(412): a, c, t, g, unknown or other
  modified_base (421)..(421): a, c, t, g, unknown or other
  modified_base (438)..(438): a, c, t, g, unknown or other
tcagcgtagactagcacgaccggtgctcgatttagagtgctacgaagggaaagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttntgcactggatccagcagtgacgttgtagttatattatgtctctggtaccaacagtacccaggacaaacgcccccaaatcatgatttangaggtcagtaatcggccctcgaggggtttctaatcccgtactttctctcggctccgaagtctgggacctaaacgaccgccctccctgaccctatctcgtgggctcgagtcnggaggacgngggtagatttatacgtnacagtctacatatagaagtgcagctacgtctacgtagttcggggcggtacggggaccctaaggtccgtcggtacccgtaacgtacggtacgacgacccgaacggcctaccggtccccccgg

SEQ ID NO: 369365 - DNA, 596 bp, Homo sapiens
  misc_feature: GZ8MTXP02HXBD8.17.29.C07.1.454.CMB.2.raw
tcagcgtagactagcacgaccggtgctcgatttagagtgctacgaagggaaagggggggtctcaggaggcagcgctctcaggacatctccaccatggcctgggctctgctgctcctcaccctcctcactcagggcacgagggtcctgggcccagtctgccctgactcagcctgcctcgtgtctgggtctcctggacagtcgatcatcattcttctgcactggatccagcagtgacgttgtagttatattatgtctctgtaccaacagtaccaggaccaaacgaccccaaactcatgtattatgagtactagtaagtccggtcctgtacggggttctaagtcccgtcttctctggtctaccgagtcgtggacacgtaccgtcctccctagacctctcgtcgtcgggcctacgaggtctaggacggacggtgggtagtattattacgtgtacgtagtcctatagtagtagtaaggtgacgtagctacgttcgtacggttacgtcggggtacggtacgggtaacctacggtccgtacggtacccgttaacggtacggtaccgaccggacccgtaacggtccgttaccccggtcccccgg

SEQ ID NO: 369366 - DNA, 528 bp, Homo sapiens
  misc_feature: GZ8MTXP01E105W.15.23.C01.1.454.CMB.2.raw
  modified_base (347)..(347): a, c, t, g, unknown or other
  modified_base (374)..(374): a, c, t, g, unknown or other
  modified_base (492)..(492): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgcccgcctctggactcacctttagagctattggatgagctgggtccgccaggctccgaggggaaggggctgggagtggggtgccaanataaaggagatcggaagtcaagaaacnctaaatgtggactctggtgaaggggccattcaccatctcagagacaacgccaagaattcagtgtatctggacaaatgaacagcctgagagccgaggacacggccgtgtattatgttgngagagcatgacaaggtgagttacggtggggttgaag

SEQ ID NO: 369367 - DNA, 534 bp, Homo sapiens
  misc_feature: GZ8MTXP01BX335.15.23.C01.1.454.CMB.2.raw
  modified_base (335)..(335): a, c, t, g, unknown or other
  modified_base (382)..(382): a, c, t, g, unknown or other
  modified_base (406)..(406): a, c, t, g, unknown or other
  modified_base (433)..(433): a, c, t, g, unknown or other
  modified_base (437)..(437): a, c, t, g, unknown or other
  modified_base (462)..(462): a, c, t, g, unknown or other
  modified_base (503)..(503): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttcgtgtagctatttagtaaggtgtcagtgcgaggagcagctggtggagtcgtgggggaggcctggtccgaggccggggggtccccgagactctcctgtgccgcctctggactcacctttagtagctattggatgagctggtccgccaggctccgagggaggggctggaggttgggnggccaagataaaggaagatggaacgtcagaaacactatgtggaactntgtgaagggccgattcaccattcnccaagagaccaacgcctaaagtaatanagtntatatagacgaatagaacacgacgngagagacgacgacgacgcgtgtaatgttgtgttgagagagnagaagagtaagagtacggttagggtgttgtg

SEQ ID NO: 369368 - DNA, 643 bp, Homo sapiens
  misc_feature: GZ8MTXP01BG1QN.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttcgtgtagctatttagaaggtgtcagtgcgaggagcagctggtggagtcgtggggggagccgtggtcccgaggccgggggggtccctggagctctcctgtgcccgctctggactcacctttagagctattggatgagcgtggtccgccgacggcgtccgagggaagggggcggtggaggtgggtcggacgaacgaagtaaaggaaagagtaggaagtagaagaaacaactaagtagtgtacgtcgtaggtaggaacgggacgtactactactactactaccgacgaacgaaccgaaaccgaaccgaaacgtaaacgtacgtacgtagttacgttacgtacggtaacgtaaagtaacgaacgacgacgacgacgacggacggaacggacgaccggtcgtaacgttacgttacgtgttagtagtaagacgacgagtaagaacgtaacggtaacggtaacggttaacgggtaacgggttaaggtaag

SEQ ID NO: 369369 - DNA, 517 bp, Homo sapiens
  misc_feature: GZ8MTXP01CX0LB.15.23.C01.1.454.CMB.2.raw
  modified_base (307)..(307): a, c, t, g, unknown or other
  modified_base (349)..(349): a, c, t, g, unknown or other
  modified_base (376)..(376): a, c, t, g, unknown or other
  modified_base (387)..(387): a, c, t, g, unknown or other
  modified_base (406)..(406): a, c, t, g, unknown or other
  modified_base (411)..(411): a, c, t, g, unknown or other
  modified_base (425)..(425): a, c, t, g, unknown or other
  modified_base (427)..(427): a, c, t, g, unknown or other
  modified_base (431)..(431): a, c, t, g, unknown or other
  modified_base (435)..(435): a, c, t, g, unknown or other
  modified_base (438)..(438): a, c, t, g, unknown or other
  modified_base (440)..(440): a, c, t, g, unknown or other
  modified_base (442)..(442): a, c, t, g, unknown or other
  modified_base (446)..(446): a, c, t, g, unknown or other
  modified_base (472)..(472): a, c, t, g, unknown or other
  modified_base (484)..(484): a, c, t, g, unknown or other
  modified_base (486)..(486): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttcgtgtagctattttagaaggtgtccagtgcgaggagcagctggtggagtctgggggaggcctgggtccaggcccggggggggtccctgagactctcctgtgcccgcctctggactcacctttagagctattggatgagctgggtccnccaggctccgaggggaaggggctgggagtgggtggaccaaanataaaaggagatggaagtcaagaaacntaatgtgactntgtgaagggcatcacatcncaganacaagctaagatanantatngtanaanananagcngagagacgacgacgacgcgtgtattntgttgtgagagnanaagacgaacgtagagttacggtaaggttgtg

SEQ ID NO: 369370 - DNA, 533 bp, Homo sapiens
  misc_feature: GZ8MTXP01ACA4B.15.23.C01.1.454.CMB.2.raw
  modified_base (308)..(308): a, c, t, g, unknown or other
  modified_base (346)..(346): a, c, t, g, unknown or other
  modified_base (411)..(411): a, c, t, g, unknown or other
  modified_base (454)..(454): a, c, t, g, unknown or other
  modified_base (488)..(488): a, c, t, g, unknown or other
  modified_base (498)..(498): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttcctgttgctattttagaaggtgtccagtgcgaggagcagctggtggagtcgtggggggaggcctgggtccaggccgggggggtccctgagactctcctgtgccgcctctggactcacctttagagctattggatgagctgggtccnccaggctccgaggggagggctgggagtgggtggccaanataaaggagatggaagtcaagaaacactaatgtggactcgtgtggaaggggccattccaccatcncagagacaacgcaaagattcagtgtatctggacaaatgaaacngcctgagagccgaggactacgggctgtattacgngttgtgaagngcatgagaacggtagagacggtaagggttggtaag

SEQ ID NO: 369371 - DNA, 531 bp, Homo sapiens
  misc_feature: GZ8MTXP01DWGFG.15.23.C01.1.454.CMB.2.raw
  modified_base (347)..(347): a, c, t, g, unknown or other
  modified_base (413)..(413): a, c, t, g, unknown or other
  modified_base (436)..(436): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctgggtggagtcgtggggggaggcctggtccaggccgggggggtccctgagactctcctgtgcccgcctctggactcacctttagagctattggatgagctgggtccgccaggctccgaggggaagggctgggagtgggtgccaanataaaggagatggaagtcagaaacactaaatgtggactctgtagaagggccattcaccatctcagngacaacgcaaagattcagtgtanctaggcaaatgaaacagcctgagagccgagactacggccgtgtattactgttgtgagagcatgaacaacggtgaagttaaccgggtgggttgaag

SEQ ID NO: 369372 - DNA, 559 bp, Homo sapiens
  misc_feature: GZ8MTXP01CW4EM.15.23.C01.1.454.CMB.2.raw
  modified_base (306)..(306): a, c, t, g, unknown or other
  modified_base (344)..(344): a, c, t, g, unknown or other
  modified_base (519)..(519): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctgagactctcctgtcgccgcctctggactcacctttagagctatgatgagctgggtccncaggctccgaggggagggctgggagtgggtggccaaanataaaggagataggaagtcaagaaaacactaaatgtggactcgtggtagaaggggcccgaattcaaccatccaccagacgaacaaacgtccaaagaattcagtgtaatctaggacaaatagaacagaccgagagagacgacggacgacggccgtgtagttactgttgtgagaganataagacgaacggtaggagaacggtaaggggttggtaagg

SEQ ID NO: 369373 - DNA, 539 bp, Homo sapiens
  misc_feature: GZ8MTXP01BKOW7.15.23.C01.1.454.CMB.2.raw
  modified_base (305)..(305): a, c, t, g, unknown or other
  modified_base (346)..(346): a, c, t, g, unknown or other
  modified_base (409)..(409): a, c, t, g, unknown or other
  modified_base (414)..(414): a, c, t, g, unknown or other
  modified_base (457)..(457): a, c, t, g, unknown or other
  modified_base (482)..(482): a, c, t, g, unknown or other
  modified_base (490)..(490): a, c, t, g, unknown or other
  modified_base (529)..(529): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttcctgttgctattttagaaggtgtccagtgcgaggagcagctggtggagtcgtgggggagcctggtccaggccgggggggtccctgagactctcctgtgcccgcctctggactcacctttagagctattggatgagctgggtccnccagggctccgaggggaggggctgggagtggggtgccaaanataaaggagatggaagtcaagaaacactaatgtggactcgtgtgaagggccgattcaccatcncaganacaacgcaagattcagtgtatctaggacaaatgaaacagtccngagacgccgtaggacacggccggtntaattcgngttgtgagagacatgaacaacgggtgagttaaccggggngggtttgaag

SEQ ID NO: 369374 - DNA, 645 bp, Homo sapiens
  misc_feature: GZ8MTXP01DQT2C.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccaggccggggggtccctgagactctcctgtgcccgcctctggactcacctttagagctattggatgagctgggtccgccaggctccgaggggaagggctgggagtgggtgaccaagataaaggagatggaagtcaagaaacactaaagtgtggactcgtggtaggaaacggggcccgtaatttcccaaccctatcctacccgaagaacgaaccaaacggcccaaaaggtaacttcaaggttgttaaatccgtaggggaacctaaaagttcggaaaaccaggcccctagggaacggaacgggtccccggaaaggggtacccaaccggggtcccgttaagtaactttacgtggttagtaggagttaagacagtggaaacaacggggtgaaacggttaaaccgggggtggggtttgaagg

SEQ ID NO: 369375 - DNA, 566 bp, Homo sapiens
  misc_feature: GZ8MTXP01CFQJB.15.23.C01.1.454.CMB.2.raw
  modified_base (428)..(428): a, c, t, g, unknown or other
  modified_base (470)..(470): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggttttcgtgtagctattttagaaggtgtcagtgcgaggagcagctggtggagtcgtgggggagcctggtccaggccgggggggtccctgagactctcctgtgccgcctctggactcacctttagagctattggatgacgcgtcgggtccgccgacggcgtccgagggaaggggcggtggaggtgggtggaccgaaacgaaagtaaaggaaagaagtacggaagtacgaagaaacaataatagtggactctgtgagggacggattcacactcnccagagacaacgaccaaagaatacagtagtatatagacaaanaagaacgacgcgagagacgacgacgacgacgcgtgtattagtgttgtagagagagagaagaacgaacggagacggttacgggtaagggttggtaag

SEQ ID NO: 369376 - DNA, 523 bp, Homo sapiens
  misc_feature: GZ8MTXP01A6HV4.15.23.C01.1.454.CMB.2.raw
  modified_base (295)..(295): a, c, t, g, unknown or other
  modified_base (316)..(316): a, c, t, g, unknown or other
  modified_base (318)..(318): a, c, t, g, unknown or other
  modified_base (320)..(320): a, c, t, g, unknown or other
  modified_base (325)..(325): a, c, t, g, unknown or other
  modified_base (329)..(329): a, c, t, g, unknown or other
  modified_base (339)..(339): a, c, t, g, unknown or other
  modified_base (344)..(344): a, c, t, g, unknown or other
  modified_base (354)..(354): a, c, t, g, unknown or other
tcagtctacgtagccacgaccggtgctcgatttagtacacgtgattagggattggggaggtctcagagaggagccttagccctggactccaaggcctttccacttggtgatcagcactgagcacagaggactcaccatggagttggggctgagcgtggttttcgtgtagctattttagaaggtgtcagtgcgaggagcagctggtggagtctgggggaggcctgggtccaggccgggggggtccctgagctctcctgtgccgctctggactcacctttagagctattggatgagntggtcgcagctccaggagggngngngtggngcanagaagagagngaganagacactaangtgctgtgtgaggcgatacacactctcgagacgacgaacgacaagatactagtagtatctagacaatagaacgacgcgtgagacgacgtacggacgacggcggtcgtagttagtgttgtgagacgacgagaagacgaacggaggtacggttacgggtaacgggttggtg

SEQ ID NO: 369377 - DNA, 553 bp, Homo sapiens
  misc_feature: GZ8MTXP01B4MT1.15.23.C01.1.454.CMB.2.raw
  modified_base (309)..(309): a, c, t, g, unknown or other
  modified_base (472)..(472): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggggggaggcctgggtccaggccgggggggtccctgagactctcctgtgcccgcctctggactcacctttagagctattggatgagctgggtccnccaggctccgaggggaaggggctgggagtgggtggaccaaacagtaaaaggaagataggaagtcaagaaacactaatgtggactcgtggtagaaggggccgattccaccatcctccagacgacaaacgccaaagaattcagtgtatctaggacaaatgaaacngcctgagagccgaggaccacggcctgtattactgttgtagagagcagtgacaacgggtgagttaaccgggtggggttgaag

SEQ ID NO: 369378 - DNA, 524 bp, Homo sapiens
  misc_feature: GZ8MTXP01DXVAT.15.23.C01.1.454.CMB.2.raw
  modified_base (412)..(412): a, c, t, g, unknown or other
  modified_base (479)..(479): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggggggaggcctggtccaggccggggggtccctgagactctcctgtgcccgcctctggactcacctttagagctattggatgagctgggtccgccaggctccgaggggaagggggctgggagtgggtggccaaacataaaggagatggaatcagaaacactaatgtggactctgtgaagggcattcaccatctcaganacaacgccaagatcagtgtatctggacaaatgaacagcctgagagccgagacacggcgtgtattacngttgtgagagcagtgaacaacggtgagttacgggtgggttgtaag

SEQ ID NO: 369379 - DNA, 629 bp, Homo sapiens
  misc_feature: GZ8MTXP01DMGAO.15.23.C01.1.454.CMB.2.raw
  modified_base (309)..(309): a, c, t, g, unknown or other
  modified_base (374)..(374): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccaggcccggggggtccctgagactctcctgtcgcccgcctctggactcacctttagagctattggatgagcgtgggtccnccaggctccgagggaagggctggagtgggtgaccaacagtaaaggagataggaagtcaagaaacnctaaatgtggactcgtagtaggaaacggggccaatttccaaccgtatccgtacccgaaggtacgaacccaaacggccctaaaaggtaactttccgaagttagtaacttccgttaggggaacctaaaagttacgaaaccgagtccccgtagaacggacggcccgaaggaccacgggtcccgttaaggtaacttaccgtgttgtaggagagacagtgaaaccgtaagggtagagttaaccggggtgggttcgtaagg

SEQ ID NO: 369380 - DNA, 559 bp, Homo sapiens
  misc_feature: GZ8MTXP01EBN6T.15.23.C01.1.454.CMB.2.raw
  modified_base (307)..(307): a, c, t, g, unknown or other
  modified_base (346)..(346): a, c, t, g, unknown or other
  modified_base (416)..(416): a, c, t, g, unknown or other
  modified_base (445)..(445): a, c, t, g, unknown or other
  modified_base (508)..(508): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccaggccgggggggtccctgagactctcctgtcgcccgcctctggactcacctttagagctattggatgagctgggtccncaggctccgaggggaagggctgggagtgggtgaccaaanaagtaaaggagataggaatacaagaaacactaaatgtggactcgtggtagaacgggccattcaccatccnccaagacgacaaacgcaaagaattcagtntaatctaggacaaatgaaacagcctgagaagccgaagacctacgggcctgtaacttatgttgngaacgagacagtgaacgaacgggtgaggttaaaccgggtggggtttgaagg

SEQ ID NO: 369381 - DNA, 552 bp, Homo sapiens
  misc_feature: GZ8MTXP01DNQGQ.15.23.C01.1.454.CMB.2.raw
  modified_base (351)..(351): a, c, t, g, unknown or other
  modified_base (401)..(401): a, c, t, g, unknown or other
  modified_base (425)..(425): a, c, t, g, unknown or other
  modified_base (444)..(444): a, c, t, g, unknown or other
  modified_base (448)..(448): a, c, t, g, unknown or other
  modified_base (457)..(457): a, c, t, g, unknown or other
  modified_base (460)..(460): a, c, t, g, unknown or other
  modified_base (462)..(462): a, c, t, g, unknown or other
  modified_base (467)..(467): a, c, t, g, unknown or other
  modified_base (470)..(470): a, c, t, g, unknown or other
  modified_base (513)..(513): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttctgtgctattttagaagtgtcagtgcgaggagcagctggtggagtcgtgggggagcctggtccgaggcccgggggggtccctgagactctcctgtcgccgcctcgtggactctacctttagagctattggatgagcgtggtcccgccaggcctccggaggggaaggggctgggaggtgggtaggaccaaanaagtaaaaggagagtaggaacgtcaagaaacataaagtgtggactgtagnggaaggccgatcactatcacaganacaacgacaaagtaacttnagtntatctaganaananacacncgngagacgacgacgacgacgcgtgtagttagtgttgtagagaganagaagacgaacgtagtacggttacgggtaagggttggtg

SEQ ID NO: 369382 - DNA, 530 bp, Homo sapiens
  misc_feature: GZ8MTXP01BPGB0.15.23.C01.1.454.CMB.2.raw
  modified_base (306)..(306): a, c, t, g, unknown or other
  modified_base (370)..(370): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctgggtccaggccgggggggtccctgagactctcctgtgccgcctctggactcacctttagagctattggatgagctgggtccnccaggctccgaggggagggctggagtgggtggccaaagataaaggagatggaagtcaagaaacnctaaatgtggactcgtgtgaagggccgaattccaccatcctacagacgacaaacgccaaagattcagtgaatctgcaaatgaacagctgagagccgaggacacggcctgtattactgttgtgagacgcatgacaacgtagagacggtaagggttggtaag

SEQ ID NO: 369383 - DNA, 582 bp, Homo sapiens
  misc_feature: GZ8MTXP01C05IH.15.23.C01.1.454.CMB.2.raw
  modified_base (306)..(306): a, c, t, g, unknown or other
  modified_base (540)..(540): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccgaggccgggggggtccctgagactctcctgtgccgcctctggactcacctttagagctattggatgagctgggtccncaggctccgaggggaagggctgggagtgggtggaccaaagaagtaaaaggaagatacggaagtacaagaaacactaaatgtggactcgtgtaggaaacgggccgattccaccctattccaccgagaacgaacaaacggtcaaagtaatttcgaagtgtaatctagggaactaaatagaacacgaccgagagagacggacggacgacggcgtcgtagttagtagttgtgagaganagtaagacgaacggtagtagttaacggtaagggttggtaagg

SEQ ID NO: 369384 - DNA, 540 bp, Homo sapiens
  misc_feature: GZ8MTXP01B1ACC.15.23.C01.1.454.CMB.2.raw
  modified_base (307)..(307): a, c, t, g, unknown or other
  modified_base (375)..(375): a, c, t, g, unknown or other
  modified_base (529)..(529): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctgggtccaggccgggggggtccctgagactctcctgtgccgcctctggactcacctttagagctattggatgagctgggtcccnccaggctccgaggggaagggggctgggagtgggtggccaacataaaggagatcggaagtcaagaaacnctaaatgtggactcgtgtgaagggccgattcaccatctcagagacaacgccaaagattcagtgtatctggacaaatgaacagcctgagagccgaggacacggccgtgtattactgttgtgagagacagtgaacgaacggtgacgttaccggggnggggttgtaag

SEQ ID NO: 369385 - DNA, 523 bp, Homo sapiens
  misc_feature: GZ8MTXP01EGACS.15.23.C01.1.454.CMB.2.raw
  modified_base (305)..(305): a, c, t, g, unknown or other
  modified_base (340)..(340): a, c, t, g, unknown or other
  modified_base (406)..(406): a, c, t, g, unknown or other
  modified_base (447)..(447): a, c, t, g, unknown or other
  modified_base (501)..(501): a, c, t, g, unknown or other
  modified_base (513)..(513): a, c, t, g, unknown or other
  modified_base (520)..(520): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctggggggagcctggtccaggccgggggggtccctgagactctcctgtgccgcctctggactcacctttagagctattggatgagctgggtccncaggctccgagggagggctgggagtgggtgccaanataaaggagatggaagtcaagaaacactaaatgtgggactcgtgtagaagggccgattcaccatcncagagacaacgcaagatcagtgtatctggacaaatgaaacngcctgagagccgaggacacggccgtgtattactgttgtgagagcatgacaaggngagttaacgggnggggttnaag

SEQ ID NO: 369386 - DNA, 589 bp, Homo sapiens
  misc_feature: GZ8MTXP01B0W40.15.23.C01.1.454.CMB.2.raw
  modified_base (353)..(353): a, c, t, g, unknown or other
  modified_base (382)..(382): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgctattttagaaggtgtccagtgcgaggagcagctggtggagtcgtggggggaggcctggtccgaggccgggggggtccctgagactctcctgtcgccgcctctggactcacctttagagctagttggatggagcgtgggtccgccaggcctccgagggggaagggctgggagtgggtggccaaanagtaaaaggagataggaagtcaagaaacnctaaatggtggactcgtggtagaaggggcccgattccaccatctaccagacgaacaacgccaaagtattcagtgtatctggactaaatgaaacagccctggagacggcccgtaagggaccacgggccgttaagtaacttacgtggttgtaggaagacgacagtaagaacgaacgggttgaacgttaaccggggtaaggggttgaagg

SEQ ID NO: 369387 - DNA, 550 bp, Homo sapiens
  misc_feature: GZ8MTXP01AURUN.15.23.C01.1.454.CMB.2.raw
  modified_base (341)..(341): a, c, t, g, unknown or other
  modified_base (408)..(408): a, c, t, g, unknown or other
  modified_base (411)..(411): a, c, t, g, unknown or other
  modified_base (455)..(455): a, c, t, g, unknown or other
  modified_base (494)..(494): a, c, t, g, unknown or other
  modified_base (546)..(546): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggggggaggcctgggtccgaggccgggggggtccctggagactctcctgtgccgcctctggactcacctttagagctattggatgagctgggtccgccaggctccgaggggagggctgggagtgggnggccaagagtaaaggagatggaagtcaagaaacactaatgtggactcgtgtgaagggccattcaccntcncagacgacaacgccaagactcagtgtatctggacaaatcgaacngcctagagacgccgaggaccacggggcctgtaattacgnggttgagagagcagtaaggactaacgggtgaacgttaacggggtgggggttnaagg

SEQ ID NO: 369388 - DNA, 622 bp, Homo sapiens
  misc_feature: GZ8MTXP01CNHLG.15.23.C01.1.454.CMB.2.raw
  modified_base (309)..(309): a, c, t, g, unknown or other
  modified_base (339)..(339): a, c, t, g, unknown or other
  modified_base (560)..(560): a, c, t, g, unknown or other
tcagtctacgtagccacgaccggtgctcgatttagtacacgtgattagggattgggaggtctcagagatgagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggaggcctggtccgaggccggggggtccctgacgactctcctgtcgccgcctctggactcaccttagagctattggatgagctgggtcccncaggctccgaggggagggctggagtggggngccaaacagtaaaggagactggaagtcaagaaacaactatggtggactcgtgtgaacggggccgaattccaaccatcctaccgaagaacgaaccaaaccggccaaaaggtaattacgaagttgtaatccgttgaactaaatcggaaaccagccctaggaaacggacgccggaaggaccgaacggggccgttaagttacgttaaccttggtaggtagaaggngaaccgtaatacggaaccgaaacggggttgaaacgttaaacccgggggttaagggtttaagg

SEQ ID NO: 369389 - DNA, 553 bp, Homo sapiens
  misc_feature: GZ8MTXP01AZRDX.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctgagactctccctgtcgcccgcctctggactcacctttagagctattggatgagctgggtcccgcaggctccgaggggaaggggctggagtgggtggccaacataaaggagataggaagtcaagaaacactaatgtggactcgtggtaggaacggggccgatttcacccatcctaccagacgacaaacgccaaagattcagtgtatctaggacaaatgaacagcctgagagccgaggaccacgggccgtgtagttactgttgtgacgagcagtgacgaacggtgaagttaccggggtgggttgaag

SEQ ID NO: 369390 - DNA, 664 bp, Homo sapiens
  misc_feature: GZ8MTXP01D71G6.15.23.C01.1.454.CMB.2.raw
  modified_base (351)..(351): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctgggtggagtcgtggggggagcctgggtccaggccggggggtccctgagactctcctgtcgcccgcctctggactctacctttagagctattggatgagcgtgggtccgccaggctcgagggggaagggctgggagtggggtgccaaanagtaaaaggagagtaggaagtcaagaaaaccactaaagtgtgggacttcgtggtaggaaacggggcccgtattaccaaccctatcctaccgaaggacgaaccaaacggcccaaaaggtaattccgaagttgtaattcctaggggaactaaaagttcgaaaaccgagcccctagggaaacggaacggccccggtaaagggacccgtaaccggggtcccggttaagttaactttacgtgggttgaaggaaggacgaccagtaacggaaacgtaacggggtgaacgggttaaaccggggttgggggttaataaggg

SEQ ID NO: 369391 - DNA, 717 bp, Homo sapiens
  misc_feature: GZ8MTXP01BU25Y.15.23.C01.1.454.CMB.2.raw
  modified_base (311)..(311): a, c, t, g, unknown or other
  modified_base (342)..(342): a, c, t, g, unknown or other
  modified_base (350)..(350): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccagggccgggggggtccctggagactctcctgtcgcccgcctctggactcacctttagagctattggatgagctgggtccncgaggctccgaggggagggctgggagtgggngaccaaanagtaaaggagagtaggaaagtcaagaaaacactaaagtggtggactcgtagggtaggaaacggggcccgtaatttcccaccctaactacctacccgaacggaaacggaaaccgaaaccgaacccgaaaaggtaaacgttaacctaacgttacggttaagttaccttacggggtaacgaaaacttaaggaaaccaacgtacccgtacggaaggaaacggacccggaacgggaaccggaaccgggacccggtaacggttaagtttaaaccgttaggttggttaggaaggaacggaacgaacgtaaggaaggaaaccccccgggttaaggaaacggttaaaccggggtaacgggggttaagggttaaggg

SEQ ID NO: 369392 - DNA, 609 bp, Homo sapiens
  misc_feature: GZ8MTXP01DZ5PY.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggggggagcctggtccaggccggggggtccctgagctctctgtcgccgctctggactctacctttagagctattggatgagcgtcgggtccgccaggcctccggaggggaagggctgggaggtgggtgaccaaagaagtaaaggagagtaggaagtacaagaaactactaaagtgtcggactcgtaggtaggaaacggggccgtattccaaccctattccaccgaagacgaacaaaccgtaccaaagtacttcgagttgtaatctaggaactaaatcgaacagccctaggacggaacgcccggaaggaccgacgggtccgttaagttacttagtggttgacggagaagcagtaaccgaagtaacgggtgaacgttaacgggggtgggttgtaagg

SEQ ID NO: 369393 - DNA, 741 bp, Homo sapiens
  misc_feature: GZ8MTXP01BKQQK.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccaggccgggggggtccctgagactctcctgtgcccgcctctggactcacctttagagctattggatgagcgtgggtccgccgaggcctccgagggggaaggggctgggaggtggggtggaccaaacgaagtaaaaggaagatagggaagtacaagaaacactaaatgtggactcgtggtaggaaacggggcccgtaattccaaccctattccctacccgaaaggaacgaaacccgaaaccgacccgaaaaaggtaactttccgaaaggttcggttaaatcccgttaggggaacctaaaaaagttcggaaaacccgaggaccccgttagggaacggaaacgggtccccggaaaggggaaccccgtaacccgggggtcccgttaaggtttaaaccgttttaacggtgggttaggtaagggaagttaaaccgggacttaaggtaacgggaaacccgtaaacgggggttggaaaaccggttaaacccggggggtaaggggggttttaacgtaagggg

SEQ ID NO: 369394 - DNA, 656 bp, Homo sapiens
  misc_feature: GZ8MTXP01ALV3A.15.23.C01.1.454.CMB.2.raw
  modified_base (307)..(307): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggagcctggtccaggccggggggtccctgagctctctgtgccgcctctggactcacctttagagctagttggatggagcgtgggtcccncgaggctccggaggggaggggctgggaggtgggtggaccaaacgaagtaaaaggaagagtagggaaagtcaaaggaaacacgttaaagtcgggtggactcgtggtaggaaacgggggcctattccaacctatcctaccgaagaacgaacaaacggtacaaagtacttcgagttgtacttcgtaggaacaaattacgaaacgtacgccgtaggaacggacggccccggaagggtaaccgacggggtcccggtttgtaacgtttacgtggttggtaaggaagaacgacgttagtaaggaaacccgtaaggggttacggaacggttaacgggggtgggggtttaagtaaggg

SEQ ID NO: 369395 - DNA, 730 bp, Homo sapiens
  misc_feature: GZ8MTXP01AEAMZ.15.23.C01.1.454.CMB.2.raw
  modified_base (317)..(317): a, c, t, g, unknown or other
  modified_base (644)..(644): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggagcctgggtccgaggccggggggtccctgagactctcctgtcgcccgcccgtggacctctacctttagtagctagtggatgacgcgtcgggtcccnccgaggcctccggaagggggaacgggggctagggggagggtggggtacggacccaaacgaagtaaaagggaagagtagggaaatcaaagaaacacgtagtagggtacgggaaccttcgtagggtagggaacgggccgtattaccaacccgattcccaccgaaggaacgaaccaaaccgaccaaagtaacttcgaagttgtaactcgtagaactaaagtcgaaaccacggtcccgtggaaacgacggacccgggaaggtaacccgacccggggtccgtttaaggttaaacgtttcgttgggttaggttacgaaagggtacgaaaccgnggttaaccggaaaacccggtaacggggtaagtaaaaccgggttaaacccggggggttagggggttttaacgaagggttttccgggg

SEQ ID NO: 369396 - DNA, 605 bp, Homo sapiens
  misc_feature: GZ8MTXP01BF4OS.15.23.C01.1.454.CMB.2.raw
  modified_base (307)..(307): a, c, t, g, unknown or other
  modified_base (425)..(425): a, c, t, g, unknown or other
  modified_base (456)..(456): a, c, t, g, unknown or other
  modified_base (560)..(560): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttctgttgctattttagaaggtgtccagtgcgaggagcagctggtggagtcgtgggggaggcctgggtccaggccgggggggtccctgagactctcctgtgccgcctctggactcacctttagagctattggatgagcgtgggtccncaggctccgaggggaggggctgggaggtgggtggaccaaagaagtaaaaggaagatagggaaatcgaaagaaacactaaagtgtggactcgtggtggaaggggccattccaccatccncagagaccaacgtacaaagtaattcaagttntatcgagaactaaagtcgaaacgcgtaccgtaggaacggaacggaccggaacgggaacccgtaccggggtcgttaagttaacgttagtggttgacggagacganagtaagacgaacggtaggtacggttacgggtaaggggttggtaag

SEQ ID NO: 369397 - DNA, 562 bp, Homo sapiens
  misc_feature: GZ8MTXP01DLKOW.15.23.C01.1.454.CMB.2.raw
  modified_base (255)..(255): a, c, t, g, unknown or other
  modified_base (304)..(304): a, c, t, g, unknown or other
  modified_base (346)..(346): a, c, t, g, unknown or other
  modified_base (525)..(525): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggttttctgtagctatttagaaggtgtccagtgcgaggagcagctgggtggagtcgtggggggagcctggtccaggcccggggggtccctgagctctccngtcgcccgctctggactcactttagagctattggatgagctgggtcccnccaggctccgaggggaagggctgggagtgggtcggaccaaanagtaaaaggagagtaggaaagtacaagaaaacacgtaatgtggactcgtgtaggaaagggccaattccactatcctccgaagacgaacaaacgccaaagaattcaagttgtaatcgtagactaaataagaacgacgcgagagacgacgacgacgacgcgtgtattatgttgtgagaganagaagagaacggagaggttaacgggtaagggttggtg

SEQ ID NO: 369398 - DNA, 712 bp, Homo sapiens
  misc_feature: GZ8MTXP01BS4BZ.15.23.C01.1.454.CMB.2.raw
  modified_base (279)..(279): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttcgtgtagctattttagaaggtgtcagtgcgaggagcagctggtggagtcgtggggggagcctggtccaggccggggggtccctgagctctcctgtgcccgctctggactcactttaganctattggatgagcgtgggtccgccgacggcgtccgaggggaagggggcggtgggtaggtgggtcggaccgaaacgaaagtaaaggaaaggaagtaacggtaagtacgaaacgaaacaactaagtaggtcggtacgtcgtacggtaggtaacgggtaccgtactacctacctactacctaccgaacgaacgaaaccgaaaccgaaccgtaaacgtaaacgttacgtaacgtacgttacgttacgtacggtaactaaacgtaacgaaacgaacgtaccgtacggaacggaaccggaaccggtaacggaaccggaccggtaccggttaacgttaacgttacgttaggttaggtaggtaaggaacgaacgttacgtaacggtaacggtaacggtaacgggtaacgggttaacggggttaacggggttaagggtaagg

SEQ ID NO: 369399 - DNA, 560 bp, Homo sapiens
  misc_feature: GZ8MTXP01A211N.15.23.C01.1.454.CMB.2.raw
  modified_base (496)..(496): a, c, t, g, unknown or other
  modified_base (539)..(539): a, c, t, g, unknown or other
  modified_base (551)..(551): a, c, t, g, unknown or other
  modified_base (557)..(557): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggggggaggcctgggtccgaggccgggggggtccctgagactctcctgtcgccgcctctggactcacctttagagctattggatgagctgggtccgccaggctccgaggggagggctgggagtgggtggccaaagagtaaaaggagagtgggaagtcaagaaacactaagtcggtggactcgtggtaggaacggggtcccgatttccacccatcctaccagagacaacgccaaagaattcagtgtatctggacaaatgaacagcctagagacgccgaggacncggccgtgtaattacgtgttgtgagagcatgaaccgaagggtnagttaaccgggngggttnaag

SEQ ID NO: 369400 - DNA, 572 bp, Homo sapiens
  misc_feature: GZ8MTXP01AV90Z.15.23.C01.1.454.CMB.2.raw
  modified_base (283)..(283): a, c, t, g, unknown or other
  modified_base (469)..(469): a, c, t, g, unknown or other
  modified_base (501)..(501): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttcctgttgctattttagaaggtgtccagtgcgaggagcagctggtggagtcgtgggggaggcctgggtccaggccgggggggtccctgagactctcctgtgccgcctctggactcactttagngctattggatgagctgggtcccgcaggctccgagggggaaggggctgggagtgggtggccaaagaagtaaaggaagagtagggaatcaagaaaacactaaatggtggactcgtgtagaagggcccgattcaccatcaccagagacaacgcaaagaattcagtgtatctagggacaaaatcgaaacngcctgaacgagcccgaggtaccacgggccgtntaattacgtggttgtgaaggagacagtggaactaaccgggtgaacgttaaccggggtaaggggttgtaagg

SEQ ID NO: 369401 - DNA, 585 bp, Homo sapiens
  misc_feature: GZ8MTXP01DPKL7.15.23.C01.1.454.CMB.2.raw
  modified_base (308)..(308): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggggggaggcctggtccaggccggggggtccctgagactctcctgtcgccgcctctggactcacctttagagctattggatgagctgggtcccncaggctccgaggggaagggctggagtgggtggaccaaagataaaaggaagatggaaagtcaagaaaacactaaatgtggactcgtggtggaaaggggcccgaattccacccagtcctccgaagacgaacaaaccggtccaaagtaattcagtgtaatcctagggactaaaagtcgaaacgagcctgaagacgcccggaaggacaccgggtccgtaagtaacttacgtgttgtagagaggcagtgaacgaacggtgaagttacgggaaggggttgaag

SEQ ID NO: 369402 - DNA, 580 bp, Homo sapiens
  misc_feature: GZ8MTXP01DJYIJ.15.23.C01.1.454.CMB.2.raw
  modified_base (306)..(306): a, c, t, g, unknown or other
  modified_base (347)..(347): a, c, t, g, unknown or other
  modified_base (435)..(435): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccaggccgggggggtccctgagactctcctgtgccgcctctggactcacctttagagctattggatgagctgggtcccnccaggctccgaggggaagggctgggagtggggtggccaaanataaaagggagatggaaagtcaaggaaaacacgtaaatgtgggactcgtaggtaggaacggggcccattcccaccatccgaccaaganaacaacgtccaaagattcagtgtatctaggacaaatgaaacagtcctggaagacgcccgaagggactacgggccgtgttaacttcgtggttgtagaagaccgacagaagacgaacggtagaggttaacgggtaagggttggtaag

SEQ ID NO: 369403 - DNA, 757 bp, Homo sapiens
  misc_feature: GZ8MTXP01AG8OQ.15.23.C01.1.454.CMB.2.raw
  modified_base (309)..(309): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctgggtggagtcgtgggggagcctggtccaggccggggggtccctgagctctcctgtcgccgcctctggactcacctttagagctattggatggagcgtggggtcccncgaggcctccgagggggaaggggctgggaggtggggtggaccaaacgaagtaaaagggaagaagtagggaaagtcgaaaggaaaacacttaaagtgggtcgggaaccttcgtaggtacgggaaacgggggtcccgtaatttcccaaccctacttcccgtacccgaaggaacgaaccaaacccggaccaaaagggtaaacttttccaaaggtttggtaaacttcgttacggggaactaaaaagttcgaaaaccgacggtccccgtagggaacggaacgggaccccggtaaaggggaaccccgaaccggggtcccgttaaggtttaaagttttaaccggttggttgggttaacggaagggaaggttaaccttaggttaacgggaaaccggtaaacccggggttaggtaaacggggttaaacccgggggttaaggggggtttcggtaaggg

SEQ ID NO: 369404 - DNA, 660 bp, Homo sapiens
  misc_feature: GZ8MTXP01EI1OH.15.23.C01.1.454.CMB.2.raw
tcagtctacgtagccacgaccggtgctcgatttagtacacgtgattagggattgggaggtctcagagaggagccttagccctggactccaaggccctttccacttggtgatcagcactgagcacagaggactcaccatggagttggggctgagcttgggttttccttgttgcttattttagaaggtgtccagtgcgaggagcagctggtggagtcgtgggggagcctggtccagggccggggggtccctgagactctccgtgtcgcccgcctcgtggactctacctttagagcttagttggatgagtcgtcgggtcccgccgaggcctaccggaagggggaacgggggtcgtaggggaggttgggggtacggacccaaagtaagtaaaagggaagagtaggaaagtacaaagaaacacttaaagtgtggtacttcgtaggtaggaacggggccgtattccacctatccaccaagacgaactaacgaccaaagtacttcagttatatctaggaactaaaagtcgaaacagtcccgtaggaacgaacggacccggaaggtaaccgccgggccgttaagttaacctttaggtgttagtagaagagacttagtaacgaacgtaaacgggtgtaaacggttaaccggggtggggttaagtaaggg

SEQ ID NO: 369405 - DNA, 618 bp, Homo sapiens
  misc_feature: GZ8MTXP01DR5KC.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggagccgtgggtccagggcccggggggtccctgagactctcctgtcgcccgcctctggactctacctttagagctattggatgagcgtgggtccgccaggctccgagggggaagggctgggagtgggtgaccaaagaataaaggagagtaggaagtacaagaaacacgtaaatgtggactcgtaggtaggaacggggcctattccaacctatcctaccgaagacgaaccaaacgccaaagtaacttcaaagttgtaatcgtagggaactaaagtgaaacacggtcctaggaaggaacgccggaaggaccaacgggtccttaagtaatttacgtggttagtagaggttaagcttaagtgaaaccgtaacgggtgaacgttaaacggggtggggttgtaagg

SEQ ID NO: 369406 - DNA, 569 bp, Homo sapiens
  misc_feature: GZ8MTXP01CCE58.15.23.C01.1.454.CMB.2.raw
  modified_base (349)..(349): a, c, t, g, unknown or other
  modified_base (509)..(509): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggcccgggggggtccctggagactctcctgtcgcccgcctctggactcacctttagagctattggatgagcgtgggtccgccaggctccgaggggagggctggagtgggtgccaaanagtaaaggagataggaagtcaagaaacactaaatgtggactcgtggtgaaggggccattcacctatccacagacacaacgccaaagattcagtgtatctaggacaaatcgaaacagcctaggagacggccgaggtaccgacgggtccgtaagtacttacnggttgtagagaacgcagtcggaacgtaagggtgaacgttaaccggggtggggtttgaagg

SEQ ID NO: 369407 - DNA, 545 bp, Homo sapiens
  misc_feature: GZ8MTXP01DL2GC.15.23.C01.1.454.CMB.2.raw
  modified_base (300)..(300): a, c, t, g, unknown or other
  modified_base (339)..(339): a, c, t, g, unknown or other
  modified_base (515)..(515): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttctgtgctatttagaaggtgtcagtgcgaggagcagctgggtggagtcgtggggggagcctggtccaggccgggggggtccctgagactctcctgtgccgcctctggactcacctttagagctattggatgagctgggccncaggctccgaggggaagggctggagtgggtggaccaaanagtaaaaggaagatacggaagtcaagaaaacactaaatgtggactcgtaggtagaaggggccattcaaccatccaccagacgacaaacgtccaaagaattcaagtgtaatctaggaacaatagaacgacgcgagagacgacgacgacgacggcgtgtagttagtgttgtgagaganataagagaacgagagacggtaagggttgtg

SEQ ID NO: 369408 - DNA, 608 bp, Homo sapiens
  misc_feature: GZ8MTXP01EO173.15.23.C01.1.454.CMB.2.raw
  modified_base (321)..(321): a, c, t, g, unknown or other
  modified_base (500)..(500): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagtcgttgggttttccttgttgcttattttagaaggtgtccagtgcgaggagcagcgtggtggaggtcgtgggggaggccgttgggtccgacgggccggggggtccctggagctctcctgtcgcccgcctgtggactctacctttagagctattggatgagcgtgggtcccnccaggcctccgaggggaaggggctggggagtggggtgaccaaagaagtaaaaggagataggaagtacaagaaacactaaagtgtggactcgtggtaggaacgggccgattccactatcctaccagacgaacaaacgaccaaagtacttcgaagtgttaatctaggacaaagtcgaaacngcctggaacgacgaccggaggtaccgaccgggtcgttaagtacttagtggttgagaagagacagtaaggaacgtaagggtgaacggttaaccggggtgggtttgaagg

SEQ ID NO: 369409 - DNA, 580 bp, Homo sapiens
  misc_feature: GZ8MTXP01CTJ3P.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtgggtccaggccgggggggtccctgagactctcctgtcgccgcctctggactcacctttagagctattggatggagctgggtccgccaggctccgagggggaaggggctgggaggtggggtggccaaagagtaaaaggagatagggaatcaagaaaacactaaatgtggactcgtggtagaacggggccattccacccatcctaccagacgaacaacgccaaagattcagtcgtatctaggactaaaatgaaacagcctaggacgaacggcccgaagggaccacgggtcctggtaacttacgtgttgtaggagagcagtgaacgaagggtgagttaccgggtaaggggttgaagg

SEQ ID NO: 369410 - DNA, 554 bp, Homo sapiens
  misc_feature: GZ8MTXP01D1X54.15.23.C01.1.454.CMB.2.raw
  modified_base (452)..(452): a, c, t, g, unknown or other
  modified_base (471)..(471): a, c, t, g, unknown or other
  modified_base (544)..(544): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgcccgcctcgtggactcacctttagagctattggatgagctgggtcccgccaggctccgagggggaaggggctgggagtggggtggaccaaagagtaaaggaagagtggaagtacaagaaacactaaatgtggactcgtggtagaaggggccgattcaccatcctcaagagaacaacgtcaaagtaatcagtntatctaggacaaatgaacngcctagagacgcgaggacacggcgtgtattacgtgttgtagagagcagtgaccgaaggtgacgttaaccgggnggggttgaag

SEQ ID NO: 369411 - DNA, 700 bp, Homo sapiens
  misc_feature: GZ8MTXP01DND6L.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctgggtggagtcgtggggggaggcctgggtccaggcccgggggggtccctgagctctcctgtgcccgcctctggactcacctttagagctattggatgagctgggtcccgcaggctccgagggggaaggggctgggaggtgggggtcggaccaaagaagtaaaagggaagagtagggaaagtacaaagaaaacactaaatggtgggacctcgtaggtaggaaacggggccctattccgaaccctattcctaccgaagaacgaacaaaccggtaccaaaagtaactttccgaagttgtaattcgtagggaactaaaaagttcggaaaaccacggcccttaggaaacggaacggaccccggaaagggtaacccgaaccggggtccggttaagttaacgtttaccgtgggttaggtacggaagaacggacaagtaacgggaaaaccgtaacgggggttaaggaacggtttaaaacccggggggtaagggggtttcgtaaggg

SEQ ID NO: 369412 - DNA, 578 bp, Homo sapiens
  misc_feature: GZ8MTXP01B0ACH.15.23.C01.1.454.CMB.2.raw
  modified_base (315)..(315): a, c, t, g, unknown or other
  modified_base (478)..(478): a, c, t, g, unknown or other
  modified_base (491)..(491): a, c, t, g, unknown or other
  modified_base (495)..(495): a, c, t, g, unknown or other
  modified_base (498)..(498): a, c, t, g, unknown or other
  modified_base (514)..(514): a, c, t, g, unknown or other
  modified_base (532)..(532): a, c, t, g, unknown or other
  modified_base (538)..(538): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgttgggttttccttgttgcttattttagaaggtgtccagtgcgaggagcagcgtggtggagtcgtggggggagccgtgggtccgagggccggggggtccctgagactctcctgtcgccgcctctggactcacctttagagctattgatgagcgtgggtcccncaggcctccgaggggaggggctgggagtgggtgaccaaagaagtaaaaggagataggaaagtcaagaaaacacgtaaatggtcggaactcgtgggtacggaaacggggcccgtaattcccaacctatcctaccgagaacgacaaacgaccaaagaattcagtntatctgacaaatnaacngcngagacgccgagtaccncggctaagtacttagtgngtaganagcagtgacgaaggtgacgttaacgggtggggttaagaag

SEQ ID NO: 369413 - DNA, 552 bp, Homo sapiens
  misc_feature: GZ8MTXP01AYBQE.15.23.C01.1.454.CMB.2.raw
  modified_base (307)..(307): a, c, t, g, unknown or other
  modified_base (425)..(425): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagagctattggatgagctgggtcccnccaggctccgaggggaggggctgggagtgggtggccaaacagtaaaagggaagatacgggaaagtcaaggaaacactaaatgtggactcgtggtgaaaggggccgaattccaccatcnccagagacaacgccaaagaattcagtgtatctggacaaatgaacagcctgagagccgaggaccacgggccgtgtaattactgttgtgagagacatgacgaacggtgagttaccgggaagggttgaag

SEQ ID NO: 369414 - DNA, 550 bp, Homo sapiens
  misc_feature: GZ8MTXP01C6CSV.15.23.C01.1.454.CMB.2.raw
  modified_base (343)..(343): a, c, t, g, unknown or other
  modified_base (352)..(352): a, c, t, g, unknown or other
  modified_base (368)..(368): a, c, t, g, unknown or other
  modified_base (374)..(374): a, c, t, g, unknown or other
  modified_base (400)..(400): a, c, t, g, unknown or other
  modified_base (496)..(496): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggggggaggcctggtccaggccgggggggtccctgagactctcctgtgccgcctctggactcacctttagagctatggatgagctgggtcccgcaggctccgaggggagggctgggagtgggtgccaanataaagganatggaagtcagaaacnctaaangtggactctgtgaagggccatcaccntctccagagacaacgccaaagaattcaagtgtatctagggacaaaagtgaaacagtccctgagacgccggaaggaccacgggcctgtaattcgtgngtgagagacagtgaacgtaacgggtgaacgttaaccggggtaaggggttgtaag

SEQ ID NO: 369415 - DNA, 613 bp, Homo sapiens
  misc_feature: GZ8MTXP01EUNK6.15.23.C01.1.454.CMB.2.raw
  modified_base (311)..(311): a, c, t, g, unknown or other
  modified_base (507)..(507): a, c, t, g, unknown or other
  modified_base (535)..(535): a, c, t, g, unknown or other
  modified_base (561)..(561): a, c, t, g, unknown or other
  modified_base (586)..(586): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctgggtccgaggccggggggtccctggagactctcctgtcgcccgcctctggactctacctttagagctattggatgagcgtgggtccnccgaggctccgagggggaggggctgggaggtggggtcgaccaaacgaagtaaaaggaagagtaggaagtacaaagaaacactaagtgtggactcgtaggtaggaacggggccgtattccaaccctatcctaccaagacgaaccaaaccgaccaaaggtaattcgagttgtaactctaggaactaaaagtcgaaacngccctagaacgacggcccgaagggaccnccgggccgtgttacttacgtggttgngaagagacagtggactaacggggtnaacggttaaccggggtgggtttgaagg

SEQ ID NO: 369416 - DNA, 593 bp, Homo sapiens
  misc_feature: GZ8MTXP01ELUXW.15.23.C01.1.454.CMB.2.raw
  modified_base (307)..(307): a, c, t, g, unknown or other
  modified_base (347)..(347): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccaggccggggggtccctgagactctcctgtcgcccgcctctggactctacctttagagctattggatgagctgggtccncaggctccgaggggaagggctgggagtgggtggaccaaanagtaaaaggaagagtaggaaagtcaaagaaaacactaaatggtgggactcgtggtaggaaacggggcccgaattccaaccctaatcctaccgaagaacgaacaaaccgaccaaaagtaacttcaagttgtaatctagggacaaaagtgaaacagccctggaagacgccgtaaggaccacggcgttaatattacgtgttgagagagcagtgaacgaacgggtgaagttaaccgggtggggttgaagg

SEQ ID NO: 369417 - DNA, 560 bp, Homo sapiens
  misc_feature: GZ8MTXP01EEFEC.15.23.C01.1.454.CMB.2.raw
  modified_base (268)..(268): a, c, t, g, unknown or other
  modified_base (378)..(378): a, c, t, g, unknown or other
  modified_base (451)..(451): a, c, t, g, unknown or other
  modified_base (472)..(472): a, c, t, g, unknown or other
  modified_base (509)..(509): a, c, t, g, unknown or other
  modified_base (514)..(514): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtcgccgcctntggactcacctttagagctattggatgagctgggtccgccaggcctccgaggggaagggctgggagtgggtggaccaaagagtaaaaggaagatggaaagtcaagaaacnctaaatgtggactcgtggtgaaagggccgaattccaccatctaccagacgaacaaacgccaaagaattcagtntaagtctggacaaatgaaacngcctgagagccgaaggacacgggcctaagtattacgngttgngaagagcagtcgaacgtaacggtgaagttaacggggtgggttgaag

SEQ ID NO: 369418 - DNA, 654 bp, Homo sapiens
  misc_feature: GZ8MTXP01D33DL.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccgaggccggggggtccctgagctctcctgtgcccgcctctggactcacctttagagctattggatgagcgtgggtcccgccgaggctccgagggggaaggggctgggaggtggggtcggaccaaacgaagtaaaaggaagagtaggaaagtacaagaaacactaaagtggtggactcgtaggtaggaacggggccgtattccaccctattccctaccgaaggaacgaaacccaaaaccggaccctaaaaggtaactttacgaaggttagtaacttccgttagggaacctaaaagttacggaaactacgcccgtaggaacggaacggcccggagggaaccaccggggtccgttaagtacgtttacgtgttggtagaagacgacagtgaaccgaagggttgaacggttaaccggggtgggttgtaagg

SEQ ID NO: 369419 - DNA, 544 bp, Homo sapiens
  misc_feature: GZ8MTXP01BXHZ7.15.23.C01.1.454.CMB.2.raw
  modified_base (307)..(307): a, c, t, g, unknown or other
  modified_base (371)..(371): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctgggtccaggccgggggggtccctgagactctcctgtgcccgcctctggactcacctttagagctattggatgagctgggtccnccaggctccgagggagggctggagtgggtggccaacataaaggaagataggaagtcaagaaacnctaatgtggactctaggtgaagggccattccaccatctccagagacaaacgccaaagattcagtgtatctggacaaagtgaaacagcctgagagccgaggacacggccgtgtattacgtgttgtgacgagacagtgacgtaacggtgagttaaccggggaaggggtttgaagg

SEQ ID NO: 369420 - DNA, 656 bp, Homo sapiens
  misc_feature: GZ8MTXP01AXF13.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttcctgttgctattttagaggtgtccagtgcgaggagcagctggtggagtcgtgggggaggcctggtccgaggccgggggggtccctgagactctcctgtgcccgcctctggactcacctttagagctagttggatgagcgtgggtcccgccgaggcctccggagggggaagggggctgggaggtgggggtaggccaaacgaagtaaaagggaagagtacgggaagtacaagaaacactaatggtggaccttcgtaggtaggaaacggggccctaattcccaccctatccctaccgaagaacgaaccgaaaccgacccaaagaactttacagttagtatcgtaggactaaagtgaaacacgaccgtagaaggaacgcccggaaggaccgaccggggtcccgtggttaactttacgtggttaggtaggagaacggacttagtaacggaacgtaacgggttagaaacgggttaacccggggtaagggggtttcgtaaggg

SEQ ID NO: 369421 - DNA, 729 bp, Homo sapiens
  misc_feature: GZ8MTXP01CMDDP.15.23.C01.1.454.CMB.2.raw
  modified_base (350)..(350): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggaggcctggtccaggccggggggtccctgagactctcctgtcgccgcctctggactcacctttagagctattggatgagcgtgggtccgccaggctccgagggggagggctgggagtggggtgaccaaanagtaaaggagataggaagtcaagaaacactaaatggtggactcgtggtggaaaggggcccgtaattcccaaccctattccctacccgaaggaacgaacccaaaccggacccaaaaggtaactttaccgaagttagttaacttccgttaggggaacctaaaaagttcggaaaaccgtaacgccccgttagggaacgaccggggacccggtaaagggaccccgtaaacccgggggtcccggttaaggtttaaacgtttaccggttggttagggttaaaggaacgttaagggaaccaaagggttaacggaaaacccggtaaaccgggggttagggtaaacggttaaaaccccggggggttaagggggttttaacggtaaggg

SEQ ID NO: 369422 - DNA, 577 bp, Homo sapiens
  misc_feature: GZ8MTXP01B71CR.15.23.C01.1.454.CMB.2.raw
  modified_base (429)..(429): a, c, t, g, unknown or other
  modified_base (506)..(506): a, c, t, g, unknown or other
  modified_base (527)..(527): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgctattttagaggtgtccagtgcgaggagcagctggtggagtcgtgggggagcctggtccaggccggggggtccctgagactctcctgtgcccgcctctggactctacctttagagctattggatgagcgtgggtccgccaggcctccgagggggaaggggctgggagtgggtggaccaaacgaagtaaaaggaagagtagggaaagtacgaagaaacactaatggtggactcgtggtaggaacgggccgacttcaccatcnccaagagaacaaacgcaaagtaattcgagtgtaatctaggactaaatgaaacgagcctagagacggccgaaggaccncgggccgttaagtacttacgnggttgagagagacagtgaacgaacggtgaagttaaccgggtgggttgaag

SEQ ID NO: 369423 - DNA, 573 bp, Homo sapiens
  misc_feature: GZ8MTXP01DPWUQ.15.23.C01.1.454.CMB.2.raw
  modified_base (308)..(308): a, c, t, g, unknown or other
  modified_base (486)..(486): a, c, t, g, unknown or other
  modified_base (563)..(563): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagagctattggatgagcgtgggtcccnccaggctccgagggggaagggctgggagtggggtgaccaaagaagtaaaaggagataggaaagtacaagaaaacactaaatgtggactcgtggtaggaaacggggcccattccaaccattccaccaagacgaacaaacgccaaagaacttcaagtgtatctaggacaaaagtgaaacngcctgaacgagccgaggacacgggcgtaagtattacgtgttgtagagagacagtgaacaacggtgaagttaacgggngggtttgaag

SEQ ID NO: 369424 - DNA, 611 bp, Homo sapiens
  misc_feature: GZ8MTXP01BC7CX.15.23.C01.1.454.CMB.2.raw
  modified_base (461)..(461): a, c, t, g, unknown or other
  modified_base (485)..(485): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccaggccggggggtccctgagctctcctgtgccgcctctggactctacctttagagctattggatgagcgtgggtcccgcaggctccgagggggagggctgggaggtggggtgaccaaagagtaaaaggagagtcgggaaatcaagaaaacacgtaatggtggaactcgtaggtaggaacggggcattccacccattcaccagacgaactaacgaccaaagaacttcgaagttntactcaggaactaaagtcgaaacncgccgtaggaacggaccggccggtaaggaccgaccgggtcgttaagttacttacgtggttagtaggaagacgacagtaacggaacggtaacgggtagaacgggttaacggggtaaggggttgtaag

SEQ ID NO: 369425 - DNA, 582 bp, Homo sapiens
  misc_feature: GZ8MTXP01EPDYT.15.23.C01.1.454.CMB.2.raw
  modified_base (465)..(465): a, c, t, g, unknown or other
  modified_base (530)..(530): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagcgtggtggagtcgtgggggagcctggtccgaggccggggggtccctgagactctcctgtcgccgcctctggactctacctttagagctattggatgagcgtgggtcccgcaggctccgagggagggctggagtgggtgaccaaagagtaaaggagagtaggaagtacaagaaacactaaatggtggactcgtggtagaaacggggccgtaattccaacccatcctaccgaagaacgaaccaaacgccaaagtaacttcagttntaatctaggaactaaagtagaacagcctagagacgccgtaggaccacgggcgttaagtaattcgngttgagagagttacagtgaacgaagggtgagttaacgggtaaggggttgaag

SEQ ID NO: 369426 - DNA, 561 bp, Homo sapiens
  misc_feature: GZ8MTXP01AXO50.15.23.C01.1.454.CMB.2.raw
  modified_base (355)..(355): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggagcctggtccgaggccggggggtccctgagactctcctgtcgcccgcctctggactcacctttagagctattggatgagcgtgggtcccgccaggcctccgagggggaaggggctgggaggtgggtggaccaaanagtaaaaggagatagggaagtcaagaaacactaaatgtggactcgtgtagaaggggccattccaccatcctcagacgacaacgccaaagattcagtgtatctggacaaatgaacagcctagacgacgcgagacacggcgtgtattcgtgttgtagaagagacagtaagacgaacgggtgaacggttaaccgggtggggtttgaagg

SEQ ID NO: 369427 - DNA, 712 bp, Homo sapiens
  misc_feature: GZ8MTXP01BKLML.15.23.C01.1.454.CMB.2.raw
  modified_base (331)..(331): a, c, t, g, unknown or other
  modified_base (649)..(649): a, c, t, g, unknown or other
  modified_base (660)..(660): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagtcttgggttttccttgttgctattttagaaggtgtccagtgcgaggagcagcgtggtggagtcggtgggggagccgtggtccgacgggcccggggggtccctggacgtactctccgtgtcgcccgcctcgtcggactctacctttagagtcttagttggatggacgtcgtcgggtcccnccgaggccgtaccggaagggggaacggggtcgtaggggtaggtcgggggtacgaccgaaagtaagtaaagggaagtagtaggaacgtacaaagaaacctacgtaagtgtcggtactcggtaggtaggaacggggtacctagttacccaacccattacccaccggaaagaccgaaccgaaaccgtaccaaaaggttacttcgaaaggttcgttaactaccgtaggggaaacctaaaaggttccgaaaaccgtcggacccgtaaggacggaccggaccccggttaaggacccggtcgggtccgtaagttaaactttcggnggttagaaganacgacttagtaacgaacggtaaggtaggtaacgggttacggggtgttgtaag

SEQ ID NO: 369428 - DNA, 807 bp, Homo sapiens
  misc_feature: GZ8MTXP01CJDRQ.15.23.C01.1.454.CMB.2.raw
  modified_base (338)..(338): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccgaggccggggggtccctgagactctcctgtgcccgcctctggactcacctttagagctattggatgagcgtgggtcccgcaggctccgaggggagggctgggagtgggngccaagagtaaaggagagtaggaagtacaagaaacactaatgtggactcgtggtaggaacggggtcctaagttccaacccattcccctaccgaaaggaacgaaacccaaaacccgggacccctaaaagggtaaactttaccgaaggtttaggtaactttacccgttaagggggaaacctaaaaaaggttaccggaaaaaccgtacggaccccgttaaggggaaacggtaaacccggggaccccggggtaaaaccgggggacccgtaaaaccccggggggtccccggtttaacgggttttaaaggttttaaaccccggttgggggtttacgggttaaggggtaaacgggttaaagggaaacccttaaacggttaacggggaaaaaccccggttaaacggggggttaaggtaaaaccgggggttaaaaccccggggggggttaaggggggttttaacggttaaaacggggg

SEQ ID NO: 369429 - DNA, 658 bp, Homo sapiens
  misc_feature: GZ8MTXP01C36YQ.15.23.C01.1.454.CMB.2.raw
  modified_base (353)..(353): a, c, t, g, unknown or other
  modified_base (393)..(393): a, c, t, g, unknown or other
  modified_base (441)..(441): a, c, t, g, unknown or other
  modified_base (480)..(480): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttcgtgtagctatttagaaggtgtccagtgcgaggagcagctgggtggagtcgtggggggagcctgggtccaggccggggggtccctgagactctcctgtcgcccgcctctggactctacctttagagctattggatgagcgtgggtccgccaggctccggagggggaagggctgggaggtggggtcgaccaaanaagtaaaaggagtacgtacggaaacgtacaaggtaaaacnctaaagtgtcgggactcgtaggtaggaacgggcctatccacctatccncaagacgaccaaagccaaagtaacttcgaagttcgtaancgttagggaaactaaagtcgaaaccgcgtaccgaggacggacgaccggaacggtaccgcggtccgtaagttacgttacggttggttacggtaagtaaggaacgttacgttaacggtaacggaaaccggtaacgggtaaggtaacccggggttaaacgggggttgggttaacggtaagg

SEQ ID NO: 369430 - DNA, 718 bp, Homo sapiens
  misc_feature: GZ8MTXP01B7BNY.15.23.C01.1.454.CMB.2.raw
  modified_base (490)..(490): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgctattttagaaggtgtccagtgcgaggagcagctggtggagtcgtgggggaggcctggtccgaggccggggggtccctgagactctcctgtcgcccgcctcgtggactcacctttagagctattggatggagcgtgggtcccgccaggcctccggagggggaacgggggctgggaggtgggggtcgaccaaacgaagtaaaaggagagtaggaaagtacaaagaaaccacgttaaatggtggaactcgtaggtaggaacgggccgtattaccgaccagtcctaccgaagacgaacctaacggaccaaagtaacttcgaagtntaactcgtaggaactaaaagtcggaaaacacggtccctaagggaacggaaccggacccggaaacggggtaacccgtaacccgggggtccgtttaaggttacgttttaaccggtagggttggtaaagggaaagaaccggttaacgttaaggttaacgggaaacccggtaaaacggggttaggggtaaaacgggttaacccggggggttaagggggtttaacgtaagggg

SEQ ID NO: 369431 - DNA, 646 bp, Homo sapiens
  misc_feature: GZ8MTXP01ACTEJ.15.23.C01.1.454.CMB.2.raw
  modified_base (316)..(316): a, c, t, g, unknown or other
  modified_base (353)..(353): a, c, t, g, unknown or other
  modified_base (381)..(381): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggagccgtgggtccgagggcccggggggtccctggacgactctcctgtcgcccgcctctggactcacctttagagctattggatgagcgtgggtccncaggctccgaggggagggctggagtgggtcgaccaanagtaaaggagataggaagtcaagaaacnctaaagtggtcggactcgtggtacggaacggggccctattcccaaccctatccctacccgaagaacgtaaccaaaccggccaaaaggtaactttccgaagttgtaacttccgtaggggaacaaaagttcgaaacgtagcccgtaggaacggacgacccggaaggtaccgaaccgggtccgtaagtaactttacgtggttgtagagacgacgagtcgaaaccgtaacgggtagaacgggttaaccggggtaaggggtttgtaaggg

SEQ ID NO: 369432 - DNA, 760 bp, Homo sapiens
  misc_feature: GZ8MTXP01CVNC6.15.23.C01.1.454.CMB.2.raw
  modified_base (295)..(295): a, c, t, g, unknown or other
  modified_base (524)..(524): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggaggccgtgggtccgagggcccggggggtccctggagactcctcctgtcgccgcctcgtcggactctacctttagngctattggatgagtcgtgggtcccgccgagggcctaccggagggggaacgggggcgtgggggaggttgggggtcggaccgaaagaaagtaaaagggaagagtaggaaagtacaagaaaacctactaagtggtcggacttcgtagggtaggaacggggcctaagttcccaaccctatccgtaaccaaggaccaaacccgaacgacccgtaaaagtaactttcgaaggttntaaactcccgtagggaaacctaaaaggtacgaaactacggtacccgtaaggacggaaaccggccgggaaaccgggtaacccgtacggggtccccggtttaaggttaaacccgtttggtggttagggttaaacgggaggaaaacgttaccgttaaaggttaacggaaaccccggtaaagggggttacggtaaaaaccgggtttaaaccggggggtaagggggtttaacttaacgggg

SEQ ID NO: 369433 - DNA, 626 bp, Homo sapiens
  misc_feature: GZ8MTXP01CLMU4.15.23.C01.1.454.CMB.2.raw
  modified_base (288)..(288): a, c, t, g, unknown or other
  modified_base (353)..(353): a, c, t, g, unknown or other
  modified_base (621)..(621): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccgggggggtccctggagactctcctgtcgccgcctctggactcacctttaganctattggatgagcgtgggtcccgccaggctccgagggggaaggggctgggagtgggtggccaaanagtaaaaggagagtaggaagtcaagaaacactaaatgtggactcgtggtaggaacggggccgtattccaaccattccgtcccaaggaacgaaccaaaccggcccaaaaggtaaactttcagttgtatcgtaggacaaaatgaaacaggcctaggacgaacgggccccggaaagggtacccaaccggggtcccttaaggtaacttacgtggttagtagagacgacagtaagaaaccgtaagggtgaacggttaaaccgggtgggggttntaagg

SEQ ID NO: 369434 - DNA, 613 bp, Homo sapiens
  misc_feature: GZ8MTXP01CS32B.15.23.C01.1.454.CMB.2.raw
  modified_base (348)..(348): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctggagactctcctgtcgccgcctctggactctactttagagctattggatgagcgtgggtccgcaggctccgaggggaagggctggagtgggtgaccaaanagtaaaggagagtggaagtcaagaaaacactaatggtggactcgtaggtaggaaacggggcccgtaattccaaccctatccctaccgaagaacgaaccgaacggaccaaagtaacttcaagttgtaatctaggggactaaaatgaacacgcctaggaacgacggaccgaggaaccgcgggccgtaagttaacttacgtggttgtagagaacgacagtaacgaacgtaaacgggtgaacgttaaccggggtaaggggttcgtaagg

SEQ ID NO: 369435 - DNA, 616 bp, Homo sapiens
  misc_feature: GZ8MTXP01AQXZY.15.23.C01.1.454.CMB.2.raw
  modified_base (481)..(481): a, c, t, g, unknown or other
  modified_base (506)..(506): a, c, t, g, unknown or other
  modified_base (568)..(568): a, c, t, g, unknown or other
tcagtctacgtagccacgaccggtgctcgatttagtacacgtgattagggattgggaggtctcagagatgagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggagcctggtccgaggccggggggtccctgagactctcctgtcgccgcctctggactcaccttagagctattggatgagcgtggggtcccgccgaggcctccgagggggaacgggggctgggaggtgggggtcggccaaacgaagtaaaagggaagacgtagggaaagtcaaaggaaacaactagtgtgggactcgtgtggaacggggccgaattccaccatccgtaccaagacgaaccaacggccaaagtacttcaggttntaatcctagaccaaagtcgaaaccncgcgtaggacgaccggccggaacggaccgaccgggtcgtagttattacgttggtagtagagngacaagtcggaacgtaagggtacggaacggtaacggggttggggtaag

SEQ ID NO: 369436 - DNA, 603 bp, Homo sapiens
  misc_feature: GZ8MTXP01CWBGP.15.23.C01.1.454.CMB.2.raw
  modified_base (307)..(307): a, c, t, g, unknown or other
  modified_base (334)..(334): a, c, t, g, unknown or other
  modified_base (342)..(342): a, c, t, g, unknown or other
  modified_base (562)..(562): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtggagtcgtgggggagcctgggtccgaggccggggggtccctggagactctcctgtcgccgcctctggactcaccttagagctattggatgagctgggccncaggctcgaggggaggctggagtgggngaccaaanaagtaaaaggagataggaaagtacaaggaaaacactaaagtggtggtaacctgtggtaggaaacggggccctaattccaacctattccaccgaagacgaacctaaacgaccaaagaattcagtcgtaatctaggaactaaaagtcgaaacgagcctagaaggaacggccgtaagggaacctacggccttaagttaaacttggtgttacgagaagagttanagtaagaacgtaaggtagaacggttacggggtggttgtaag

SEQ ID NO: 369437 - DNA, 600 bp, Homo sapiens
  misc_feature: GZ8MTXP01BVPWD.15.23.C01.1.454.CMB.2.raw
  modified_base (309)..(309): a, c, t, g, unknown or other
  modified_base (572)..(572): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgcttattttagaaggtgtccagtgcgaggagcagctggtggagtcgtgggggaggccgtgggtccagggccgggggggtccctgagactctcctgtcgccgcctctggactcacctttagagctattggatgagctgggccncaggctccgaggggagggctgggaggtgggtggaccaaagaagtaaaggaagagtaggaaagtcaagaaaccactaaatggtggactcgtaggtagaaacggggccgtaattccaccaatcctaccgagacgaacaacgaccaaagattcagttagtatctagggaactaaagtgaacagcccgtagaagacggcccggtaaggacaaccgggtcccgtggttaacttcgtaggttgtagagaaggacagtgaacgtaacggnggtaagaaccggggtggggttaataagg

SEQ ID NO: 369438 - DNA, 554 bp, Homo sapiens
  misc_feature: GZ8MTXP01CUL94.15.23.C01.1.454.CMB.2.raw
  modified_base (346)..(346): a, c, t, g, unknown or other
  modified_base (410)..(410): a, c, t, g, unknown or other
  modified_base (415)..(415): a, c, t, g, unknown or other
  modified_base (459)..(459): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgctctggactcacctttagagctattggatgagctgggtccgccaggcctccgaggggaaggggctgggagtgggtggccaanataaaggagatggaatcaagaaacactaaatgtggactcgtggtgaagggcgattcaccatccncaganacaacgccaaagattcagtgtatctaggacaaatgaacagcccngagacgccgaggaccacgggccgtgtattacgtgttgtagagaagcagtggaacgtaacgggtgaacggttaaccggggtaagggggtttgaagg

SEQ ID NO: 369439 - DNA, 596 bp, Homo sapiens
  misc_feature: GZ8MTXP01AQUDH.15.23.C01.1.454.CMB.2.raw
  modified_base (494)..(494): a, c, t, g, unknown or other
  modified_base (591)..(591): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccgaggccggggggtccctgagactctcctgtcgcccgcctctggactcacctttagagctattggatgagcgtgggtcccgccaggcctccgagggggaagggctgggagtgggtgaccaaagataaaagggagatacgggaagtcaagaaacactaaatggtggactcgtggtaggaaaggggcccgattccaaccctatcctaccgaagaacgaacaaaccggcccaaagaacttcaagtgtaatctaggacaaatggaaaccngccctagagacggcccgaaggtaccacgggccgtgtaacttacgtgttgtagagagacagtgaacgtaacgggtgaacggttaaccgggtggggttntaagg

SEQ ID NO: 369440 - DNA, 717 bp, Homo sapiens
  misc_feature: GZ8MTXP01B1Y5Z.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctgggtccgaggccggggggtccctgagactctcctgtcgccgcctctggactctacctttagagctattggatggagcgtcgggtccgccgaggcctccggagggggaagggggctgggaggtggggtggacccaaagaagtaaaaggaagagtacgggaaagtcaaaggaaaacacgtaaagtggtgggaacttcgtgggtagaaacggggcccgtaattcccgaaccctagtccctacccgaaggaacgaaccgaaaccgaccaaaagtaattccgaagttagtacttccgtagggaacctaaaagtacggaaactacggaccctggaacggaaccggaccccgggaagggtaacccgaccggggtccccggttaagttaacgttttaacggtggtttgggtacggaaggttaacggaccttaaggtaacggaaacccggtaaacgggttaggaacgttaaacccggggggtaagggggtttaagtaagggg

SEQ ID NO: 369441 - DNA, 648 bp, Homo sapiens
  misc_feature: GZ8MTXP01DHX6G.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggaggccgtggtccgagggcccggggggtccctgagactctcctgtcgcccgcctcgtggactctacctttagagctattggatgagcgtgggtcccgccgaggcctccggaagggggaacgggggcgtgggaggtgggggtcggaccaaacgaagtaaaaggaagaagtaggaaagtacgaaagaaacactaagtgtcggactcgtaggtaggaacgggctacttccaacctatcctaccagaacgaaccaaacgacctaaagtacttcgagttgtatccgtaggaactaaaatcgaaactacgccgtaggaacggacgccggaacggtacccgacgggtccgttaagttaacgttagtgggttgtaaggagaacgcttaaggtgaaacgtaacgggtagaacggttaaccgggggtgggttgtaagg

SEQ ID NO: 369442 - DNA, 602 bp, Homo sapiens
  misc_feature: GZ8MTXP01CP2GE.15.23.C01.1.454.CMB.2.raw
  modified_base (590)..(590): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggcccggggggtccctgagactctcctgtgcccgcctctggactcacctttagagctagtggatgagctggtccgcaggctccgaggggagggctgggaggtgggtggaccaaagagtaaaaggagagtagggaagtcaagaaaacacgtaaatcggtggacttcgtggtaggaaggggcccgaattcccaacctatcctaccgaagaacgaaccaaacgtaccaaagaacttcagttgtaactctaggacaaaagtgaaacagacctggaacgacggccggaaggtacaccgggccgtgtaacttacgtggttgtagaagagacagtgaaacgtaacgggtgaacggttaaccggggnggggtttgaagg

SEQ ID NO: 369443 - DNA, 703 bp, Homo sapiens
  misc_feature: GZ8MTXP01CYS7T.15.23.C01.1.454.CMB.2.raw
  modified_base (348)..(348): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttcttgttgctattttagaaggtgtccagtgcgaggagcagctggtggagtcgtgggggagccgtggtccgaggccggggggtccctgagactctcctgtcgccgcctctggactcacctttagagctattggatgagctgggtcccgcgaggctccgaggggaagggctgggagtgggtggaccaaanaagtaaaaggagataggaaagtacgaagaaaacgactaaaagtggtcgggaacttcgttagggtacgggaaacggggccccgtaatttcccaccctaatccgtaacccgaaggaacgaaacccaaaccggacctaaaaggtaaactttacgaagttagttaacttccgttaggggaacctaaaaagtcgaaaaccaggacccgtaggaacggaaaccgccgggtaaacggtacccgaacgggtcccggttaagttaacgtttaacgtggttggttaagaacggaaaggccttaagttaacgggaaaccgtaacgggttggaacggttaaaccgggggtaaggggttaagtaaggg

SEQ ID NO: 369444 - DNA, 534 bp, Homo sapiens
  misc_feature: GZ8MTXP01AF5K2.15.23.C01.1.454.CMB.2.raw
  modified_base (307)..(307): a, c, t, g, unknown or other
  modified_base (348)..(348): a, c, t, g, unknown or other
  modified_base (374)..(374): a, c, t, g, unknown or other
  modified_base (441)..(441): a, c, t, g, unknown or other
  modified_base (454)..(454): a, c, t, g, unknown or other
  modified_base (488)..(488): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagagctattggatgagctgggtcccnccaggctccgaggggaaggggctgggagtgggtggccaaanataaaggagatggaagtcaagaaacnctaatgtggactctgtgaaggggccattcaccatctccagagacaacgccaaagattcagtgtatcnggcaaatgaaacngcctgagagccgaggacacgggcctgtattacgngttgtgagagcagtgacaacgggtgagttaccgggtggggttgaag

SEQ ID NO: 369445 - DNA, 643 bp, Homo sapiens
  misc_feature: GZ8MTXP01CVZEC.15.23.C01.1.454.CMB.2.raw
  modified_base (314)..(314): a, c, t, g, unknown or other
  modified_base (351)..(351): a, c, t, g, unknown or other
  modified_base (363)..(363): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcgtgggggaggccgtgggtccgaggccgggggggtccctgagactctcctgtcgcccgcctctggactcacctttagagctattggatgagcgtgggtccnccaggctccgaggggagggctggagtgggtgccaaanagtaaaaggaanagtaggaagtcaagaaacactaaatgtggactcgtaggtagaaaggggccctaattccgaaccctatcctacccgaagaacgaaaccgaaacgcccaaaagaacttcgaagttagtaatcctagggactaaaagtgaaaccgagtccaggaacggaacggcccggaaaggaaccgaccgggtccgttggttaattacgtgttagttaggagttaagacgaagttaacggaaacgtaaacggggttgaaacggttaaaccgggggtaaggggttgtaaggg

SEQ ID NO: 369446 - DNA, 583 bp, Homo sapiens
  misc_feature: GZ8MTXP01AP5GR.15.23.C01.1.454.CMB.2.raw
  modified_base (308)..(308): a, c, t, g, unknown or other
  modified_base (457)..(457): a, c, t, g, unknown or other
  modified_base (527)..(527): a, c, t, g, unknown or other
  modified_base (582)..(582): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttccttgttgctattttagaaggtgtccagtgcgaggagcagctggtggagtcgtgggggagcctggtccaggccgggggggtccctggagactctcctgtgcccgcctctggactcacctttagagctattggatgagctgggtccncaggctccgaggggagggctgggagtgggtggaccaagaagtaaaggagagtagggaagtcaagaaacactaaagtggtggactcgtaggtaggaaacggggcccattaccacctatccaccagacgacaaacgccaaagattcgagtntatctaggacaaaagtcaaacgagccaggacgacgccggaggaccaccgggccttaagtaattacgtggngtagaagagcataacggacgtaacgggtgaacggttaaccggggtggggttaagng

SEQ ID NO: 369447 - DNA, 616 bp, Homo sapiens
  misc_feature: GZ8MTXP01CIB0I.15.23.C01.1.454.CMB.2.raw
  modified_base (516)..(516): a, c, t, g, unknown or other
  modified_base (564)..(564): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttcctgttgctattttagaaggtgtccagtgcgaggagcagctggtgggagtcgtggggggaggcctgggtccgagggccgggggggtccctgagactctcctgtgcccgcctctggactctacctttagagctattggatgagcgtgggtcccgccaggcctccgagggggaagggggcgtgggaggtgggggtggaccaaacgaagtaaaaggaagagtaggaaagtacaagaaaacactaaagtgtggactctgggtagaaacggggcccgtattacccaccctatcctaccaggaacgaaccaaaccgaccaaagtaacttcagttgtatcctagggactaaagtcgaaacngcctagagacgcgaggacacggcgtaagtacttagtggttgtgagagnttagtaacgaccgtaaggggtagaacggttaacgggtaaggggtttcgaagg

SEQ ID NO: 369448 - DNA, 553 bp, Homo sapiens
  misc_feature: GZ8MTXP01DSUGK.15.23.C01.1.454.CMB.2.raw
  modified_base (306)..(306): a, c, t, g, unknown or other
  modified_base (492)..(492): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggggggagcctggtccaggccgggggggtccctgagactctcctgtgccgcctctggactcacctttagagctattggatgagctgggtccnccaggctccgaggggaaggggctgggagtggggtgccaaacgataaaggagatggaagtcaagaaacactaatgtggactcgtgtagaagggcgattcaccatctccagagacaaacgccaaagacttcagtgtatctggacaaagtgaaacagcctagagacgcgaggacacggcgtgtaattcngttgtgagttagcttaagtgaaaccgtaagggtagacgttaaccggggtggggtttgaagg

SEQ ID NO: 369449 - DNA, 669 bp, Homo sapiens
  misc_feature: GZ8MTXP01A73Y3.15.23.C01.1.454.CMB.2.raw
  modified_base (280)..(280): a, c, t, g, unknown or other
  modified_base (387)..(387): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaggtgtcagtgcgaggagcagctggtggagtcgtgggggaggccgtggtccgaggccggggggtccctgagctctcctgtcgccgctctggactcacttagngctattggatgagcgtggtcccgcgaggcctcgagggggaaggggcgtgggaggtggggtggaccaaagaagtaaaagggaagagtagggaaagtacaaagaaaacncgttaaagtggtggacctcgtagggtagggtaaacggggcccgtaattcccacctattccctaccgaaggaacgaaccgaaaccgacctaaaaggtaactttccgaaagttcgttaaacttccgtagggaactaaaagtcgaaacgacgccgtaggaacgacggccgaagggaccgaccgggccgttaagttacttactggttggtagaggttaacgcgaagttaaggaaacccgtaacggggtaggtaaacgttaaaccggggggtggggtttgtaacggg

SEQ ID NO: 369450 - DNA, 555 bp, Homo sapiens
  misc_feature: GZ8MTXP01EHZSG.15.23.C01.1.454.CMB.2.raw
  modified_base (341)..(341): a, c, t, g, unknown or other
  modified_base (350)..(350): a, c, t, g, unknown or other
  modified_base (506)..(506): a, c, t, g, unknown or other
  modified_base (513)..(513): a, c, t, g, unknown or other
  modified_base (517)..(518): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccaggccggggggtccctgagactctcctgtgcccgcctctggactcacctttagagctattggatgagctgggtcccgccaggctccgagggggaagggctgggaggtgggnggaccaaanaagtaaaggaagataggaaagtacaagaaacactaaatgtgactgtgtagaacgggcgattcacctaatctaccagacgaactaacgcaaagattcgagtgtatctaggactaaaatgaacagccagagagccgagaccacggcctgtattactgngtcgaanacgnngtaagacaacgggtgacgttaacgggtgggttgaagg

SEQ ID NO: 369451 - DNA, 546 bp, Homo sapiens
  misc_feature: GZ8MTXP01AIUGN.15.23.C01.1.454.CMB.2.raw
  modified_base (500)..(500): a, c, t, g, unknown or other
  modified_base (524)..(524): a, c, t, g, unknown or other
  modified_base (537)..(537): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagagctattggatgagctgggtccgccaggctccgaggggagggctgggagtgggtggccaaagagtaaaggagagtagggaaagtcaagaaacactaaatggtggactctggtgaagggccgattccacatctaccagacgacaacgaccaaagaattcgagtgtatctaggacaaagtgaaacagcctagagagccgagacacggcgtgtaattcgngttgtgagagcatgacaacgggtnacgttaaccgggngggttgaag

SEQ ID NO: 369452 - DNA, 667 bp, Homo sapiens
  misc_feature: GZ8MTXP01DJFNQ.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggttttctgttgctatttagaaggtgtcagtgcgaggagcagctgggtggagtcgtgggggagcctggtccgaggcccgggggggtccctggagactctcctgtcgccgcctcgtggactcacctttagagctagttgatgagcgtgggtcccgccaggcctccggagggggaagggggctagggggagttcgggggtcggaccaaacgaagtaaaaggagagtaggaagtacgaagaaacacgttaaatcggtggaaccttgtaggtaggaacggggccctattaccacctattccaccgagaagaccaaaccggcaaaatacttcaggttatacttaccgaagaactaaactaacaacgacgaccgacggaacggaacggaccggaacggaccggaccggtcggttaacgttacgttacgttggttggtaggtaacgaacgacgttacgtaacggtaaacggtaacgggtaacggtaacgggttaacggggtaacggggttaaggtaagg

SEQ ID NO: 369453 - DNA, 584 bp, Homo sapiens
  misc_feature: GZ8MTXP01BQI53.15.23.C01.1.454.CMB.2.raw
  modified_base (312)..(312): a, c, t, g, unknown or other
  modified_base (468)..(468): a, c, t, g, unknown or other
  modified_base (487)..(487): a, c, t, g, unknown or other
  modified_base (541)..(541): a, c, t, g, unknown or other
  modified_base (548)..(548): a, c, t, g, unknown or other
  modified_base (551)..(551): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttctgtgctatttagagtgtcagtgcgaggagcagcgtggtggagtcgtggggggagccgtgggtccgagggcccggggggtccctggagactctccgtgtcgcccgcctcgtggacctctacctttagagctagttggatgagcgtgggcccncgaggcctcgaggggaagggctgggaggtggggtgaccaaagaagtaaaaggaagagtaggaaagtacaaagaaaccataagtgtggaactcgtggtaggaacggggtccattccacctatccaccgagacgaacaacgtcaaagtacttcgagtntaatccgtaggaactaaancgaaacgagcctagagacggccgaaggtaccacgggtccgtaagtaattgtagngtacganagnagaagacgaacgagaggttacggtaaggttgtg

SEQ ID NO: 369454 - DNA, 622 bp, Homo sapiens
  misc_feature: GZ8MTXP01C4LG1.15.23.C01.1.454.CMB.2.raw
  modified_base (287)..(287): a, c, t, g, unknown or other
  modified_base (308)..(308): a, c, t, g, unknown or other
  modified_base (467)..(467): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggagccgtggtccgaggccggggggtcctgagactctcctgtcgccgtctcgtcggactctacttagntctagtgatgagcgtggcccncgacggcctaccggaagggggacgggtcgtagggaggtggggtcgaccaaacgaaagtaaaggagtagtaaggaacgtacgaagaaacactaagtgcgtacctgtagtaggacgggctatccaactatccacgagacacaacgacaaagtacttcagtntactcgtaagaaactaagacaacgcgacgtaggacgaccggacggtaacggaccgtaccggttcgttaagttagttgtaggttacgtaggaacgacgttacaggtaacgaaacggtaacgggtaacggtaacgggttacggggtggttaagtaag

SEQ ID NO: 369455 - DNA, 628 bp, Homo sapiens
  misc_feature: GZ8MTXP01EPJ1B.15.23.C01.1.454.CMB.2.raw
  modified_base (569)..(569): a, c, t, g, unknown or other
  modified_base (576)..(576): a, c, t, g, unknown or other
  modified_base (585)..(585): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgcttattttagaaggtgtccagtgcgaggagcagctggtggagtcgtgggggagcctggtccgaggccgggggtccctgacgactctcctgtcgcccgcctcgtggactcacctttagagctattggatgagcgtcgggtcccgcgaggcctaccggagggggaaggggctgggaggtgggtcggaccaaagaagtaaaaggagagtaggaaagtacaaagaaacacgtaagtggtggtaactcgtaggtacggaacggggtcccctagtttacccaaccctagtacctaccgaagaacgaactaaaccgaccaaagtacttcgagtagtatctagggaactaaagtcgaacagcccgtaggagacgccgtaacggacaccgggcgtaagttaactttacgnggttagngaagacganagtgaaccgtaaggtgtaacggttaccggggtgggtttgaagg

SEQ ID NO: 369456 - DNA, 648 bp, Homo sapiens
  misc_feature: GZ8MTXP01CGDE6.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgctattttagaaggtgtccagtgcgaggagcagctggtggagtcgtgggggagcctggtccgaggccggggggtccctgagactctcctgtcgcccgcctctggactctacctttagagctagttggatgagcgtgggtcccgccgaggcctccggagggggaacggggcgtgggaggtgggggtcggaccaaagaagtaaaaggagagtaggaaagtacaagaaaaccacgttaaagtggtcggactcgtagggtaggaacgggcctaattccactatccaccaagacacaaacgaccaaagtacttcgagttgtactctaggactaaaagtcgaaaactgacccgtggaacgaccggccggaagggaccctaacggggccgttaagttaacttacggtggttgtaggaaggttaacgcttagtaacgggaaaccgtaacgggttggaaacgggttaaacgggggtggggtttgtaaggg

SEQ ID NO: 369457 - DNA, 673 bp, Homo sapiens
  misc_feature: GZ8MTXP01DYNMX.15.23.C01.1.454.CMB.2.raw
  modified_base (439)..(439): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctgggtccaggccggggggtcctgagactctcctgtgcccgcctctggactctacctttagagctattggatgagcgtgggtccgccgaggcctccggagggggaaagggggctgggaggtggggtacggaccaaacgaagtaaaagggaagagtagggaagtacaagaaactactaagtgtggactcgtaggtaggaacgggcgattccactatcncagagaacaacgtcaaagaattcagtgtaatcgtaagaactaaagtacgaaacgacgtccgtaggaacggaaccggaccggaaacgggtacccgtaccggggttccggttaagtttaacgtttacggttggttaggtacggaaacggaacgttacgttaaacggtaacggaaaacggtaacggggttaacggtaaacggggttaaaccgggggttaagggggtttaagttaagg

SEQ ID NO: 369458 - DNA, 631 bp, Homo sapiens
  misc_feature: GZ8MTXP01DQ0VH.15.23.C01.1.454.CMB.2.raw
  modified_base (499)..(499): a, c, t, g, unknown or other
  modified_base (520)..(520): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctgggtccgaggccgggggggtccctggacgtctcctccgtgtcgcccgtcctcgtcggactctacctttagatcttagttggatgacgtcggtcgggtcccgcgaggccgtaccggaagggggaagggtcgtaggggtaggtgggggtacgaaccaaacgtaaagtaaaaggagtaggtacggaacgtacgaaagaaactacgtaagtggtggactcgtggtaggaacggcgtactaccactatccacagacgaacacgactaaagtactcgagtntatctaggaacaagtcgaaancgctagacgacggcgtagacgtcggcttaatgttacgtggttgtagacggttaagcgttagtaacggtaacgtaacgggtaggtaacgggttacggggtaaggttgtaagg

SEQ ID NO: 369459 - DNA, 607 bp, Homo sapiens
  misc_feature: GZ8MTXP01DJN3L.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggagcctggtccgaggccggggggtcctgagctctcctgtcgcccgcctctggactcacctttagagctagttggatgagcgtgggtcccgcgaggctccgaggggaagggctgggaggtgggtagaccaaagaagtaaaaggaagagtaggaaatacaagaaacactaaagtgtggactcgtggtaggaacgggtcctattccaaccctattccaccgaagaacgaacaaaccgacaaagtacttcaagttctatctaggactaaaatcgaaacacgcctaggaacgacggacccgtaagacccgtacgggccgttaagttacttacgtgttgtagaagaagcgaatggaaccaaagggtgaaacgttaacggggtggggttaagaag

SEQ ID NO: 369460 - DNA, 557 bp, Homo sapiens
  misc_feature: GZ8MTXP01DMK30.15.23.C01.1.454.CMB.2.raw
  modified_base (347)..(347): a, c, t, g, unknown or other
  modified_base (356)..(356): a, c, t, g, unknown or other
  modified_base (364)..(364): a, c, t, g, unknown or other
  modified_base (465)..(465): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggggggaggcctggtccaggccgggggggtccctgagactctcctgtcgccgcctctggactcacctttagagctattggatgagctgggtcccgccgaggctccgaggggaggggctgggagtgggtgcaanataaagganatggaatnaagaaacactaatgtggactcgtgtaggaagggcccgtattccacctatcctcagaacgacaaacgaccaaagaattcagtgtatcaggacaaatgaaacngcctgagacgccgaaggaccacggcgtgtaattcgtgttgtagagagcagtggaacaacggggtgaacgttaaccggggtggggttgtaagg

SEQ ID NO: 369461 - DNA, 691 bp, Homo sapiens
  misc_feature: GZ8MTXP01BG9DF.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccgggggggtccctgagctctcctgtcgcccgcctctggactcacctttagagctattggatgagcgtgggtcccgccagggcctccggagggggaaggggctgggaggtggggtggaccaaagaagtaaaaggagagtagggaaagtcaagaaacactaaagtggtggactcgtaggtagggaaacggggccgtaatttcccaacctattcccctacccgaaggaacgaaacccaaaccgggaccaaaaggtaactttccgaagttagtaattcccgtaggggaaacctaaaaagtcggaaaacctggaccctagggaacggaacggcccgggaaagggaccgaccggggtccgttaaggttaactttaccggtggttaggtaggaagaacggacttagtaagggaaaccctaagggggtgaaaccggttaaccgggggtaaggggtttgtaaggg

SEQ ID NO: 369462 - DNA, 656 bp, Homo sapiens
  misc_feature: GZ8MTXP01C2WYM.15.23.C01.1.454.CMB.2.raw
  modified_base (198)..(198): a, c, t, g, unknown or other
  modified_base (316)..(316): a, c, t, g, unknown or other
  modified_base (651)..(651): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaagtgtccagtgcgaggancagcgtggtggagtcgtgggggagccgtggtccgagggcccggggggtccctggagacttctcctgtcgccgcctcgtggactctacctttagagctattggatgagcgtgggtcccnccgaggctccgaagggggaagggcgtgggagtgggtacggaccaaagaagtaaaaggagtagtaggaagtacgaagaaaaccattaaagtggtaacggacttcgtagggtaggaacggggtcctattacccaacctattcccgaaccaaggaacaaaccaaaccgttaacccaaaggtaaactttcgaaaggtttgtaacttacgaagaaactaaagtacgaaacgacgtacgtaggaacggaaccgtaccggaacggtaccgacggtcgttaagttaacgttgtgagacgaagacgacagtaagacgtaaggtaggtaacgttacggggtgttntaagg

SEQ ID NO: 369463 - DNA, 623 bp, Homo sapiens
  misc_feature: GZ8MTXP01BL7ZD.15.23.C01.1.454.CMB.2.raw
  modified_base (554)..(554): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgctattttagaaggtgtccagtgcgaggagcagctggtggagtcgtgggggaggccgtggtccgagggccggggggtccctggagactctcctgtcgcccgcctctggactctacctttagagctattggatgagcgtgggtcccgccaggcctcgaggggaaggggctgggacggtgggtgaccaaagaagtaaaaggagagtaggaatcaaagaaacacgtaaatgtggacctgtggtagaacggggccattccacctatcctaccgaagacgaacaaacgccaaagtacttcgaagttctatctagggaactaaaagtcgaaacagtcccgtagaaggaacgccccggtaagggaacccgaccgggtcgttgttaaacgtttgnggttagtgaagagacttagtaacgaaaccgtaagggttagaacgttaaaccgggggtggggtttgaagg

SEQ ID NO: 369464 - DNA, 574 bp, Homo sapiens
  misc_feature: GZ8MTXP01DLXEE.15.23.C01.1.454.CMB.2.raw
  modified_base (529)..(529): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgctattttagaaggtgtccagtgcgaggagcagctggtggagtcgtgggggaggccgtgggtccgaggcccgggggggtccctggagactctcctgtgcccgcctctggactcacttagagctagttggatgagctgggtcccgccaggctccgagggggaaggggctgggagtggggtgaccaaacgagtaaaaggagatagggaagtacaagaaaaccactaatggtggactcgtggtagaaacggggcctattccacctatcctaccgaagacgaaccaaacgccaaaagtattcagtgtaatcgtagacaaagtgaacagcctgagacgccgaggtaccacggccgtgtacttcgtgngtagagagcagtgaacgaacggtgacgttacgggtgggttgtaag

SEQ ID NO: 369465 - DNA, 596 bp, Homo sapiens
  misc_feature: GZ8MTXP01E01UN.15.23.C01.1.454.CMB.2.raw
  modified_base (309)..(309): a, c, t, g, unknown or other
  modified_base (346)..(346): a, c, t, g, unknown or other
  modified_base (378)..(378): a, c, t, g, unknown or other
  modified_base (487)..(487): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggagcctggtccgaggccggggggtcctgagactctcctgtcgcccgcctctggactctacctttagagctattggatgagctgggtccncaggctccgaggggagggctggagtgggtgaccaaanagtaaaaggagagtcggaaagtcaaagaaacnctaaatggtggaactcgtaggtaggaaacggggtcccaatttccacctaatcctacgagaacgacaaaccgcaaagaacttcagtgtaatctaggacaaaagtgaaacngacccgtgaagacgtccggaaggaacccaccgggccggtaatacgttaagtgttgtagaagacgaacagtaacgaacgtaacggtggtaacggttacgggtgggttgtg

SEQ ID NO: 369466 - DNA, 574 bp, Homo sapiens
  misc_feature: GZ8MTXP01AHI1R.15.23.C01.1.454.CMB.2.raw
  modified_base (479)..(479): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgcccgcctctggactctacctttagagctattggatggagcgtgggtcccgccagggctccgaggggagggggctgggagtggggtcggaccaaagagtaaaaggaagagtagggaagtcaagaaacactaaatggtgactgtaggtaggaacggggcattccacctatctaccagaacacaacgccaaagattcagtgtatctaggacaaatcgaaacngcctgagacgccggaggacgaccggcgtgtacttcgtgttgtagagagacagtggaacgaacgggttgaacggttaccggggaaggggttgaagg

SEQ ID NO: 369467 - DNA, 661 bp, Homo sapiens
  misc_feature: GZ8MTXP01D4MFC.15.23.C01.1.454.CMB.2.raw
  modified_base (526)..(526): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctcctgtgcccgctctggactcactttagagctattggatgagcgtcgggtccgccgaggctccggagggggaagggggcgtgggaggtgggggtcggaccaaacgaagtaaaaggaagagtagggaaagtacaagaaactactaaagtgtggacttcgtaggtaggaacggggcctagttccacgtattccaccgaagaacgaaaccaaaccggacctaaaaggtaactttcgaaaggttcgttaatccgtaggaaactaaaatcggaaacngacccgtaggaaggaacggcccggtaagggaaccgtccggggccgttaagttaacgtttacgtggttaggagaaggttaagcaagtaacgaaacgtaacgggtagaacgggttaaacgggggtgggtttgtaagg

SEQ ID NO: 369468 - DNA, 650 bp, Homo sapiens
  misc_feature: GZ8MTXP01DDG4U.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtgggagtcgtggggggaggcctggtccgaggccggggggtccctgagctctcctgtgcccgcctctggactcacctttagagctattggatggagcgtggtccgcaggctccgagggggagggctgggagtggggtaggaccaaagaagtaaaaggagagtaggaagtacaagaaaacacgtaaatggtgactcgtaggtaggaacgggccgtattcccacctatcctaccaagacgaaccaacgaccaaagtaacttcgaagtgttaataccgtaggaacctaaaagtcgaaacgtagccctaggaacggaacggtcccggaaggtaaccgtccggggtaccgttaaggttaatttaccggtgggttagttaggaacgaaggacagttaaggaaaccgtaacgggtaggtaaacgggttaccggggttaaggggttgtaaggg

SEQ ID NO: 369469 - DNA, 572 bp, Homo sapiens
  misc_feature: GZ8MTXP01C2FWN.15.23.C01.1.454.CMB.2.raw
  modified_base (346)..(346): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgccgcctctggactcacctttagtagctattggatgagctgggtccgccaggctccgaggggaaggggctgggagtgggtggccaanataaaggagagtggaagtcagaaacactaatgtggactcgtggtaggaagggccgattaccaccatcctaccagaagaccaaacgcccaaagaacttcagtgttaatccttagggactaaatgaaacagcctagaggacgcccggaggaccacgggccgtgtattactggttgtgagagacatggaacgaacgggtgacggttaaccggggtggggttaagtaagg

SEQ ID NO: 369470 - DNA, 745 bp, Homo sapiens
  misc_feature: GZ8MTXP01CSI3Z.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcgtgggggagccgtggtccgagggcccggggggtccctgagactctcctgtcgccgcctcgtggactctacctttagagtctagttggatggacgtcgtcgggtcccgccgagggcctaccggagggggaagggggcgtggggaggttgggggtcggaccaaagaagtaaaacgggaagtaagtagggaaagtacgaaagaaaacctacgtaaagttggtgggaaccttcgttagggtacgggaaacggggtcccgtagttacccaaccgtattcccgtacccgaaggaacgaaaccaaaccgtacccaaaaggtaactttccgaaggttgttaaactcccgttaaggggaacctaaaaagttcgggaaaacccacggtccccgtagggaaacggaccggaacccggggtaaaggggaaccccgtaaccggggtcccggttaagtttaacgttacgtagggttagaggacgttagttacagtaacgaaacgtaacgggtaggaacgggttaaccggggtggggttcgaaggg

SEQ ID NO: 369471 - DNA, 560 bp, Homo sapiens
  misc_feature: GZ8MTXP01CFOUZ.15.23.C01.1.454.CMB.2.raw
  modified_base (432)..(432): a, c, t, g, unknown or other
  modified_base (503)..(503): a, c, t, g, unknown or other
  modified_base (510)..(510): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggcccgggggggtccctgagactctcctgtgcccgcctctggactcacctttagagctattggatgagctgggtcccgccaggctccgagggggaagggctgggagtgggtgccaaacataaaggagataggaagtcaaggaaaacactaaatgtggactcgtggtagaaaggggcccgattccacccatcctccaganacaacgccaaagattcagtgtaatctaggactaaagtgaaacagcctagagacgccggaagcacggccgtntaattcngttgtgagagcagtgaacaacgggtgaagttaaccggggtggggttgaag

SEQ ID NO: 369472 - DNA, 738 bp, Homo sapiens
  misc_feature: GZ8MTXP01CX2ZV.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggaggccgtggtccgaggccgggggggtccctggagactctcctgtcgccgcctctggactcacctttagagctattggatgagcgtggtccgcaggctccgagggagggctggagtgggtgaccaaagagtaaaggagagtaggaaagtcaagaaacacgtaaatgtggactcgtggtaggaagggcccaattccgacctatcctacccgaagaacgaaccaaaaccggacccaaaaggtaaactttaccgaaaggttagttaacgttaccgttaggggaaaccctaaaaaagttacgggaaaaaccctaacggaccccgttaagggaacggaaaccgggaccccgggaaaacggggtaacccgaaacccgggggtcccggttaaggtttaaacgttttaaaccggttgggttacggtttacggaaacggttaaggaaccttaacggttaaggaaaaccgtaaaccggggtttaggaaacggttaaaacccgggggtaagggggtttaacgttaaggg

SEQ ID NO: 369473 - DNA, 640 bp, Homo sapiens
  misc_feature: GZ8MTXP01CGLNC.15.23.C01.1.454.CMB.2.raw
  modified_base (290)..(290): a, c, t, g, unknown or other
  modified_base (314)..(314): a, c, t, g, unknown or other
  modified_base (360)..(360): a, c, t, g, unknown or other
  modified_base (416)..(416): a, c, t, g, unknown or other
  modified_base (591)..(591): a, c, t, g, unknown or other
  modified_base (610)..(610): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttcctgttgctattttagaaggtgtccagtgcgaggagcagcgtggtggagtcgtgggggacgccgtggtccgagggccggggggtccctggacgactctcctgtcgcccgctcgtggactcacctttagngctattggatgagcgtgggtcccncgaggctccggaagggggacgggctgggaggtgggtacgaccaaanaagtaaaaggagagtaccggaaatacgaaagaaaccataaagtggtcggtactcgnggtacggaacggggccctattccaacctatcaccaagacgactaaaccggaccaaagtacttcgagtacgtaactcgtacggaaacttaaagacgaaaccgagtcccaggaacggaaccggccgaaaggacccgttacgggccttaaggttaacttgtggttgaagagacggaanagtaacggaacgtaacggnggtaaacgggttacggggtaaggttgtaag

SEQ ID NO: 369474 - DNA, 647 bp, Homo sapiens
  misc_feature: GZ8MTXP01BJ6JV.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgcccgcctctggactcacctttagagctattggatgagcgtgggtcccgccaggcctccgaggggaaggggcgtgggagtggggtggaccaaacgaagtaaaaggaagagtagggaaagtacaagaaacactaatggtgggactcgtggtagaacggggccgattccaaccgtatcccgtaccaaggacgaaccaacggccaaacgtaaagtactacgtaagggttataccttaggggtactaaagtaaaccgtaacggaacgccgtacgaagggaacggaccggaacggggaacgacccggaccgggtccgttaagttcgttagttggttagaggttaagagttacaagacgaacgtaggagttaaccgggtaaggggttgggtaag

SEQ ID NO: 369475 - DNA, 639 bp, Homo sapiens
  misc_feature: GZ8MTXP01CTHSP.15.23.C01.1.454.CMB.2.raw
  modified_base (520)..(520): a, c, t, g, unknown or other
  modified_base (574)..(574): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccgaggccggggggtccctgagactctcctgtcgccgcctctggactcacctttagagctattggatgagctgggtccgccaggcctccgaggggagggctgggagtgggtcggaccaacgagtaaaaggagagtacggaagtcaagaaacactaatggtggactcgtagggtaggaacggggtccgtaattcccaacctatccctaccgaaggaacgaaaccgaaaccggacctaaaaggtaaactttccgaagttagtaactcgttacgggaactaaaagtcgaaaacgngccctagggaacgaccgccggtaaggaccgacggccgtaagttaattacgtggngtagagttacgacagtaaggaaccgtaagggcgtaacggttaaaccgggggtggggtttgaacgg

SEQ ID NO: 369476 - DNA, 618 bp, Homo sapiens
  misc_feature: GZ8MTXP01AHG06.15.23.C01.1.454.CMB.2.raw
  modified_base (315)..(315): a, c, t, g, unknown or other
  modified_base (359)..(359): a, c, t, g, unknown or other
  modified_base (565)..(565): a, c, t, g, unknown or other
  modified_base (591)..(591): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgagggccggggggtccctggacgactctcctgtcgcccgcctctggactcacctttagagctattggatgagcgtcgggtcccnccgaggctccgagggggagggctgggaggtgggtcggaccaaanagtaaaaggagagtacgggaagtacaagaaaacactaaatggtgggactcgtggtaggaacgggggcccaatttcccgaaccctatccctacccgaaggacgaaccaaaccggaccaaagtaacttacagttacgtactctagggactaaaagtcgaaacagcccgtaggacgaacggccgaggaccacgggccgtgtacttacgngttgtgagagcagtggacaacgggtnaaggttaccgggtaaggggttcgtaag

SEQ ID NO: 369477 - DNA, 597 bp, Homo sapiens
  misc_feature: GZ8MTXP01BOO01.15.23.C01.1.454.CMB.2.raw
  modified_base (286)..(286): a, c, t, g, unknown or other
  modified_base (308)..(308): a, c, t, g, unknown or other
  modified_base (345)..(345): a, c, t, g, unknown or other
  modified_base (367)..(367): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcttgggttttccttgttgcttattttagaaggtgtccagtgcgaggagcagctggtggagtcgtgggggagccgtggtccgaggccggggggtccctgagctctcctgtgcccgcctctggactcacctttaganctattggatgagcgtgggtccncaggctcgagggaagggctgggagtgggtgaccaaanagtaaaggaagagtaggaagtnaaagaaacactaaatgtggactcgtggtagaaacggggcctaattcccgacctagtcctaccgagaacgaacgaaacgaccctaaagtaacttcaagttgtaaatccgtagggaacaaattcggaaacagccgtagagaccgacgaaggacaccgggccgtaagttattacgtgttgtaggattaggacagtgaaccgaaggtgacgttaaccgggtaagggttcgtaag

SEQ ID NO: 369478 - DNA, 542 bp, Homo sapiens
  misc_feature: GZ8MTXP01BRCXU.15.23.C01.1.454.CMB.2.raw
  modified_base (306)..(306): a, c, t, g, unknown or other
  modified_base (339)..(339): a, c, t, g, unknown or other
  modified_base (348)..(348): a, c, t, g, unknown or other
  modified_base (365)..(365): a, c, t, g, unknown or other
  modified_base (456)..(456): a, c, t, g, unknown or other
  modified_base (498)..(498): a, c, t, g, unknown or other
  modified_base (506)..(506): a, c, t, g, unknown or other
  modified_base (509)..(509): a, c, t, g, unknown or other
  modified_base (532)..(532): a, c, t, g, unknown or other
tcagtctacgtagccacgaccggtgctcgatttagtacacgtgattagggattgggaggtctcagagaggagccttagccctggactccaaggcctttccacttggtgatcagcactgagcgacagtaggactcaccatggagttgggctgagctggttttccttgttgctattttagaaggtgtccagtgcgaggagcagctggtggagtcgtgggggagcctggtccaggccggggggtccctgagactctcctgtcgcccgcctctggactcacctttagagctagttggatgagctgggccncaggctccgagggagggctggagtgggtgcaanataaagganatggaatcgaagaaacnctaaatgtggactcgtgtaggaacgggccattcacctatctccagacgacaaacgccaaagattcagtgtatctaggactaaatgaaaccngcctagagagccgtaggactacgggcctgtattacgtgttgngagagacngtnaacgaaggtgaacgttacggggngggttgtaag

SEQ ID NO: 369479 - DNA, 553 bp, Homo sapiens
  misc_feature: GZ8MTXP01D1U2T.15.23.C01.1.454.CMB.2.raw
  modified_base (441)..(441): a, c, t, g, unknown or other
  modified_base (484)..(484): a, c, t, g, unknown or other
  modified_base (520)..(520): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttctgttgctattttagaggtgtccagtgcgaggagcagctggtggagtcgtgggggagccgtggtccgagggcccggggggtcctgagactctacgtgtcgcccgcctcgtggactctacctttagagctagttggatgagcgtgggtcccgcaggctccggaggggaaggggctgggaggtgggtggaccaaagaagtaaaaggaagtagtaggaacggtacaaagaaaacactaaagtgtggactgtggtagaaggggcctattccaccatccacagganaacaacgcaaagacttcagtatatcaggaacaatagaacagcngagacgcgagacgcgcgtgtattatgttgtgagagnataagacgaagtagacgaggtaaggttgtaagg

SEQ ID NO: 369480 - DNA, 675 bp, Homo sapiens
  misc_feature: GZ8MTXP01DK9SN.15.23.C01.1.454.CMB.2.raw
  modified_base (312)..(312): a, c, t, g, unknown or other
  modified_base (342)..(342): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggagcctggtccgaggccggggggtccctgagactctcctgtcgcccgcctcgtggactctacctttagagctattggatgagcgtgggcccncaggcctcgaggggagggctgggagtgggngaccaaagagtaaaaggagagtaggaaagtcaagaaacactaatggtggactcgtaggtacggaaacggggtccgtaattcccacctattcctacccgaagaacgaaccaaaccggaccaaaagtaactttcgaagttgtaatccgttagggaactaaaagttcggaaaaccaggcccgtaggaacggaacggacccggtaagggaacccgaccggggtcccgtttaaggttaaactttacggtggttggtaggaagaacggacgttaagtaacggaaaccgtaacggggtaggtaaacggttaaacccgggggtaagggggtttcgtaaggg

SEQ ID NO: 369481 - DNA, 529 bp, Homo sapiens
  misc_feature: GZ8MTXP01AZ647.15.23.C01.1.454.CMB.2.raw
  modified_base (461)..(461): a, c, t, g, unknown or other
  modified_base (473)..(473): a, c, t, g, unknown or other
  modified_base (520)..(520): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttcctgttgctattttagaaggtgtccagtgcgaggagcagctggtggagtctgggggaggcctggtccaggccgggggggtccctgagactctcctgtgccgctctggactcacctttagagctattggatgagctgggtccgccagggcctccgaggggaagggggctgggagtgggtggccaaacataaagggaagataggaagtcaagaaacactaatgtggactctgtgaagggccgattcaccatctcagagacaaacgccaaagattacagtgatctggacaaatgaacagtccngagagcgagacncggctgtattctgttgtgagagcatgacaacggtgagttaaccgggngggttgaag

SEQ ID NO: 369482 - DNA, 612 bp, Homo sapiens
  misc_feature: GZ8MTXP01DJRUV.15.23.C01.1.454.CMB.2.raw
  modified_base (305)..(305): a, c, t, g, unknown or other
  modified_base (349)..(349): a, c, t, g, unknown or other
  modified_base (474)..(474): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggggggaggcctggtccaggccgggggggtcctgagactctcctgtcgccgcctctggactcacctttagagctatgatgagctgggtccnccaggctccgagggggaaggggctgggagtggggtggaccaaanaagtaaaaggaagatagggaagtcaagaaaacactaatgtggactgtgtagaaggggccatcaccatccacagacgaacaaccgtacaagtaattcagtgtatcctagggactaaaatgaaacgngccctggaacgaacggcccggtaagggaacccgaacggggtcccgttaagttaacgttaccgttggttagtaggaagaagacaagtcggaaaccgtaacgggtgaacggttaaccgggggtaagggggtttgtaaggg

SEQ ID NO: 369483 - DNA, 675 bp, Homo sapiens
  misc_feature: GZ8MTXP01A6WL5.15.23.C01.1.454.CMB.2.raw
  modified_base (321)..(321): a, c, t, g, unknown or other
  modified_base (541)..(541): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttcctgttgctattttagaaggtgtccagtgcgaggagcagctggtggagtcgtgggggagcctgggtcgcgacggggtcccggggggtcctggacgtactcctccgtgtcgcccgcctgtcggactctaccttagagcttagtggatgagtcgtcgggtccncgaggctaccggaagggggacgggtcgtgggaggtgggtcgacccaaagtaaagtaaaggaacgtacgtagggaaacgtcgaaagaaactaacttagtggtagtaccttcgtgggtaggaacggggcctaacttccgaacctagtcctacgaaggacgaaaccaaccgactaaagtacttacgagttagtactcggtacgaaactaaagtcgaaaaccgngtcccgtaggaacgcggaccgggaagacccgacgggtaaccgttagttaacgttacgttggtaggtaggaacgcgttaaactgtacggaacgtaaccggggtagaaccggggtaaaccggggttggggttaacg

SEQ ID NO: 369484 - DNA, 647 bp, Homo sapiens
  misc_feature: GZ8MTXP01CUKQ8.15.23.C01.1.454.CMB.2.raw
  modified_base (311)..(311): a, c, t, g, unknown or other
  modified_base (351)..(351): a, c, t, g, unknown or other
  modified_base (489)..(489): a, c, t, g, unknown or other
  modified_base (527)..(527): a, c, t, g, unknown or other
  modified_base (642)..(642): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctgggtccaggcccgggggggtccctgagactctcctgtcgcccgcctctggactctacctttagagctattggatgagctgggtcccnccaggcctccgaggggagggctgggagtgggtgaccaaanagtaaaaggagagtaggaaagtacaaggaaaacacgttaaatggtcggtaactcgtggtaggaaacggggccctattcccgaacctatcctaccgaagaacgaaccctaaacgacccaaaagtaactttcgaaggttntaaacttccgttagggaaacctaaaagttcggaaaacncggtaccctaggaaggaaaccggcccggaaagggaccctaccgggaccgttgttaaacttacgtggttgtagaagacgacagtgaacgtaaggtgaagttaaccgggtggggttntaagg

SEQ ID NO: 369485 - DNA, 659 bp, Homo sapiens
  misc_feature: GZ8MTXP01C8Z3F.15.23.C01.1.454.CMB.2.raw
  modified_base (401)..(401): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggaggccgtgggtccgagggcccgggggggtccctgagactctcctgtcgcccgcctctggactcacctttagagctattggatgagcgtgggtcccgccgaggcctccgagggggaagggggctgggaggtgggggtggaccaaacgaagtaaaaggaagagtaggaagtacgagaaaacnctaatgtcggtactcgtggtaggaacgggccgtattccacctatcctaccgaagacgaaccaaacgaccaaagtacttcagttgtaatccgtaggaacctaaaagtacgaaacacgcccgtaggaacggaacggcccggaagggacccgaccgggccgttaagttaactttcgtggttggttaggaaggaacggacaagtcggaaaaccgtaagggtacggaacgggttaaaaccgggggtgggggtttaagtaaggg

SEQ ID NO: 369486 - DNA, 584 bp, Homo sapiens
  misc_feature: GZ8MTXP01EK566.15.23.C01.1.454.CMB.2.raw
  modified_base (310)..(310): a, c, t, g, unknown or other
  modified_base (381)..(381): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggagcctgggtccagggccggggggtccctgagctctcctgtcgcccgcctctggactcacctttagagctattggatgagcgtgggtccncaggcctccgagggagggctgggagtgggtggaccaaagagtaaaaggagatagggaaagtcaagaaaacnctaaatgtggactcgtggtaggaaacggggccgattccaccatcctaccagacgaacaaacgaccaaagtattcagtgtaatccgtaggaacaaagtcgaaactagcccgtgaagacgccgtaaggacgaccgggtccgtgtattacgtgttagtgagagacagtgaacgaacgggtgaggaaccggggtaagggttgtaagg

SEQ ID NO: 369487 - DNA, 557 bp, Homo sapiens
  misc_feature: GZ8MTXP01EAU6G.15.23.C01.1.454.CMB.2.raw
  modified_base (303)..(303): a, c, t, g, unknown or other
  modified_base (344)..(344): a, c, t, g, unknown or other
  modified_base (425)..(425): a, c, t, g, unknown or other
  modified_base (507)..(507): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttctgtgctatttagaggtgtccagtgcgaggagcagctggtggagtcgtgggggaggcctggtccaggccggggggtccctgagactctcctgtgcccgcctctggactctacctttagagctattggatgagcgtgggtcccnccaggctccgagggggaagggctgggagtggggtgaccaanaagtaaaggaagagtaggaagtacaagaaacactaaatgtggactcgtggtaggaacggggccattcaccatcctccaganaacaacgcaaagaattcaagtgtatctaggacaaatgaacagcctgagacgccgaggccacgggctaagtacttagtgttgngacgagcaagtgaaacgaacgggtagagttaaccggggtgggttgtaagg

SEQ ID NO: 369488 - DNA, 623 bp, Homo sapiens
  misc_feature: GZ8MTXP01EJXIE.15.23.C01.1.454.CMB.2.raw
  modified_base (317)..(317): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagagactcaccatggagttgggctgagcgtgggttttccttgttgctatttagagtgtccagtgcgaggagcagcgtggtggagtcgtgggggagccgtggtccgagggccggggggtccctggacgactcctccgtgtcgcccgcctcgtcggacctctacctttagagctattggaatgagcgtgggtcccnccgaggcctaccgaggggaagggctgggaggtgggggtcgaccaaagaagtaaaagggaagaagtagggaaagtacaaaggaaaacactaaagtgtggacttcgtagtacgggaacgggcccgtattccacaatccaccagacgaacaaacgccaaagtacttcagtgtatctaggaactaaagtacgaaacgagcccgtaggacgaacggccgaaggtaccgaccgggtccgtaagttaacttacgtgttgtagaagagacagtaagaaccgtaagggtgaacggttaaccgggtgggttgaagg

SEQ ID NO: 369489 - DNA, 559 bp, Homo sapiens
  misc_feature: GZ8MTXP01BW9XW.15.23.C01.1.454.CMB.2.raw
  modified_base (309)..(309): a, c, t, g, unknown or other
  modified_base (347)..(347): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctggagactctcctgtcgcccgcctctggactcacctttagagctattggatgagctgggtccnccaggctccgaggggagggctgggagtgggtgaccaanagtaaaggagagtggaatcaagaaaccactaatgtggactcgtgtgaacgggcattccaccatcctaccagacgacaacgccaaagtattcagtgtatctggacaaatgaacagcctggagacggccgaaggaccacgggcctgtacttacgtgttggtcgaagagacagtgaaccgtaagggtgaagttaaccggggtaaggggttgaagg

SEQ ID NO: 369490 - DNA, 612 bp, Homo sapiens
  misc_feature: GZ8MTXP01BAENO.15.23.C01.1.454.CMB.2.raw
  modified_base (307)..(307): a, c, t, g, unknown or other
  modified_base (346)..(346): a, c, t, g, unknown or other
  modified_base (414)..(414): a, c, t, g, unknown or other
  modified_base (450)..(450): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccggggggtccctgagactctcctgtgcccgcctctggactcacctttagagctattggatgagctgggtccncaggctccgaggggaagggctggagtggggtggaccaanataaaggaagatcggaatcaagaaacactaatgtggactcgtgtagaagggccattccacccattccnccaagacgaacaaacgtaccaaagaattcaaggttntatcgtagaactaaagtcgaaacagtccgtaggaagacggacccggaacgggacccgtaccgggcccggttaagttaacgttacgtggttaggtaggaacgagaccttagtaacggaaccgtaacgggtaggaacgggttaaaccggggtgggttaagaagg

SEQ ID NO: 369491 - DNA, 564 bp, Homo sapiens
  misc_feature: GZ8MTXP01A8IH0.15.23.C01.1.454.CMB.2.raw
  modified_base (307)..(307): a, c, t, g, unknown or other
  modified_base (346)..(346): a, c, t, g, unknown or other
  modified_base (450)..(450): a, c, t, g, unknown or other
  modified_base (492)..(492): a, c, t, g, unknown or other
  modified_base (508)..(508): a, c, t, g, unknown or other
  modified_base (513)..(513): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagagctattggatgagcgtgggtccnccaggctccgaggggagggctgggagtgggtggccaaanagtaaaggagagtggaagtcaagaaacactaaatgtggactcgtaggtgaacggggccgtattaccaccatcctaccagacgacaacgccaaagaacttcagtntatctaggacaaatcgaaacagcctgacgagcccgaggaccncgggcctgtattacgngttgngagagacagtgaacgtaacgggtgacgttaaaccggggtggggttgtaagg

SEQ ID NO: 369492 - DNA, 538 bp, Homo sapiens
  misc_feature: GZ8MTXP01D9GLX.15.23.C01.1.454.CMB.2.raw
  modified_base (266)..(266): a, c, t, g, unknown or other
  modified_base (341)..(341): a, c, t, g, unknown or other
  modified_base (368)..(368): a, c, t, g, unknown or other
  modified_base (374)..(374): a, c, t, g, unknown or other
  modified_base (439)..(439): a, c, t, g, unknown or other
  modified_base (460)..(460): a, c, t, g, unknown or other
  modified_base (499)..(499): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttctgtgctattttagaaggtgtccagtgcgaggagcagctggtggagtcgtgggggagcctgggtccaggcccgggggggtccctgagactctcctgtgcccgcctntggctcacctttagagctattggatgagctgggccgcaggctcgaggggaagggctgggagtggggtgaccaaanagtaaaggagatcggaatcaagaaacnctaaangtggactcgtagtggaagggccattcaccatctcaagagacaaacgccaaagtaattcgaagttntatcgtagaacaatacgaacngcgagagacgcgagacgacggcgtaagttattgtgttgngagagacagaagacgaaggagaggacggtaagggttgtg

SEQ ID NO: 369493 - DNA, 635 bp, Homo sapiens
  misc_feature: GZ8MTXP01EZPA5.15.23.C01.1.454.CMB.2.raw
  modified_base (203)..(203): a, c, t, g, unknown or other
  modified_base (489)..(489): a, c, t, g, unknown or other
  modified_base (570)..(570): a, c, t, g, unknown or other
  modified_base (586)..(586): a, c, t, g, unknown or other
  modified_base (607)..(607): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagagactcaccatggagttggggctgagcttgggttttccttgttgcttattttagaaggtgtccagtgcgaggagcagngtggtggagtcggtgggggagccgtggtccgagggccggggggtcctgagctctctgcgccgcctcgtggactctacctttagagtctagttggatgagcgtcggtcccgcgaggctcggaggggagggcgtgggaggtggggtcgaccaaagaaagtaaaggaagagtaggaagtacaaagaaacacgtaaagtgtggactcgtaggtacggaacgggtccgtattaccaacctatccgaccgaaggaacaacccgaaaccgactaaaagtactttacgaagttnttaactcgtagaactaaaagtcgaaactgccgtaggacgaccggtaccggaaggaccgtccggtcgttaagttaattcggngttaggagaagacganagtaacggaacgtaaggggtnaacgggttaacgggggttggttgtaacg

SEQ ID NO: 369494 - DNA, 599 bp, Homo sapiens
  misc_feature: GZ8MTXP01ERDDM.15.23.C01.1.454.CMB.2.raw
  modified_base (527)..(527): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccaggccgggggggtccctgagactctcctgtgccgcctctggactcacctttagagctattggatgagctgggtccgccaggctccgaggggaaggggctgggagtgggtgaccaacataaaggagagtaggaagtcaagaaacactaaatggtggactcgtggtgaaggggccgatttccacctatcctccagagacaaacgccaaagaacttcgagtagtatctagggactaaatgaacagcctaggaagacggccggaaggtaaccaccggggcccgttaaggttaactttaccgnggttggtaggaagaggcttagtaacggaacgtaaacgggtgaaggttaaacccgggggtggggtttgtaagg

SEQ ID NO: 369495 - DNA, 556 bp, Homo sapiens
  misc_feature: GZ8MTXP01D8HBL.15.23.C01.1.454.CMB.2.raw
  modified_base (310)..(310): a, c, t, g, unknown or other
  modified_base (338)..(338): a, c, t, g, unknown or other
  modified_base (345)..(345): a, c, t, g, unknown or other
  modified_base (364)..(364): a, c, t, g, unknown or other
  modified_base (410)..(410): a, c, t, g, unknown or other
  modified_base (415)..(415): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcgtgggggagccgtggtccgaggccggggggtccctgagctctcctgtcgcccgcctctggactcacctttagagctattggatgagctgggtccncaggctcgaggggagggctggagtgggngaccaanaataaaggagatggaagtnaagaaacactaatcgtggactcgtgtagaacgggcattcaccatcncaganacaacgcaagactcagtgtatctggactaaagtcgaacagcctagagaacgccgaggaccacggtccgtaagttacttcgtggttgtagaagacgcttagtgaaacgtaacgggtgaacgttaacggggtgggtttgaagg

SEQ ID NO: 369496 - DNA, 697 bp, Homo sapiens
  misc_feature: GZ8MTXP01CKSQB.15.23.C01.1.454.CMB.2.raw
  modified_base (320)..(320): a, c, t, g, unknown or other
  modified_base (364)..(364): a, c, t, g, unknown or other
  modified_base (603)..(603): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggaggcctgggtccgagggcccggggggtccctgagctctcctgtcgcccgcctctggacctctacctttagagctagttggatggacgcgtcgggtcccnccgagggcctccggaagggggaacgggggctggggaggtggggnggacccaaagaagtaaaaggagagtaggaatacaagaaacactaagttggtcggaacttcgtggtagaacggggtcccgtattcccgacctattccaccgagacgaacctaaacgccaaaggtacttacgagttagtattccgtagggacctaaaagtgaaaaccgcgtacccgtaggaacgacggcccggtaacggaaccgaacccggggtccgtttaagtaaacgtttccgttaggnggttaaagacggaagaccttaagttaacggaaaccgttaaaccggggttaaggtaaacgggttaaacccgggggttaagggggtttcgtaaggg

SEQ ID NO: 369497 - DNA, 574 bp, Homo sapiens
  misc_feature: GZ8MTXP01ECO4H.15.23.C01.1.454.CMB.2.raw
  modified_base (347)..(347): a, c, t, g, unknown or other
  modified_base (522)..(522): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtggggggagcctggtccaggccggggggtccctgagactctcctgtcgccgcctctggactcacctttagagctattggatgagctgggtccgcaggctccgaggggaaggggctgggagtgggtggccaaanaagtaaaggaagagtacggaagtcaagaaacactaaatgtggactcgtagtagaacgggccgattcaccatcacagacgacaaacgccaaagaattcagtgtaatctaggactaaagtgaacaggccctaggagaagcccgaaggacctaacgggccgttgttattactggttgngaagagacagtgaaacgtaacgggtgaaggttaaccggggtgggggttgaag

SEQ ID NO: 369498 - DNA, 607 bp, Homo sapiens
  misc_feature: GZ8MTXP01ADCHN.15.23.C01.1.454.CMB.2.raw
  modified_base (285)..(285): a, c, t, g, unknown or other
  modified_base (309)..(309): a, c, t, g, unknown or other
  modified_base (375)..(375): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccgaggccggggggtccctgagctctccgtgtcgccgcctctggactctacctttagngctagttggatgagctgggtcccncaggcctcgagggagggctgggagtgggtgaccaagaagtaaaggagagtaggaagtcaagaaacngtaaatggtggactcgtgtaggacgggctattccacctatcctaccaaggacgaacaaaccgtccaaaagtacttcgagtgtaatccgtagggactaaaagtcgaaacgacgccgaggacgacgacccggtaggaccgaccggtccgttaagtacgttacgtggagtaggaagacgacaggtcgtaaaccgaagggtacggtaaacggttacggggtaagggtttcgaaggg

SEQ ID NO: 369499 - DNA, 675 bp, Homo sapiens
  misc_feature: GZ8MTXP01EEXJD.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtggaggtcgtggggggagccgtgggtccagggccggggggtccctgagctctcctgtcgcccgcctctggactctacttagagctattggatgacgcgtgggtccccgcgaggcctccgagggggaagggggcgtggggaggtgggggtcgaccaaagaagtaaaaggaagagtagggaaagtacaagaaaccacgttaatggtggactcgtaggtaggaaacgggggccctaattcccacctactcctacccgaagaacggaaaccaaaccggaacctaaacgtaaactttacgagttagttaatccgtaggaactaaaagtagaaaccgagacccgtaggaagaacggaccggtaacggaaccgaccgggtccgttaaggttaacttacgtggttaggtaggaagttaacggacttagtaagaacgtaacgggtagaacgggttaaccggggtaaggggttgtaagg

SEQ ID NO: 369500 - DNA, 728 bp, Homo sapiens
  misc_feature: GZ8MTXP01A7VK8.15.23.C01.1.454.CMB.2.raw
  modified_base (316)..(316): a, c, t, g, unknown or other
  modified_base (347)..(347): a, c, t, g, unknown or other
  modified_base (354)..(354): a, c, t, g, unknown or other
  modified_base (382)..(382): a, c, t, g, unknown or other
tcagtctacgtagccacgaccggtgctcgatttagtacacgtgattagggattgggaggtctcagagaggagccttagccctggactccaaggcctttccacttgttgatcagcactgagcacagaggactcaccatggagttggggctgagcttgggttttccttgttgctattttagaaggtgtccagtgcgaggagcagctggtggagtcgtgggggagccgtgggtccagggcccggggggtccctgagactctcctgtcgcccgcctctcggactcacctttagagctagttggatggagcgtgggtcccncaggctccggaggggagggctgggagtgggngccaaanagtaaaggagatagggaatcaagaaacncgtaaagtggtcggactcgtaggtaggaacggggtccgtaatttccgaaccctatccctaccgaaggaacgaaacccgaaaccggaccctaaaaggtaactttaccgaaggttcgtaaacttccgttaggggaaacctaaaagttaccgaaaccgacggtaccccgtaggaacggaacggccccgggtaaacgggacccgtaaacccggggtccgttaaggttaacgttttaaccggtggttacggttagggaacggaaggttaaccgaaggtaacggaaacccggtaaacggggttaggtaaaccgggttaaacccggggggtaagggggtttaacggttaaggg

SEQ ID NO: 369501 - DNA, 654 bp, Homo sapiens
  misc_feature: GZ8MTXP01BD3CR.15.23.C01.1.454.CMB.2.raw
  modified_base (313)..(313): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggagccgtggtccagggccggggggtccctgagactctcctgtcgcccgcctcgtggactctacctttagagctagttggatgagctgggtcccnccaggctccgaggggagggctgggagtgggtgaccaaagagtaaaggagagtaggaagtcaagaaacactaagtgtggactcgtgtaggaacgggccgattccaccatccaccagacgaacaaaccgccaaagtacttcgaagttgtaatctaggacaaagtcgaaacacgtacccgtaggaacgaccggccggtaaacgggaaccgaccggggtcccgtaaggttaacgtttaccgtgggttagtaggaacggaagaccgttagttaacggaaaaccggtaaacggggttacggtaaacggttaaaccccggggggttaagggggttttaacgtaagggg

SEQ ID NO: 369502 - DNA, 588 bp, Homo sapiens
  misc_feature: GZ8MTXP01BNKSV.15.23.C01.1.454.CMB.2.raw
  modified_base (311)..(311): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggtgccgtggtccagggcccggggggtccctggagactctcctgtcgcccgcctctggactcacctttagagctattggatgagcgtgggtccnccaggctcgaggggaggctggagtgggtgccaagataaaggagagtggaatcaagaaacactaatggtggactcgtgtgaagggccgattccaccatcctcagacgacaaacgccaaagtattcggagtatcgtagactaaatcgaaacaggcctggagacgacccgggaaggaccgacgggtccgttgttaacgttacgttggtggttggaagtacgacagttcgaacgaacgggttggaaacggtaaccgggggagggggtttgaaggtttcggg

SEQ ID NO: 369503 - DNA, 560 bp, Homo sapiens
  misc_feature: GZ8MTXP01DI4BD.15.23.C01.1.454.CMB.2.raw
  modified_base (448)..(448): a, c, t, g, unknown or other
  modified_base (503)..(503): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctatttttagaaggtgtccagtgcgaggagcagctggtggagtcgtgggggaggcctggtccaggcccgggggggtccctgagactctcctgtgcccgcctctggactcacctttagagctattggatgagctgggtcccgccaggctccgaggggaaggggctgggagtgggtggtcaaacagtaaaaggagagtaggaagtcaagaaacactaatgtggactcgtgtgaagggccgattcaccatctcagagacaacgcaaagattcagtgtatcgnggactaaagtgaacagcctaggacgacgcccggaaggaccacgggccgttaagtnttacgtgttgtgagagcagtcgaacgaacggtgaacgttaccgggtggggttgtaag

SEQ ID NO: 369504 - DNA, 643 bp, Homo sapiens
  misc_feature: GZ8MTXP01EROMS.15.23.C01.1.454.CMB.2.raw
  modified_base (511)..(511): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccgaggccggggggtccctgagactctcctgtcgccgcctctcggactctacctttagagctattggatgagtcgtgggtcccgccgaggctccggagggggaacggggctgggaggtgggtggaccaaacgaagtaaaagggaagagtaggaacgtacgaaagaaaacactaaagtggtcggacttcgtggtaggaacggggtcccattccaacctattccaccgaaggacaacaaaccgcctaaagacttcagtgtaatcgtaggaactaaagtcgaaacgngtaccctggacggaaccgccggaaggacccgaccgggtcgttaaggttaaactttcggtgttaggtggaagacgaacttgtaacggaacgtaacggggtagaaccggttaacgggggtggggttaagtaagg

SEQ ID NO: 369505 - DNA, 573 bp, Homo sapiens
  misc_feature: GZ8MTXP01AZR3B.15.23.C01.1.454.CMB.2.raw
  modified_base (468)..(468): a, c, t, g, unknown or other
  modified_base (486)..(486): a, c, t, g, unknown or other
  modified_base (490)..(490): a, c, t, g, unknown or other
  modified_base (525)..(525): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccaggccggggggtccctgagctctcctgtcgccgcctctggactcacctttagagctattggatgagcgtgggtccgccaggctccgaggggaggggcgtgggaggtgggtcggaccaaacgagtaaaaggaagagtagggaaagtacgaagaaaacacgtaagtggtgggactcgtggtaggaacggggccgtattccgacctatcctaccagacgaacaacgaccaagtaactcagtntatctggacaaatgaacngccngagacgcgaggacgacggcgtgtattacgtgttgngagacgacagtaagacgaacggtggaacggttacgggtgggttgtaag

SEQ ID NO: 369506 - DNA, 753 bp, Homo sapiens
  misc_feature: GZ8MTXP01D7SPI.15.23.C01.1.454.CMB.2.raw
  modified_base (364)..(364): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcgtggggggaggccgtgggtccgagggcccggggggtccctgagactctcctgtgcccgcctctggactcacctttagagctagttggatgagcgtgggtcccgcgaggctccggagggggaaggggctgggaggtgggtcggaccaaanagtaaaggaagagtaggaagtacaagaaaccacgttaatggtggactcgtaggtaggaaacggggtcccgtaagttccaaccctattcccgtacccgaaagggaaacgaaacccgaaaaccgacccgtaaaaaggttaaactttaccgaaaggtttacgttaaacgttaccttaaggggaaccctaaaaagttacgggaaaacccaggtaccccgttaggaaacggaaaccggcccggtaaaggggaccccgtaaccgggggcccgtttaagggtttactttacggtggtttagggtagtaaacggaacggttaccaggttaacggaaaccgtaaccggggtttaggaaaccgggttaaaccgggggtaagggggttttaacgtaaggg

SEQ ID NO: 369507 - DNA, 660 bp, Homo sapiens
  misc_feature: GZ8MTXP01D4VT1.15.23.C01.1.454.CMB.2.raw
  modified_base (242)..(242): a, c, t, g, unknown or other
  modified_base (305)..(305): a, c, t, g, unknown or other
  modified_base (630)..(630): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttcctgttgctattttagaaggtgtccagtgcgaggagcagctggtggagtcgtgggggagcctggtccaggccggggggtccngagctctccgtgtcgcccgctgtggactctacttagcgctagttggatgacgtcgtcggtccncgaggctacggaggggtaacggtcgtagggaggtcgggtacgaccgaaacgagtaaaggagtagtacggaacgtacgaagtaaacctacgtaagtcgtcggtacttcggtaggtacggaacgggtcctaagttcccgaactagtttccaccgaagtaccgaacctaaaccgtcctaaaaggtacttccgagttacgtacgttcgtaggaactaaacgttcgggaaactcggtaccgtaggaacgtaccgtaccggagtaccgtacggtcttaagtaacgttcgagttacgtcgaagttcgcaaggttcggaacgtaacggggttnaacgggttaaccgggtgggttaactaaggg

SEQ ID NO: 369508 - DNA, 608 bp, Homo sapiens
  misc_feature: GZ8MTXP01AO8XF.15.23.C01.1.454.CMB.2.raw
  modified_base (478)..(478): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttctgtgctatttagaaggtgtccagtgcgaggagcagctggtggagtcgtgggggaggccgtggtccgagggcccggggggtccctgagctctcctgtcgccgcctctggactcacctttagagctagttggatggagcgtgggtcccgccgaggcctccgagggggaacggggctgggagtggggtggaccaaagagtaaaagggaagagtaggaaagtcaagaaacactaaagtgtggacctgtaggtaggaacggggcctattacccacctattaccaccaaggacgaacaaccgaccaaagtaacttcgaagttntactcgagaactaaagtacgaaacgcgccgtaggacggacggtaccggaacggacgaccgggtcgtaagttaacgttgtggagtagagagacagtaaggacgaaggtagtacggttagggtgggttgaag

SEQ ID NO: 369509 - DNA, 567 bp, Homo sapiens
  misc_feature: GZ8MTXP01AJDZE.15.23.C01.1.454.CMB.2.raw
  modified_base (309)..(309): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccgggggggtccctgagactctcctgtcgccgcctctggactcacctttagagctattggatgagcgtgggtccnccaggctccgaggggagggctgggagtgggtggccaaacgagtaaagggaagtatagggaatcaagaaaccagtaaatggtggactcgtggtaggaacggggcctattccaccatcctaccagacgacaacgcctaaagattacagtgtatcgtaggacaaagtgaaaccgagccgtgagacgacgacggacgacggccgtgtagttactgttgtgagagagagtgagaacggagacgttacggtaagggttgtaagg

SEQ ID NO: 369510 - DNA, 566 bp, Homo sapiens
  misc_feature: GZ8MTXP01CSQN4.15.23.C01.1.454.CMB.2.raw
  modified_base (350)..(350): a, c, t, g, unknown or other
  modified_base (359)..(359): a, c, t, g, unknown or other
  modified_base (561)..(561): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtgggtccgaggccgggggggtccctggagactctcctgtcgccgcctctggactcacctttagagctattggatgagcgtggtccgccaggctccgaggggaagggctgggagtgggtgaccaanataaagganataggaatcaagaaacactaatgtggactcgtagtaggaagggccgtattcaacctatcctaccaagacgaacaacgaccaaagaacttcagtgtatctaggacaaatgaaacagcctgagacgcgaaggaccacggccgtgtattacgtgttgtagagagcagtggaactaacgggtgaagttaaccggggtaaggggttntaagg

SEQ ID NO: 369511 - DNA, 545 bp, Homo sapiens
  misc_feature: GZ8MTXP01DK8AR.15.23.C01.1.454.CMB.2.raw
  modified_base (350)..(350): a, c, t, g, unknown or other
  modified_base (461)..(461): a, c, t, g, unknown or other
  modified_base (501)..(501): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggggggaggcctgggtccaggccgggggggtccctgagactctcctgtgccgcctctggactcacctttagagctattggatgagctgggtcccgccaggctccgaggggaaggggctgggagtgggtggccaaanataaaggagatggaagtcagaaacactaatgtggactcgtgtgaaggggccgattcaccatctccagagacaacgccaaagaattcagtgtaatctggacaaatagaaacngcctgagagccgaggacacggccgtgtattactgttgtgngagcagtgaacaacgggtgagttaccgggtaaggggttgtaagg

SEQ ID NO: 369512 - DNA, 598 bp, Homo sapiens
  misc_feature: GZ8MTXP01AE17N.15.23.C01.1.454.CMB.2.raw
  modified_base (289)..(289): a, c, t, g, unknown or other
  modified_base (317)..(317): a, c, t, g, unknown or other
  modified_base (400)..(400): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggagcctggtccagggcccggggggtccctgagactctcctgtcgcccgcctctggactctacctttagngcttagttggatggagtcgtgggtcccnccgaggctccggagggggaggggctgggaggtgggtggacccaaagaagtaaaagggaagagtaggaaagtcaaagaaaaccntaaatggtggtacctgtaggtaggaacggggtccattcccgacccatcctaccgagacgacaaccgacaaagtattcagtgtatctggacaaatgaacagcctaggacgagccggaggtaccacgggtccgtaatagttactggttgagaagagacagtcgaacgaagggtgacggttaaacgggtggggttgtaagg

SEQ ID NO: 369513 - DNA, 545 bp, Homo sapiens
  misc_feature: GZ8MTXP01CFGTI.15.23.C01.1.454.CMB.2.raw
  modified_base (308)..(308): a, c, t, g, unknown or other
  modified_base (352)..(352): a, c, t, g, unknown or other
  modified_base (363)..(363): a, c, t, g, unknown or other
  modified_base (449)..(449): a, c, t, g, unknown or other
  modified_base (456)..(456): a, c, t, g, unknown or other
  modified_base (461)..(461): a, c, t, g, unknown or other
  modified_base (464)..(464): a, c, t, g, unknown or other
  modified_base (466)..(466): a, c, t, g, unknown or other
  modified_base (475)..(475): a, c, t, g, unknown or other
  modified_base (515)..(515): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccaggccgggggggtccctgagactctcctgtcgcccgcctctggactcacctttagagctattggatgagcgtgggtccnccaggcctccgagggggaaggggctgggagtgggtggaccaaanaataaaagganatacggaagtcaagaaaaccataaatgtggacctgtagtgaaacgggccgattccaattatcacagagacaaacgcctaaagattnatgtatntaganaananaacacgcgngagacgacgacgacgacgcgtgtattatgttgtagagagnagaagacgaacgagagacggtaaggttgtg

SEQ ID NO: 369514 - DNA, 543 bp, Homo sapiens
  misc_feature: GZ8MTXP01AC8Q2.15.23.C01.1.454.CMB.2.raw
  modified_base (309)..(309): a, c, t, g, unknown or other
  modified_base (387)..(387): a, c, t, g, unknown or other
  modified_base (416)..(416): a, c, t, g, unknown or other
  modified_base (421)..(421): a, c, t, g, unknown or other
  modified_base (435)..(435): a, c, t, g, unknown or other
  modified_base (439)..(439): a, c, t, g, unknown or other
  modified_base (445)..(445): a, c, t, g, unknown or other
  modified_base (449)..(449): a, c, t, g, unknown or other
  modified_base (498)..(498): a, c, t, g, unknown or other
  modified_base (507)..(507): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggttttcgtgttaggctatttagaaggtgtccagtgcgaggagcagctggtggagtcgtgggggagcctgggtccgaggccgggggggtccctgagactctcctgtgccgcctctggactctacctttagagctattggatgagctgggtcccnccgaggctccgaggggagggctgggaggtgggtggaccaagaagtaaaggaagataccggaatcaagaaacataatgnggactgtgtagaagggccatccacagtcncaganacacgactaagatnagtntactanaganaatagacgacgcgagagacgacggacggacgacggcgtgtagttagtgngtgtagagnagaagacgaacgagtacggttacgggtaaggttgtg

SEQ ID NO: 369515 - DNA, 742 bp, Homo sapiens
  misc_feature: GZ8MTXP01EZB2F.15.23.C01.1.454.CMB.2.raw
  modified_base (664)..(664): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggaggccgtgggtccgagggcccggggggtccctggagactctcctgtcgcccgcctcgtggactctacctttagagtctattggatgagcgtcgggtcccgccgaggcctccggagggggacgggggtctgggaggtggggtcgaccaaagaagtaaaaggaagagtagggaaagtacaaagaaacacgttaaagtggtcggtactcgtagggtagggaaacggggcccgtaatttcccgaaccctagttcccctaacccgaaaggaacgaaacccgaaaaccggcccctaaaaaaggtaaccttttccgaaagtttagtttaaactcccgttaaggggaaaccttaaaaagttcggaaacccgaaggtccccgttaagggaacggaaacccgggaccgggtaaggacccggaaccggggtccgttaagttaacttttacgggnggttacgtacgaagttagacttagtaacggtaaccggtaacgggtaggaaacgggttaaccgggggtggggtttgaag

SEQ ID NO: 369516 - DNA, 604 bp, Homo sapiens
  misc_feature: GZ8MTXP01CJD2O.15.23.C01.1.454.CMB.2.raw
  modified_base (316)..(316): a, c, t, g, unknown or other
  modified_base (425)..(425): a, c, t, g, unknown or other
  modified_base (555)..(555): a, c, t, g, unknown or other
  modified_base (595)..(595): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttcctgttgctattttagagtgtccagtgcgaggagcagctggtggagtcgtgggggaggcctgggtccgagggccgggggggtccctggagacctctcctgtcgcccgcctctggacctctaccctttagagctattggatggagcgtgggtcccnccgaggcctccgagggggaaggggctgggaggtgggaatcgggaccaaacgaagtaaaagggaagaacgtaggaaagtcaaaggaaaacacttaatgtaggactcgtgnggaagggccaattccactatctccaagacgaacaaacgcctaaagaattcaagttgtaatcgtgacaaatcgaaacagcctaggagacgccggtaggaccgtcgggaaccgtagttattacgttgttagngagttagacaagtcgaacaacgggtgaacgtaaccggggnggggttaag

SEQ ID NO: 369517 - DNA, 627 bp, Homo sapiens
  misc_feature: GZ8MTXP01CFZHO.15.23.C01.1.454.CMB.2.raw
  modified_base (316)..(316): a, c, t, g, unknown or other
  modified_base (322)..(322): a, c, t, g, unknown or other
  modified_base (333)..(334): a, c, t, g, unknown or other
  modified_base (350)..(350): a, c, t, g, unknown or other
  modified_base (359)..(359): a, c, t, g, unknown or other
  modified_base (466)..(466): a, c, t, g, unknown or other
  modified_base (496)..(496): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtcagtgcgaggagcagcgtggtggagtcggtgggggaggccgtgggtccgagggccggggggtccctggagactctccgtgtcgccgcctcgtggactctactttagagctattggatgagcgtggtccncgagcncgaggggaggnnggagtgggcgacaaanagaaagganagtacgaagtcaaagaaacagtaatggtcgactcgtaggtaggaacgggccgtattcccgaactatccgcaaaggaacaccgaaacgcaaaagtacttacgaagttntattacagggaaactaaaagtcgaaaccgngtacgaggaacggacgaccggtaaggaccgtaccggtcgttaagttacgttagtggttaggtacgaacgacgacaggtaaccaaacgggtaacggtaggtaaccgggttaacgggggtaagggttgtaacg

SEQ ID NO: 369518 - DNA, 560 bp, Homo sapiens
  misc_feature: GZ8MTXP01D21DC.15.23.C01.1.454.CMB.2.raw
  modified_base (305)..(305): a, c, t, g, unknown or other
  modified_base (467)..(467): a, c, t, g, unknown or other
  modified_base (499)..(499): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctggggggagcctggtccaggccggggggtccctgagactctcctgtgcccgcctctggactcacctttagagctattggatgagctgggtccnccaggctccgagggagggctgggagtgggtgccaacataaaggagagtacggaagtcaagaaacactaatggtggactcgtgtaggaagggccctagttccacctatcctccaagagaacaaacgccaaagacttcagtgtaatctaggacaaatcgaaacngtccagagagccggagacgaccggcgtaagtnttacgtggttgtgacgagcagtgaacgaacgggtgaggttaaccgggtggggttgtaacgg

SEQ ID NO: 369519 - DNA, 687 bp, Homo sapiens
  misc_feature: GZ8MTXP01A526F.15.23.C01.1.454.CMB.2.raw
  modified_base (289)..(289): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagagactcaccatggagttgggctgagcttgggttttccttgttgcttattttagaggtgtccagtgcgaggagcagcgtggtggagtcggtgggggagccgtggtccgagggcccggggggtcctgagcctctcctgtcgcccgctctggactctacctttaganctagttggatggagcgtcgggtcccgccgaggcctaccggagggggaacggggcgtgggaggtggggtacggaccaaagaagtaaaaggagagtaggaagtacaaagaaacactaagtggtggacttcgtaggttaggaacgggccgtattccgaacctatcccgtaccgaaaggaaccgaaccgaaacccgacctaaagtaactttaccgagttacgttaactccgtagggaactaaaagtacgaaacccagtacccgaggaacggacggcccggaaacgggtaccgacccgggtccgttaagtttaactttcggtggttggaggtaagaagacaggtaacggaaacggtaaccgggtaggaaacgggttaaccgggggtggggttaacgttaaggg

SEQ ID NO: 369520 - DNA, 635 bp, Homo sapiens
  misc_feature: GZ8MTXP01DVDLT.15.23.C01.1.454.CMB.2.raw
  modified_base (315)..(315): a, c, t, g, unknown or other
  modified_base (357)..(357): a, c, t, g, unknown or other
  modified_base (519)..(519): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggagccgtgggtccgaggccgggggggtccctgagtactctcctgtcgcccgcctctggactctacctttagtagctattggatgagcgtgggtccnccaggcctccgaaggggagggctgggagtggggtgaccaaanaagtaaaggagagtggaaagtacaagaaacacttaaagtggtggactcgtagggtaggaacggggccgtaattcccaaccctagttcctaccgaaggaacgaacccaaaaccggccaaaagtaacttcaaggttgtaatcgtaaggactaaaagtcgaaacngccctaggaacgaaccggtcccggaagggacccgacgggccgttgtaactttacgtggttagtagaggacgacagtcgaaacgtaacggtgaacggttaacggggtgggttgaagg

SEQ ID NO: 369521 - DNA, 615 bp, Homo sapiens
  misc_feature: GZ8MTXP01D5XJI.15.23.C01.1.454.CMB.2.raw
  modified_base (308)..(308): a, c, t, g, unknown or other
  modified_base (543)..(543): a, c, t, g, unknown or other
tcagtctacgtagccacgaccggtgctcgatttagtacacgtgattagggattgggggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggaggcctggtccgaggccggggggtccctgagactctcctgtcgccgcctctggactcacctttagagctattggatgagctgggtccncaggctcgaggggagggctggagtgggtgccaagagtaaaggagagtaggaagtcaagaaaccataagtgtagggaacttcgtgggtagggaaacggggcccctaagttccaaccctatccgtaccaagacgaacaaacgaccaaagaacttcaagttgtaatcgtagaacctaaaagtcggaaacacgcctaggagacgaccggaggaaccgacgggtccgtgtaaactttcgnggtaggttagaagtagaacttgttacggaaccgaaaggtgaaacggtaccggggaggggttgaagtttcggg

SEQ ID NO: 369522 - DNA, 731 bp, Homo sapiens
  misc_feature: GZ8MTXP01EUBW3.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagtcgttgggttttccttgttgcttattttagaaggtgtccagtgcgaggagcagcgtggtggagtcgtgggggagccgtcggtccgagggcccggggggtccctggacgtacctcctcccgtgtcgcccgtccttcgtcggactctaccttttaggacgtcttagttggatggacgtcgtcgggtcccgccgagggcctaccggagggggacgggggcgtgggaggtggggtacggaccaaagaagtaaaggaagagtaggaagtacaaagaaacactaaagtggtaacggtacttcggtaggtacgggaacggggtaccctagtttacccaaccgtattcccgaccgaaggaacgtaacaaaaccggaccaaaagttaacttacgaaggttacttaacgtcgtacgggaaactaaaagtcggaaacctaggcctaggaacggacggacccggtaacggaccgtaccggggtccgtttaagttaactttggtagggtttgtaaggaagttaacggacaagtaacgggaaaccgtaaggggttaggaaaccgggttaaccgggggtgggggttttcaagggg

SEQ ID NO: 369523 - DNA, 643 bp, Homo sapiens
  misc_feature: GZ8MTXP01E3BZY.15.23.C01.1.454.CMB.2.raw
  modified_base (530)..(530): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggagcctggtccaggccgggggggtccctgagactctcctgtgcccgcctctggactctacctttagagctattggatggagcgtgggtcccgccagggcctccggaagggggaaggggctgggaggttgggggtggaccaaagataaaagggaagagtaggaaagtcaaagaaacacgtaaatgtggactcgtaggtaggaacggggcccgtaattcccaaccctatacctacccgaaggaacgaaccaaaccggaccaaaaggtaaacttcgagttagtaactcctaaggggaacaaaatcggaaaaccncgaccgaggaaggacgaccggaacggacgaccgggtcgttaagtacgttacgtggttgagaagacgacagtaagaacgtaagggtacgtaacggttaacggggtgggttgaag

SEQ ID NO: 369524 - DNA, 663 bp, Homo sapiens
  misc_feature: GZ8MTXP01EUFGV.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggagccgtgggtccgagggccggggggtccctgacgctctcctgtcgcccgcctcgtcggactctacctttagagcttagttggatggagtcgtcgggtcccgccgaggcctaccggagggggaagggggcgtaggggaggtggggtacggaccaaacgaagtaaaaggaagagtaggaagtacaagaaactacgtaagtggtgtactcgtaggtacggaacgggtccgtattccaaccctatcctaccgaagaacaaccaaaccgacctaaagtaacttcgaagttgtaatccgtaggaactaaagtacgaaacagcctaggacgacggacccggaaggtaccgaccgggtcttaagttaacgttacgtggttagaggaagttacgaacttagtaacgaaaccggtaacggtggaacggttaaacggggtgggtttaagaagg

SEQ ID NO: 369525 - DNA, 616 bp, Homo sapiens
  misc_feature: GZ8MTXP01AFDO6.15.23.C01.1.454.CMB.2.raw
  modified_base (307)..(307): a, c, t, g, unknown or other
  modified_base (351)..(351): a, c, t, g, unknown or other
  modified_base (381)..(381): a, c, t, g, unknown or other
  modified_base (472)..(472): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttcctgttgctattttagaaggtgtccagtgcgaggagcagctgggtggagtcgtgggggagcctgggtccaggccgggggggtccctgagactctcctgtgcccgcctctggactcacctttagagctattggatgagctgggtccnccaggcctccgaggggaaggggctgggagtggggtggcccaaanagtaaaggagataccggaatcaagaaaccnttaatggtggactcgtggtaggaacgggggccattccacccattccaccaaggacgaacaaaccggcctaaaaggtaacttcaagggtttntactcgtaggaactaaagtcgaaaccgcgtccgaggaagaccggaccggagggacctccgggtcgttaagttaacgttgtggttagagaaccgagacttagtaacgaaccgtaacgggtgaacgggttacggggtgggttgaag

SEQ ID NO: 369526 - DNA, 663 bp, Homo sapiens
  misc_feature: GZ8MTXP01E05IG.15.23.C01.1.454.CMB.2.raw
  modified_base (519)..(519): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgaggcttgggttttccttgttgcttattttagaaggtgtccagtgcgaggagcagctggtggagtcgtgggggagcctggtccaggccggggggtcctgagctctcctgtcgcccgcctctggactctacctttagagctattggatggagtcgtcgggtcccgccgagggcctaccggaagggggaacgggggtcgtgggggaggtgggggtacggaccaaacgaagtaaaagggaagagtagggaaagtacaaaggaaaaccactaaagtggtcggtacctcgtagggtaggaaacggggtccgtaattcccaacctatcctaccgaagaacgaaccgaaaccggaccaaagtaaacttcgaaggttntaactcgtaggaactaaaagtcgaaaaccgtgacccgtaggaacggacgaccggaaggtaccgacggtcgttaatacgttagtgttgacgagacgacagtaagaacgtaacggtaggaacggttacggggtaagggttgtaagg

SEQ ID NO: 369527 - DNA, 629 bp, Homo sapiens
  misc_feature: GZ8MTXP01D9B07.15.23.C01.1.454.CMB.2.raw
  modified_base (490)..(490): a, c, t, g, unknown or other
  modified_base (500)..(500): a, c, t, g, unknown or other
  modified_base (510)..(510): a, c, t, g, unknown or other
  modified_base (614)..(614): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctgggtggagtcgtgggggaggccgtgggtccgagggcccggggggtccctggacgactcctcctgtcgcccgcctcgtcggactctacctttagagctagttggatgagcgtcgggtcccgccagggcctccggagggggaaggggcgtgggaggtggggtggaccaaagaagtaaaagggaagagtaggaaagtacaagaaacactaatggtggactcgtggtagaacgggccgtattaccacctatcctaccgaagacgaaccaaacgccaaagtacttcaagtntatcaggaanaaatgaaacngccgtagagacgaccggaggaccacggggtcctaagtacttacgtggttagaggaagaacgacagtcggaaacgtaacggggttgaaacgggttaaccgggggnggggttttgaacggg

SEQ ID NO: 369528 - DNA, 659 bp, Homo sapiens
  misc_feature: GZ8MTXP01BO7OE.15.23.C01.1.454.CMB.2.raw
  modified_base (194)..(194): a, c, t, g, unknown or other
  modified_base (590)..(590): a, c, t, g, unknown or other
tcagtctacgtagccacgaccggtgctcgatttagtacacgtgattagggattgggaggtctacagagaggagccttagccctggactccaaggcctttccacttggtgatcagcactgagcacagaggactcacatggagttggggctgagcttgggttttccttgttgcttattttagaaggtgtccagtgngaggagcagcgtggtggaggtcgtgggggagccgtggtccgacgggtcccggggggtccctggacgtacttcctccgtgtcgcccgtctgtggacctctacctttagacgctagttggatggagcgtgggtcccgcgagggcctccggaagggggaacggggctaggggaggtggggtacgaccaaagaagtaaaaggaagagtagggaaagtacaaagaaactactaagtggtcggacctgtggtacggaacgggcctattaccacctatcctaccgaagaacaacgaaacgaccaaaggtacttcgaaggttctaatctagggaaactaaagtacggaaacctggccgtggaacgtacggccgaaggtactaccgggcgtttaatacgtttagngttggaagagggaagacttaggtaacgaacgtaagggtacgtaacggttacggggtaaggttcgtaagg

SEQ ID NO: 369529 - DNA, 696 bp, Homo sapiens
  misc_feature: GZ8MTXP01DG3UA.15.23.C01.1.454.CMB.2.raw
  modified_base (288)..(288): a, c, t, g, unknown or other
  modified_base (606)..(606): a, c, t, g, unknown or other
  modified_base (632)..(632): a, c, t, g, unknown or other
  modified_base (686)..(686): a, c, t, g, unknown or other
tcagtctacgtagccacgaccggtgctcgatttagtacacgtgattagggattgggggtctcagagaggagccttagccctggactccaaggcctttccacttggtgatcagcactgagcacagaggactcaccatggagttgggctgagcttgggttttccttgttgcttattttagaaggtgtccagtgcgaggagcagcgtggtggagtcgtgggggagccgtggtccgacggccggggggtccctgagctctcctgtcgccgcctcgtggactctacctttagngctatggatgagcgtcgggtccgcgaggctaccgagggggagggctggagtgggtgaccaagagtaaaggagagtaggaacgtacaaagaaacactataggtaggaacttcgtggtacgggaacggggtcccgtattccgaaccctatccgtacccaggaacgaaacccgaaacgaacccgtaaaaggtaactttacgaaggtttacgtaagtcgttacggaaactaaaaacgttcgaaaaaccgcggtaccctaggaacggacggaaccccgggaagggaccccgtaacgggtcccgtttaagttaaccgtttaagngggttagttaggaaagacggttaacncggttagaaaccggtaacgggtgtaaacgggtaaccgggggttagggtttaagnggtttaaggg

SEQ ID NO: 369530 - DNA, 810 bp, Homo sapiens
  misc_feature: GZ8MTXP01EGGK7.15.23.C01.1.454.CMB.2.raw
  modified_base (252)..(252): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgcttattttagaaggtgtccagtgcgaggagcagcgtggtggagtcgtggggggagccgtgggtccgagggcccggggggtcccngacgactctcctgtcgcccgcctctggactcacctttagagctattggatgagtcgtcgggtcccgccgagggcctaccggaagggggaaggggcgtggggaggttgggggtacggacccaaaagaagttaaaagggaagagtacgggaaacgtacgaaaaggaaaacctacgttaaaagttgggttaacggggaaacctttccgggttagggttacggggaaaacgggggtcccccgtaaattttaccccgaaacccgtacgtttaccctaacccgaaagggaaacggaaacccaaaaacccggaccctaaaaaggtaactttaccgaaggtttagttaaacttccgttagggaaacctaaaagttacggaaaacctaggtcccgtaggaaacgggaacggtaccccgggtaaagggaacccgtaacccgggcccgtttaagttaacgtttacggtggtttggaaggaaaggagttaccgttaagttaacgggaaacccgtaaaggggtttcggaaaacgggttaaaccgggggtttaagggggtttcgtaaagggg

SEQ ID NO: 369531 - DNA, 653 bp, Homo sapiens
  misc_feature: GZ8MTXP01BWLL3.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttcctgttgctattttagaaggtgtccagtgcgaggagcagctggtggagtcgtgggggagcctgggtccaggccggggggtccctgagctctcctgtcgccgcctctggactcacctttagagctattggatgagcgtgggtcccgccaggctccgagggggaagggctgggagtgggtggaccaaagaagtaaaggagagtaggaagtacaagaaacactaaatggtggactcgtggtagggaaacggggtcccgtaaattcccaaccctattcccacccgaaaggaaccgaaccaaaacccggccctaaaaggtaactttccgaaagtttgtaaattcccgttaggggaactaaaaagttcggaaaaccaggccccgtaggaaggaacgcccggtaaagggaccctaccgggccgttaaggttaacttacgtggttggtagaggttacgacagtggaactaacgggtgagttaaccggggtggggttgaag

SEQ ID NO: 369532 - DNA, 573 bp, Homo sapiens
  misc_feature: GZ8MTXP01AOUJE.15.23.C01.1.454.CMB.2.raw
  modified_base (392)..(392): a, c, t, g, unknown or other
  modified_base (433)..(433): a, c, t, g, unknown or other
  modified_base (441)..(441): a, c, t, g, unknown or other
  modified_base (486)..(486): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctgagactctcctgtgcccgcctctggacctcacctttagagctattggatgagcgtgggtcccgccaggctccgagggggaggggctgggagtgggtggaccaaacgaagtaaaagggaagataggggaaactcaaggaaaaccnctaaagtgtggactcgtgtagaagggccattcacctatccncagacganaacgcaaagattcagtgtatcgtggacaaagtagaacgacgccgngacgagaccggacggacgaccggcgtcgtattactgttgtgagagacagtaagacgaacggagacgaaccggtaagggttggtaagg

SEQ ID NO: 369533 - DNA, 651 bp, Homo sapiens
  misc_feature: GZ8MTXP01A0YYS.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggaggcctgttccgaggccgggggggtccctgagactctcctgtgcccgcctctggactcacctttagagctattggatgagctgggtcccgcaggctccgaggggagggctgggagtgggtggccaagagtaaaggagatcgggaagtcaagaaacactaaatggtggacctgtggtgaacggggccaatttccaaccctatcctcccaaggacgaaccaaaccggaccaaaggtaactttccgaagtggttaatccgtagggacaaaatgaaacccgagaccctggaacgaacggcccgggtaaggaccaccgggggcccgttaaggttaatttaacctgggttagttaggaacggacgaacgataacgggaaacgaaaccggggttgaaaaccgggttaacccgggggtaaggggggttttaagtaaggg

SEQ ID NO: 369534 - DNA, 646 bp, Homo sapiens
  misc_feature: GZ8MTXP01BBWI4.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccgaggccggggggtccctgagactctcctgtcgccgcctctggactcacctttagagctattggatgagctgggtcccgccaggctccgaggggaaggggctgggagtgggtggaccaaacgagtaaaaggaagagtaggaaagtcaaggaaaacactaaagtggtgggaaccttcgtagggtaggaacggggcccgtaatttcccaccctatcctaccgaaggaacgaacgaaaccgaccaaagtaactttcaagttgtaattcgttaggggaactaaaagttcgaaaccgacgcccgtaggaaggacggcccggaaggaaccgaccgggtcccgtaagtaacgttacgtggttggtagaagttacgacttagtaagacgaacgggtagacggttaaccgggtgggggttgtaaggg

SEQ ID NO: 369535 - DNA, 646 bp, Homo sapiens
  misc_feature: GZ8MTXP01D696K.15.23.C01.1.454.CMB.2.raw
  modified_base (316)..(316): a, c, t, g, unknown or other
  modified_base (325)..(325): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcacatggagttgggctgagctgggttttccttgttgcttattttagaaggtgtccagtgcgaggagcagcgtggtggagtcgtgggggagccgtggtccgagggccgggggggtccctggagcctctcctgtcgcccgcctgtcggactctactttagagtctagttggatgagcggtcgggccncgaggtccncggaagggggaaggggcgtgggaggttgggacgaccaaagaaagaaaaggaagagtaacggaacgacgaaagtaaaacctacgtaaagtggtggtacctggttaggaggaaaccggggtccattcccaacctatcccaaccgagaaccgaaacttaaaccggacaaaagtattcgaagtttacgtaacttacgaacggaactaaagtaacgaacgacgacgagacggacggaccggacggaccgacggtcgtaacgttagttagtgttgagaagagagagaagacgaacggtaggtacggttacgggtaagggttggtaag

SEQ ID NO: 369536 - DNA, 821 bp, Homo sapiens
  misc_feature: GZ8MTXP01EOHSY.15.23.C01.1.454.CMB.2.raw
  modified_base (204)..(204): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagntggtggagtcgtgggggagcctggtccaggccgggggtcctgagctctcctgtcgccgcctcgtggactctactttagatctagttggatgagtcgtcgggtccgccgagggcctaccggaagggggtaacgggggcgttagggggaggttcgggggtacggaacccaaaagtaaagtaaaaagggaaagtagtagggaaacgtacgaaaggaaaacctacgtaaagttgggtaagggtaccttcggtagggtaacgggaaacggggtccccgtaaatttacccaaccctacgttccctaacccgaaagggaaccgaaacccgaaaacccggacccgtaaaaaaggttaaacctttaccgaaaggggtttacttaaactttacccgtaaggggaaacccttaaaaaaggttccgaaaaccgacggtaccccgtaagggaaaccggaaacgggccccggtaaagggaaccccgtaccggggtccgtttaagtttaaacgttttacgtaggggtttacgaaagggaagaaccggaacttaaggtaaggtaaacccggtaaaccggggttaggaaaaccgggtttaaacccggggggttaaggggttttaaggtaacggg

SEQ ID NO: 369537 - DNA, 552 bp, Homo sapiens
  misc_feature: GZ8MTXP01D9MSR.15.23.C01.1.454.CMB.2.raw
  modified_base (304)..(304): a, c, t, g, unknown or other
  modified_base (405)..(405): a, c, t, g, unknown or other
  modified_base (508)..(508): a, c, t, g, unknown or other
  modified_base (513)..(513): a, c, t, g, unknown or other
  modified_base (517)..(517): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggtgctgagctgggttttccttgttgctattttagaaggtgtccagtgcgaggagcagctggtggagtcgtgggggagcctggtccaggccggggggtccctgagactctcctgtcgccgcctctggactcaccttagagctattggatgagctgggtccnccaggctccgagggaaggggctggagtgggtggaccaacgataaaggagactggaaagtcaagaaacaactatgtggactctgtagagggcatcactatcncgagagaacacgaccaaagtatacagtagtactcgtagaactaaagacgaacacgcaggaacgcgtccggagaccgacggtcgttagttacttagttggtagngaagngaanaagagaacgaggtagacggtaacgggttaagggtg

SEQ ID NO: 369538 - DNA, 725 bp, Homo sapiens
  misc_feature: GZ8MTXP01AHLMW.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggagcctgggtccagggccggggggtcctgagctcctcctgtcgcccgcctctcggactctacctttagagtcttagttggatggagtcgtgggtcccgcgagggtcctccggagggggaagggggctggggaggtggggtacgacccaaagaagtaaaagggagagtacggaaagtacaaagaaaacactaagtgggtggtactcgtagggtacgggaaacggggcctaatttcccaaaccctattcccgaccgaaggaacgaaaccccgtaaaccgaccgtaaaaggtaactttaccgaagttacgttaattccgtaaggaaaccgtaaaagtcgaaaaccgtacggtcccgtaagggaacggaaccggacccgggaaacgggtaccgaaccgggtccccggttaagttaactttaccggtaggttgtaggaaaggttacgaacttaggtaacggaaaccgtaaggggttacgaacggttaaacgggggtggggtttgtaaggg

SEQ ID NO: 369539 - DNA, 746 bp, Homo sapiens
  misc_feature: GZ8MTXP01B6VCV.15.23.C01.1.454.CMB.2.raw
  modified_base (668)..(668): a, c, t, g, unknown or other
  modified_base (694)..(694): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcttgggttttccttgttgctattttagaaggtgtccagtgcgaggagcagctggtggagtcgtgggggagccgtggtccgaggccggggggtccctgagctctcctgtcgccgcctcgtggactctacctttagagctagttggatggacgtcgtcgggtccccgaccgacggggccctaccggaaggggggaaacgggggtcgtagggggtacgggttggggggtaccgggaaccccgaaaagaaaggttaaaaaaggggaaaggtaagtaacggggaaacgtaacgaaaggaaaaacctaacgttaaagtaggttaacgggaacctttcgtaggggttacgggaaacggggtcccgtaaactttacccacccgtaattcccctaaccgaaggaaacgaaacccgaaaaccggaccctaaaagtaactttcgaaagttgtaaacttcgtagggaactaaaagtcgaaacctaagcccgtaggaacggacggacccggaaggaccgacggtacgttnttaagttcgtagttgtagaagacganacgtgaaaccggtaaggttacggaacggttaacggggtgggtttaagtaagg

SEQ ID NO: 369540 - DNA, 634 bp, Homo sapiens
  misc_feature: GZ8MTXP01DVI31.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtggagtcgtgggggagccgtggtccgaggccgggggggtccctggagactctcctgtgcccgcctctggactcacctttagagctagttggatgagcgtgggtccgccagggctccggagggggaaggggctgggaggtgggggtcggacctaaagaagtaaaaggaacgagtagggaaagtacaaaggaaacacgtaaatggtggaactcgtggtaggaacgggccgattccaccatccaccagacaacaaacgccaaagacttcgagttgtatccgtagggaaacctaaagttcggaaaccgcgtaccgtaggaacggaacggaccggaaaggaccgtaccggtcgttaagttaacttaggtgttagacgaagacgagttacgtaagaacgtaacgggtacgaacggttaacggggtggttgtaag

SEQ ID NO: 369541 - DNA, 580 bp, Homo sapiens
  misc_feature: GZ8MTXP01CLNQF.15.23.C01.1.454.CMB.2.raw
  modified_base (477)..(477): a, c, t, g, unknown or other
  modified_base (487)..(487): a, c, t, g, unknown or other
  modified_base (532)..(532): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctgagactctcctgtgcccgcctctggactcacctttagagctattggatgagcgtgggtccgccaggctccgagggggaagggggctgggaggtgggtggaccaaacgataaaaggaagatacgggaagtcaagaaacactaatggtggactctggtaggaagggccgattccaccatctccagagacaacgccaaagaacttcagtgtatctgggacaaaatcgaaacngccctggaanacggcccgaagggacaaccggggcctgtaacttacgtgttgaggngaggacagtgaacctaaagggtgaagttaaccgggtggggtttgaagg

SEQ ID NO: 369542 - DNA, 731 bp, Homo sapiens
  misc_feature: GZ8MTXP01BSLY5.15.23.C01.1.454.CMB.2.raw
  modified_base (541)..(541): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcgtggtttcctgttgctattttagaaggtgtccagtgcgaggagcagcgtggtggagtcgtgggggagccgtggtccgagggccggggggtccctgagactctccgtgtcgcccgcctcgtggacctctacctttagagctattggatggagcgtgggtcccgccaggcctccggaagggggaacgggggtcgtggggaggttcggggtcggaccaaacgaagtaaaaggaagagtaggaagtacaaagaaactactaagtgtggactgtaggtaggaacggggccgtattacccacctatcccgtaccgaaggaacgaacccaaaccggaccctaaaagtaactttccgaagttagttaactccgtaggaactaaaagtcggaaaaccncgtccgtaggaacggaaccggtaccggaacgggtaacccgtaccggggtccggtttaagtttaacgtttacgggtaggttaggtaaacgggaaggttaacggaacttaaggtaaccgggaaacccggttaaacgggggttaacgggtaaaaccggggttaaccggggggttaagggggtttaagtaacgg

SEQ ID NO: 369543 - DNA, 624 bp, Homo sapiens
  misc_feature: GZ8MTXP01EBY3D.15.23.C01.1.454.CMB.2.raw
  modified_base (308)..(308): a, c, t, g, unknown or other
  modified_base (501)..(501): a, c, t, g, unknown or other
  modified_base (530)..(530): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcgtggttttctgttgctattttagaggtgtccagtgcgaggagcagctggtggagtcgtgggggagcctgggtccgaggccggggggtccctgagactctcctgtcgccgcctctggactctacctttagagctagttggatggagcgtgggtcccnccgaggcctccggagggggaacggggctaggggaggtgggggtacggaccaaagaagtaaaagggaagagttagggaaagtacaaagaaactacgtaaagtggtgggaacttcgtaggtaggaaacggggccctaattccaacccattccctaccgaggaacaaccaaaccggaccaaaagtacttcaagttnttaactctaggggaaactaaagtgaaacngcctgaacgacgccgagacacgggctaagtaattacgtgttgagagagacagtaacgaacgtaagggtgaacggttaacgggggtggttgaagg

SEQ ID NO: 369544 - DNA, 644 bp, Homo sapiens
  misc_feature: GZ8MTXP01D10F3.15.23.C01.1.454.CMB.2.raw
  modified_base (309)..(309): a, c, t, g, unknown or other
  modified_base (526)..(526): a, c, t, g, unknown or other
  modified_base (635)..(635): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcggctggtggagtcgtgggggacgcctggtcccgaggcccgggggtcctgagactctcctgtgccccgctctggactctaccttagagctagttggatgagcgtgggtccnccgaggcctccgagggggaaggggctgggaggtggggtcgaccaaagaagtaaaggaagagtaggaaagtcaaagaaaacactaagtgggtacgtaacttcgtagggtacgggaaacgggtcccgtaattcccaaccctattcctacccgaaggaacgaacccaaacggtaccaaagtaacttccgaagtgtaatcctaggaactaaaatggaaacncgccaggagaaccggaccggaaggaaccgaccgggtccgtagttaacgttacttggtgttagacgaagacagttacgaacgtaggtaagaacggtaacggggagggttnaacgttggg

SEQ ID NO: 369545 - DNA, 652 bp, Homo sapiens
  misc_feature: GZ8MTXP01CR4VA.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggagccgtggtccgagggccggggggtccctgagactctcctgtcgccgcctcgtggactctacctttagagctattggatgagcgtgggtcccgcaggcctccgaggggaagggctgggagtgggtgaccaaagaagtaaaaggagagtagggaaagtacaagaaaacacttaaagtggtggactcgtagggtaggaaacggggtccgtaattacccgaccctaatcccgtaccgaagaaccgaaaccaaaccggaccctaaaaggtaacttcgaagttcgttaaatcctagggaaactaaaagtcgaaaccagccctaggaacgaacgccggtaaggacccgacgggtccgtaagttaacttacgtggttagtagagaaaggcttaagtaagaaaccgtaaggtagaacggttacgggtaagggttgtaacg

SEQ ID NO: 369546 - DNA, 606 bp, Homo sapiens
  misc_feature: GZ8MTXP01BTZKP.15.23.C01.1.454.CMB.2.raw
  modified_base (315)..(315): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagcgtggtggagtcgtgggggaggccgtggtccgagggccgggggggtccctggagctctcctgtcgcccgctctggactctacctttagagctattggatgagcgtgggtcccncaggctccgaggggagggctgggagtgggtgaccaaagaagtaaaggagagtaggaagtacaagaaacacttaagtggtggacttcgtaggtaggaacgggtccgtaattcccaaccattccaccgaagacgaacctaaaccggaccaaagtaacttcaagttagtaatcgtaggaactaaagtcgaaacacgcccgaggacgacggccgtaagggaccacgggtctgtacttgtgttgagacgagcagtaagacgaagggttcgaaggttaccgggtaagggtttgaacg

SEQ ID NO: 369547 - DNA, 716 bp, Homo sapiens
  misc_feature: GZ8MTXP01AWPE8.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggagccgtgggtccgagggcccggggggtccctggagactctcctgtcgcccgcctctggactcacctttagagctattggatgagctgggtcccgcaggctccgagggggaaggggctgggaggtggggtcggacccaaagagtaaaagggaagagtaggaagtacgaagaaaaccactaaagtgtaagggacttcgtggtacggaaaggggtcccgtatttaccaccctatccgtacccaaggaacgaaacgaaaccggaccctaaaaggaactttacgaagttacggtaattacccgtaggggaaactaaaagttacgaaaacgtaacgaccccgttaggaaacgggaacgtccccgggaaagggtaccgaacccggggtccggttaaggttaaatttaccggtggttagtaaggaacgttaggaccaagttaacggaaaccgtaacggggtaggtaacgggttaaacccggggtaaggggggtttaataaggg

SEQ ID NO: 369548 - DNA, 594 bp, Homo sapiens
  misc_feature: GZ8MTXP01ETLT0.15.23.C01.1.454.CMB.2.raw
  modified_base (271)..(271): a, c, t, g, unknown or other
  modified_base (309)..(309): a, c, t, g, unknown or other
  modified_base (394)..(394): a, c, t, g, unknown or other
  modified_base (534)..(534): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctgggtggagtcgtgggggagcctgggtccgaggccgggggggtccctgagactctcctgtcgccgcctntggactctacctttagagctatggatgagctgggtccncgaggctccggagggggaggctgggagtgggtgaccaagagtaaaggagatacggaatacaagaaacactaaagtgtggactcgnggtaggaacggggtccattccacctattccaccagacgacaaacgccaaagtacttacgagtagtaactctaggaactaaagtgaaccagccctaggacgacgccgtaagacgaccgggcgtaagttagttacgtgttgnggaagacgcagtggaaacgtaacgggtgaacgggttaaaccggggtggggttttgaaggg

SEQ ID NO: 369549 - DNA, 806 bp, Homo sapiens
  misc_feature: GZ8MTXP01DQEDF.15.23.C01.1.454.CMB.2.raw
  modified_base (321)..(321): a, c, t, g, unknown or other
tcagtctacgtagccacgaccggtgctcgatttagtacacgtgattagggattgggggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggaggccgtggtccgagggcccggggggtccctggagactctcctgtcgcccgcccttcgtggacctctacctttagtagctagttggatgagcgtgggtccnccaggctccgagggggaacggggctgggagttggtacgaaccaaacaagttaaaagggaagagtagggaaacgtaccgaaagaaaccacttaagtgtcggaacttcgtaggtagggaaacgggcccgtatttccgaacctattccgtacccgaaggaacgaaccgaaaccgaccctaaaagtaaactttccgaaggttgtaacttaccgtacggtaaccaaaaagttcggaaaacctacgggtacccgtaagggaaaggaaccgggaacccgggaaacggggtaacccgtaacccggggggttacccgtttagggttttaaaacttttaaccgggttggggtttacggaagggtaaagggaacccggttaaaacgttaggttaaaaccggggaaacccggttaaaaaacgggggtttgggaaaaacccgggtttaaacccggggggggttaaggggggtttttaacgaaacgggtttttcggggg

SEQ ID NO: 369550 - DNA, 621 bp, Homo sapiens
  misc_feature: GZ8MTXP01D0398.15.23.C01.1.454.CMB.2.raw
  modified_base (305)..(305): a, c, t, g, unknown or other
  modified_base (398)..(398): a, c, t, g, unknown or other
tcagtctacgtagccacgaccggtgctcgatttagtacacgtgattagggattgggaggtctcagagatgagccttagccctggactccaaggcctttccacttggtgatcagcactgagcacagaggactcaccatggagttgggctgagcttgggttttccttgttgcttattttagaaggtgtccagtgcgaggagcagctggtggagtcgtgggggagcctggtccgaggccggggggtccctgagctctctgtcgccgcctctggactcaccttagagcttattggatgagctgggtccnccaggctccgaagggggagggctgggaggtggggtcgaccaaacgagtaaaggagactggaaatcgaagaaacactaatggtggaactcgtgnggaacgggccgattcacctatctaccaagacgaacaacgccaaagaattacgagttagtaatcgttagactaaaactcggaaacacgtccgaggaacggacggaccggacggaccgaaccgggtccgttggttaacgtttaacttggttaggtggaaaggcggaaaagtaagtagaaacggtaacggtacggttaacgggttaaaccggggttggggtttaag

SEQ ID NO: 369551 - DNA, 554 bp, Homo sapiens
  misc_feature: GZ8MTXP01B4PKX.15.23.C01.1.454.CMB.2.raw
  modified_base (308)..(308): a, c, t, g, unknown or other
  modified_base (467)..(467): a, c, t, g, unknown or other
  modified_base (482)..(482): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggaggccgtggtccgagggccggggggtccctgagctctcctgtcgccgcctctggctcacctttagagctattggatgagcgtgggccncaggctcgaggggagggctggagtgggtgccaagagtaaaggagagtaggaatcgaagaaacactaaagtgtggactgtgtaggaacgggccattcaccatcctaccagacgacaaacgccaaagtaacttcagtatatctggacaaagtgaacagccngagacgccgagaccncgggcctgtattacgtgttggtagagagcagtgaacgtaacggtgaacggttaaccggggtgggttcgtaag

SEQ ID NO: 369552 - DNA, 629 bp, Homo sapiens
  misc_feature: GZ8MTXP01DKWMG.15.23.C01.1.454.CMB.2.raw
  modified_base (563)..(563): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccgaggccggggggtccctgagactctcctgtcgccgcctcgtggactcacctttagagctattggatgagcgtgggtcccgccaggcctccgagggggaaggggcgtgggaggtggggtcggaccaaacgaagtaaaaggaagagtaggaaagtacaagaaacactaagtgtggactcgtggtaggaacgggccgattccaccatctaccagacacaacgaccaaagaattcagttgtatcgtaggaactaaagtagaaacgtagcccgtaggaacggacggacccggaacggaccgaaccgggtcccgttaagttaacgtttactggggggttntagggaagacggacagtaacgaacgtaacgggtagaacggttaaaccggggtgggttaaggtaagg

SEQ ID NO: 369553 - DNA, 539 bp, Homo sapiens
  misc_feature: GZ8MTXP01EHCZA.15.23.C01.1.454.CMB.2.raw
  modified_base (307)..(307): a, c, t, g, unknown or other
  modified_base (348)..(348): a, c, t, g, unknown or other
  modified_base (422)..(422): a, c, t, g, unknown or other
  modified_base (459)..(459): a, c, t, g, unknown or other
  modified_base (464)..(464): a, c, t, g, unknown or other
  modified_base (473)..(473): a, c, t, g, unknown or other
  modified_base (504)..(504): a, c, t, g, unknown or other
  modified_base (510)..(510): a, c, t, g, unknown or other
  modified_base (512)..(512): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctggggggagcctgggtccaggccgggggggtccctgagactctcctgtgcccgcctctggactcacctttagagctattggatgagctgggtccnccaggctccgaggggaagggctgggagtggggtggccaaanaagtaaaaggaagagtggaaagtcaagaaaacactaaatgtggactcgtagtagaaggggccattcaccattcncagagacaaacgccaaagaattcagtgtatctggaanaatanaacgagcgngagagacgagacgacgcgtgtattatgttgngagagnanaagagaaggagagacggtaaggttgtg

SEQ ID NO: 369554 - DNA, 600 bp, Homo sapiens
  misc_feature: GZ8MTXP01B01YL.15.23.C01.1.454.CMB.2.raw
  modified_base (393)..(393): a, c, t, g, unknown or other
  modified_base (498)..(498): a, c, t, g, unknown or other
  modified_base (536)..(536): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggggggaggcctgggtccaggccggggggtccctgagactctcctgtgcccgcctctggactcacctttagagctagttggatggagctggggtcccgccgaggcctccgagggggagggggctgggaggtggggtggaccaaacgagtaaaagggagagtagggaagtcaagaaaacnctaaatgtggactcgtaggtggaaggggccgattcccaccctatcctccaaggacgaccaaacggccaaagacttcaagttgtatctagggactaaagtgaaacngcctaggagacggccggtaagggaccaccgggtccgtntaacgttcgtgttggtgaagacgcagtgaacaacggtgaacgttaccggggaaggggttgaagg

SEQ ID NO: 369555 - DNA, 682 bp, Homo sapiens
  misc_feature: GZ8MTXP01C3SUF.15.23.C01.1.454.CMB.2.raw
  modified_base (602)..(602): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggaggtcggtgggggaggccgtgggtccgagggcccggggggtccctggagacctctccgtgtcgcccgcctcgtggactctacctttagagctagttggatggagcgtgggtcccgccgaggcctaccggagggggaaggggctgggaggttgggggtcggaccaaaagaagtaaaagggaagaagtagggaaagtacaaagaaaacacgttaaagtggtcggacttcgtaggtaggaaacggggtccaattcccgacctatccgtaccaaggacgaaccaaacgccaaaagtacttcgaagttgtaactcgtaggaactaaaagtagaaacgacgtccgagaaggacgcccggaaaggacccgaccgggtccgttaagttaacgtttacgnggttaggtagaaggacgacgttaagtaacggaaaccgtaacggggtgaaacgggttaaccggggtggggttaagtaaggg

SEQ ID NO: 369556 - DNA, 614 bp, Homo sapiens
  misc_feature: GZ8MTXP01AIB1W.15.23.C01.1.454.CMB.2.raw
  modified_base (538)..(538): a, c, t, g, unknown or other
  modified_base (547)..(547): a, c, t, g, unknown or other
  modified_base (609)..(609): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaggtgtccagtgcgaggagcagctggtggagtcgtgggggaggcctgggtccaggccgggggggtccctgagactctcctgtcgcccgcctctggactcacctttagagctattggatgagcgtgggtccgccgaggctccgagggggaggggctggggagtgggggtggaccaaagagtaaaaggaagatagggaagtcaagaaacactaaatggtggactcgtggtaggaacggggccgtattcccaacccattccctaccgaaggaacgaaccaaaccggaccaaaggtaaactttccgaagttgtaacttcgtaggaactaaatggaaaccagcctaggagacgtaccggaggacnccgggcgtntattacgtgttgtagagttcgacagtgaaccgtaaggtggaaacggttacggggtggggttntaagg

SEQ ID NO: 369557 - DNA, 698 bp, Homo sapiens
  misc_feature: GZ8MTXP01ACWFB.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggaggccgtgggtccgagggcccgggggggtccctggacgactctcctgtcgcccgcctcgtggactctacctttagagctattggatgagcgtgggtcccgccgaggcctccggagggggaggggctgggaggtggggtgaccaaagaagtaaaggagacgtaggaacgtcaagaaacactaaagtggtggactcgtggtaggaacggggcctattcccaacctattccctaccgaaggaaccgaaccaaaccggaccaaaaggtaactttccgaaggttacgtaacttccgtaaggggaactaaaaagttcggaaaacccaggtcccctaagggaacgaccgggcccggtaaagggacccgtaaccggggtccgttaagttaacgtttacgtggttagtaggaaagacgttaccgagttaacgggaaactaacgggggttagaaaccgggttaacgggggtaaggggtttcgtaaggg

SEQ ID NO: 369558 - DNA, 689 bp, Homo sapiens
  misc_feature: GZ8MTXP01AVB0G.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttcctgttgctattttagaaggtgtccagtgcgaggagcagctggtggagtcgtgggggaggcctggtccgaggccggggggggtccctgagctctcctgtgccgcctctggactctaccttagagctattggatgagcgtgggtcccgccaggctccgaggggacggggctgggaggtgggtggaccaaacgagtaaaaggaagagtacgggaaagtacaagaaacactaaatcggtgggactccgtagtagggaaacggggtcccgtaatttcccaaccctaattcccgacccaaagggaacggaacctaaaacccggcccctaaaaaggtaactttaccgaagttagtactttaccggtacggaaactaaagtacgaaacgacgaccgtaggaacggaccggaccggaacgggtaacccgcgggtccgttaagttaacgttacgtggttcggtaaggaagaacgacgaagtaaccggaaacggtaacgggtacggaacgggttaaccggggtaaggggttaagaag

SEQ ID NO: 369559 - DNA, 723 bp, Homo sapiens
  misc_feature: GZ8MTXP01EJPUL.15.23.C01.1.454.CMB.2.raw
  modified_base (669)..(669): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagagactcaccatggagttgggctgagtcgttgggttttccttgttgcttattttagaaggtgtccagtgcgaggagcagcgtggtggagtcgtgggggacgccgtggtccgagggcccgggggtcctgagctctcctgtcgcccgcctcgtggactctacctttagagcttagttggatggagtcgtcgggtccccgccgagggtcctaccggagggggaacgggggtcgtggggaggttgggggtcggacccaaagtaagtaaaaggaagagtagggaatacgaaagaaactacgttaaagtggtaacgggtaccttcggttagggtaacgggtaaaccgggggtcccgtaattttacccgaaccctattaccctacccgaaggaaccgaaaccgtaaacccggaccctaaaagtaacttacgaagttagtaacttccgtaggtaaactaaagtacgaaaccgagacccgaggaacgacggaccggaacgggaaccgacccggggtccgttaagttaacgttcggtggttagtaggaagacganagtaacgaaacgtaacgggtagtaaacgggttaccggggtaagggttgtaaggg

SEQ ID NO: 369560 - DNA, 711 bp, Homo sapiens
  misc_feature: GZ8MTXP01ADIF0.15.23.C01.1.454.CMB.2.raw
  modified_base (296)..(296): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcgtgggggaggccgtgggtccgagggcccggggggtccctggagactctcctgtcgcccgcctcgtggactctacctttagngctattggatgagcgtgggtcccgccaggctccgagggggaagggctgggaggtggggtcggaccaaacgaagtaaaaggagagtaggaaagtcaaagaaacactaaagtggtcggactcgtggtagggaaacggggtccatttcccaaacctattccacccgaagaacgaacccaaaccggtcccaaaaggtaactttacgaacggttagttaacttaccgtaggggaacctaaaagttacggaaaacctaacggccccgttaagggaaacggaaccggtaccccgggaaagggaaccctaccgggggtcccgttaagttaacgtttaacgtggttaggtacgaaggacggttaacagttaaggaaaccgaacgggttggaaccggttaaaccgggggtgggggtttgtaaggg

SEQ ID NO: 369561 - DNA, 695 bp, Homo sapiens
  misc_feature: GZ8MTXP01BNK4N.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggaggcctggtccgagggccggggggtccctgagactctcctgtcgcccgcctctggactcacctttagagctattggatgagcgtgggtcccgccaggctccgaggggagggctgggagtgggtgaccaacagtaaaggagagtaggaatcaagaaacactaagtgtggactcgtggtaggaacgggccgattccacctagtccctaccgaagaacgaaccaaaaccggaccctaaaaggtaactttccgaaaggtttcttaacttccgtaaggaaactaaaagtacgaaaccgacggtacccgtaaggaacggaaccggacccgggtaaacgggacccggtaaccgggtccgttaagtttaacgtttacggttgggttaggtaggaacgaacgttacgttaaggtaacggaaaccggtaaacggggttacgggtaaaccggggttaaaccgggggttgggggtttaacgtaagg

SEQ ID NO: 369562 - DNA, 605 bp, Homo sapiens
  misc_feature: GZ8MTXP01D2PVS.15.23.C01.1.454.CMB.2.raw
  modified_base (287)..(287): a, c, t, g, unknown or other
  modified_base (309)..(309): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctgggtccgaggccggggggtccctgagactctcctgtcgcccgcctctggactctacctttagngctattggatgagctgggtccnccaggctccgagggggaagggctgggagtgggtggaccaaagaagtaaaaggaagagtagggaagtacaaaggaaaacactaaagtggtggactcgtggtagaacggggccctattcccaacctatcctacccgaaggaacgaaccaaaccgccaaaagtaacttcagttgtaatcgtaggaactaaaagtcgaaacagcctaggagacgccgaggaccacgggcctaagtacttacgtgttcgtagagagcagtaagacgtaacgggtagacggttaaccgggtgggttgtaagg

SEQ ID NO: 369563 - DNA, 643 bp, Homo sapiens
  misc_feature: GZ8MTXP01B113P.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctgggtccaggccggggggtccctgagactctcctgtcgccgcctctggactcacctttagagctattggatggagcgtgggtcccgccaggcctccgagggggaaggggctgggaggtggggtcggaccaaacgaagtaaaaggaagagtaggaaagtcaagaaaacactaaatgggtggacttcgtaggtacggaaacggggcctaagtttccaaccctattccctacccgaaggaacgaaccaaaaccggccctaaaagtaactttcgaagttgtaattccgtagggaactaaaagtcggaaacaggaccctaggaacgacggccggtaagggaccaaccgggtccgtaagttaacttacgtgttagtgaagagcagtaacgacgtaagggtcgaagttaaccggggtgggtttgaag

SEQ ID NO: 369564 - DNA, 630 bp, Homo sapiens
  misc_feature: GZ8MTXP01EOJWE.15.23.C01.1.454.CMB.2.raw
  modified_base (315)..(315): a, c, t, g, unknown or other
  modified_base (572)..(572): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcgtgggggagccgtggtccgagggccggggggtccctgagactctcctgtcgccgcctctggactctacctttagagctagttggatgagcgtcgggtccnccgaggcctccggagggggaaggggcgtagggaggtggggtcggaccaaacgaagtaaaaggaagagtagggaaagtcaaagaaacacgtaaagtgtggactcgtagggtaggaacgggtccgtatttccacctactcctaccgagacgaaccaaaccggtaccaaaagtaacttcgaagttgtaacttctaggaactaaagtacgaaccagccctaggacgacgaccggaaggaccacgggtccgtaagtacttgngttgagagagacagtaacgaacgaacgggtgtaacggaacggggtgggttcgtaaggg

SEQ ID NO: 369565 - DNA, 649 bp, Homo sapiens
  misc_feature: GZ8MTXP01DEJEY.15.23.C01.1.454.CMB.2.raw
  modified_base (392)..(392): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctgggtggagtcgtgggggagccgtggtccgagggcccggggggtccctggacgactctccgtgtcgcccgtcctcgtggactctacctttagagctattggatgagcgtggtccgcgaggctcggaggggaacgggctgggagtgggtcgaccaaagaagtaaaggagagtaggaagtacaagaaacnctaaagtgtgactgtaggtaggaacgggcctaattccaccctatcctacaaggaacaaaccaacgaccgaaagtaacttcaagttagtaactcgtaaggaacctaaaagtacgaactacgcctaggaacggacggcccggtaaaggccgacgggtccgttaaggtaacctttaggtgttaggtaggaacgttacgacgttaagtaacggtaaacgaacgggttagaaacgggttaaacgggggtgggttaagtaagg

SEQ ID NO: 369566 - DNA, 653 bp, Homo sapiens
  misc_feature: GZ8MTXP01ALE82.15.23.C01.1.454.CMB.2.raw
  modified_base (354)..(354): a, c, t, g, unknown or other
  modified_base (487)..(487): a, c, t, g, unknown or other
  modified_base (636)..(636): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctgggtccaggccgggggggtccctggagactctcctgtcgccgcctctggactcacctttagagctattggatgagcgtgggtcccgccagggctccggagggggaggggctgggagtgggtggaccaaanagtaaaagggagagtgggaaagtcaagaaacactaaatggtggactcgtggtaggaacggggccctaatttccaccctatccgtacccgaagaacgaacaaaccggtacccaaaggtaaactttccgaggttntaactccgtagggaacctaaaagtcgaaaaccgacggccccggaagaaccggaccggaacgggtaccgaccgggtcccgttaggtaactttacgttgggtgttacggaagaagttacagttcggaacgacgggttgaagtaaccggggnggggtttgaacgttggg

SEQ ID NO: 369567 - DNA, 551 bp, Homo sapiens
  misc_feature: GZ8MTXP01CGA3O.15.23.C01.1.454.CMB.2.raw
  modified_base (305)..(305): a, c, t, g, unknown or other
  modified_base (417)..(417): a, c, t, g, unknown or other
  modified_base (498)..(498): a, c, t, g, unknown or other
  modified_base (548)..(548): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgctattttagaaggtgtccagtgcgaggagcagctggtggagtcgtgggggagcctgggtccaggccggggggtccctgagactctcctgtgcccgcctctggactcacctttagagctattggatgagctgggtccnccaggctccgaggggaagggctgggagtgggtggccaacataaaggagatggaaatcaagaaacactaaatgtggactcgtgtgaaggggccattccacatctccagacganaaccgcaaagattcagtgtatctaggcaaaatgaaacagccctggacaggcccgaaggaccacgggccgtaagtattacgngttgtagagttagcatgaaccgaaggtgaacgttaacgggtggggttaanaag

SEQ ID NO: 369568 - DNA, 623 bp, Homo sapiens
  misc_feature: GZ8MTXP01BYUBM.15.23.C01.1.454.CMB.2.raw
  modified_base (557)..(557): a, c, t, g, unknown or other
  modified_base (564)..(564): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccgaggccggggggtcctgagctctcctgtcgcccgcctctggactctacctttagagctattggatgagcgtcgggtcccgccgaggcctccggagggggaaggggcgtgggaggtggggtacggaccaaacgaagtaaaaggaagtagtaggaaagtacaaagaaactactaaagtggtaaggacttcgtggtacggaaacggggcctattccacctatccacgaagacgacaaacgcaaagtacttcagttcgtatcgtaggaactaaagtcgaacacgcctggaacggacgccggaaggtaccaccgggtcgtaagttacttacgnggttagnggaagagcagtaacggaacgtaacgggttagaacggttaaccgggggtggttgtaaggg

SEQ ID NO: 369569 - DNA, 613 bp, Homo sapiens
  misc_feature: GZ8MTXP01CVBYV.15.23.C01.1.454.CMB.2.raw
  modified_base (492)..(492): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctgggtggaggtcgtgggggaggccgtggtccgagggccggggggtccctgagactctcctgtcgcccgcctctggactcacctttagagctattggatgagcgtgggtcccgccaggcctccgagggggaggggctgggaggtggggtggccaaagagtaaaaggagagtaggaagtcaagaaacactaaatgtggactcgtggtaggaaggggccattccaccatccaccaagacgaaccaacgaccaaagtaacttcagttgtaatcgtaggacaaagtcgaaacngccctaggagacggccgaaggaccgaacgggtccgttaagttaacttacgtgttggtagagaaggacagtaacggaaacgtaacggggtgtaacgggttaaccgggggtggggtttgaagg

SEQ ID NO: 369570 - DNA, 732 bp, Homo sapiens
  misc_feature: GZ8MTXP01ATBSY.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtgggtccaggcccgggggggtccctggagactctcctgtgcccgcctctggactctacctttagagctatggatgagcgtgggtcccgccgaggctccgaggggaggggctgggagtggggtggaccaaacgagtaaaaggagagtgggaaatcaaggaaacactaaagtggtcggtactcgtggtagaaggggtcccaattcccaacctataccctaccgaaaggaacgaaaccctaaaaccggccaaaaaggtaacttttacccgaagggttacgttaaagtttccctaggggaaaccctaaaaagttcgaaaaacccgacggccccgttaggaacggaacgggcccggaaaggggttaaaccccgaaccggggtccccggtttaaggttaaaccttttacggtagggttcggttacggaagagggaaccttagtaacgggaaacccgtaacggggtttgaaaacgggttaacccgggggttaagggggttttaaggtaaccggg

SEQ ID NO: 369571 - DNA, 638 bp, Homo sapiens
  misc_feature: GZ8MTXP01DMDC3.15.23.C01.1.454.CMB.2.raw
  modified_base (183)..(183): a, c, t, g, unknown or other
  modified_base (437)..(437): a, c, t, g, unknown or other
  modified_base (473)..(473): a, c, t, g, unknown or other
  modified_base (580)..(580): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttcctgttgctattttagaaggtntccagtgcgaggagcagctggtggagtcgtgggggagcctggtccgaggcccgggggggtccctgagactctccgtgtcgcccgcctcgtggactcactttagagctagttggatgagcgtgggtcccgcaggctccgagggggaagggctgggagtgggtggccaaagtagtaaaaggagagtaggaagtacaagtaaacactaaagtgtggacttcgtaggtagaacggggcctaattcccaacctattccnccgaagacgaacaaacgaccaaagtacttcgagttntaatccgtaggaaacctaaagttacggaaaccacgccgtaggaacgtacggaccggaagtaccgacgggttaccgttaagttacgttagtgagtaagagttaaccgnttagtaacggaaacggtaacggtaaggtaacgggttaacgggggttggttaagtaagg

SEQ ID NO: 369572 - DNA, 650 bp, Homo sapiens
  misc_feature: GZ8MTXP01DMTV1.15.23.C01.1.454.CMB.2.raw
  modified_base (265)..(265): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccgaggccggggggtcctgagctctccgtgtcgcccncctcgtggactcctacctttagagctagttggatggagtcgtcgggtcccgaccgagggcctaccggaagggggaacgggggtcgtaggggaggtcgggggtacggacccaaagaaagtaaaagggaagaagtagggaaagtcaaagaaaactactaagtgtgggactcgtaggagaacggggcctattaccacatccacagaacgaacaaccgaccaaagaacttcgagttgtaactcgtacggaactaaaagtaccgaaacgacgcctaggaacggaacggacccgtaagggaaccgtaccggccgttaagtacttacgtgttaggtagaagagcttagtaagacgtaacggtgaaacgggttacgggtggggtttcgaaggg

SEQ ID NO: 369573 - DNA, 769 bp, Homo sapiens
  misc_feature: GZ8MTXP01DNTD2.15.23.C01.1.454.CMB.2.raw
  modified_base (421)..(421): a, c, t, g, unknown or other
tcagtctacgtagccacgaccggtgctcgatttagtacacgtgattagggattgggaggtctcagagatgagccttagccctggactccaaggcctttccacttggtgatcagcactgagcacagaggactcaccatggagttggggctgagcgttgggttttccttgttgcttattttagaaggtgtccaggtgcgaggagcagcgtggtggagtcggtgggggagccgtggtccgagggcccggggggtcctggacgctctccgtgtcgccgcctcgtggactctaccttagagctagttggatgagcgtgggccccgccgaggctccggaagggggacggggcgtgggagtggggtcggaccaaagaagtaaaaggaagactagggaaatcgaaagaaacaactatggtagacttcgngtaggaacgggtccgtattccaaacctatcccgtaccaaaggtacgaaaccaaacggtacctaaaggaaacttcaaggttagttaaactcgggttaacggaaacctaaaaagttacgggaaaacctaaccggtccgtacgggaaaggaccccggaccggggtaaacgggaacccgtaacccggggtaacccgggtttgtttaaaacgttttaaccggttggtttaaacgggagggttaaaaaggcgggttaaaacccctaagggtaaaccggtaaccggggtaaaaacccgggggttaggttaaaccggggttaaaaccccggggggggttaaggggggtttttaagg

SEQ ID NO: 369574 - DNA, 665 bp, Homo sapiens
  misc_feature: GZ8MTXP01AR02D.15.23.C01.1.454.CMB.2.raw
  modified_base (345)..(345): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggcccggggggtccctgagctctcctgtcgccgcctctggactcacctttagagctattggatgagcgtggcccgcaggctcgaggggagggctgggagtgggtgaccaaanaagtaaaggagagtaggaagtcaaagaaaccataaagtgtggactcgtgtaggaagggcccgtattacccaccgtactcctaccgaaggaacgaaccgaaaccgaccgaaaaggtaaacttaccgaaggttagttaacttaccgttagggaacctaaaagttacgaaaaccgtacgacccgttaggaaacggaacggacccggaacgggtaaaccgaccggggtacccgttaaggttaactttacgtggttagtaggaagttagacgagtaacgaaacgtaacgggtagaacggttaaccggggtgggtttaacgtaagg

SEQ ID NO: 369575 - DNA, 652 bp, Homo sapiens
  misc_feature: GZ8MTXP01DU711.15.23.C01.1.454.CMB.2.raw
  modified_base (324)..(324): a, c, t, g, unknown or other
  modified_base (546)..(546): a, c, t, g, unknown or other
  modified_base (586)..(586): a, c, t, g, unknown or other
  modified_base (593)..(593): a, c, t, g, unknown or other
  modified_base (641)..(641): a, c, t, g, unknown or other
tcagtctacgtagccacgaccggtgctcgatttagtacacgtgattagggattgggaggtctcagagatgagccttagccctggactccaaggcctttccacttggtgatcagcactgagcacagaggactcaccatggagttggggctgagcttgggttttccttgttgcttattttagaaggtgtcagtgcgaggagcagcgtgggtggagtcggtggggggacggtccgtgggtccgacgggcccgggggggtccctgacgacctctcctgtcgcccgcctctggactcacttagtagcttatggatgagcgtgggtcccncgaggctccgaagggggaaggggctgggacgtggggtacggacccaaagaagtaaaagggaagtaagtagggaaagtacaaaggaaaacctaacgttaagtggtagggaaaccctttcgtaggtaggaaacggggcctaatttcccaacgtatcctaccgagaaacgaaccctaacgccaaaaggtattcaaggttagtaactgtagactaaaagtcgaaancgctagaagcgtaccgagacgacggtctagttattacggngttaggngaaaggcacaagtacggaaccgtaagggtgaaacgttaaaccgggggnggggttttaag

SEQ ID NO: 369576 - DNA, 610 bp, Homo sapiens
  misc_feature: GZ8MTXP01CLWMA.15.23.C01.1.454.CMB.2.raw
  modified_base (217)..(217): a, c, t, g, unknown or other
  modified_base (559)..(559): a, c, t, g, unknown or other
  modified_base (585)..(585): a, c, t, g, unknown or other
  modified_base (605)..(605): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagtcttgggttttccttgttgcttattttagaaggtgtccagtgcgaggagcagctggtggagtcgngggggaggcctggtccgaggcccggggggtccctgacgactctctgtgcccgcctctggactctacctttagagctagttgatgagcgtcgggtccgccaggcctaccgagggggaacggggcgtgggaggttgggggtgacccaaagaagtaaaaggagagtaggaagtacaagaaacactaaagtgtggaccttcgtaggtacgggaacgggccgtattccaaccctatccctaccagaacgaaccaaacggacaaagtaattccgaagtctatctgggaacaaatcgaaacacgcctaggaacgacgccgaaggtacaccggcgtaagttattacgtgngtagacgagcagtcgaagaacgggtnacggttacgggaagggtttnaaggg

SEQ ID NO: 369577 - DNA, 603 bp, Homo sapiens
  misc_feature: GZ8MTXP01AFBVZ.15.23.C01.1.454.CMB.2.raw
  modified_base (281)..(281): a, c, t, g, unknown or other
  modified_base (372)..(372): a, c, t, g, unknown or other
  modified_base (455)..(455): a, c, t, g, unknown or other
  modified_base (459)..(459): a, c, t, g, unknown or other
  modified_base (482)..(482): a, c, t, g, unknown or other
  modified_base (573)..(573): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttcctgttgctattttagaggtgtccagtgcgaggagcagctggtggagtcgtgggggagcctggtccaggccggggggtccctgagactctcctgtcgcccgctctggactcacctttagngctagtggatgagcgtggtcccgcaggctccgaggggagggctgggagtgggtgaccaaagagtaaaaggagagtaggaagtcaagaaacnctaagtgtcggtactcgtgtaggaacgggtcctattccaccgtatcctaccgaagacgactaaaccggcaaagtagtcaggtntacncgttaggactaaagtcgaaaccngccctaggacggacggaccgtaacgggacctaacggggtccttaaggtaacttacgtggttagagaacgagacagtccgaacgtaacgggngtaacggttaacggggtggttaacgtaagg

SEQ ID NO: 369578 - DNA, 580 bp, Homo sapiens
  misc_feature: GZ8MTXP01C5W17.15.23.C01.1.454.CMB.2.raw
  modified_base (312)..(312): a, c, t, g, unknown or other
  modified_base (478)..(478): a, c, t, g, unknown or other
  modified_base (526)..(526): a, c, t, g, unknown or other
  modified_base (535)..(535): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctatttcagaaggtgtccagtgcgaggagcagctggtggagtcgtggggggaggccgtggtcccgaggcccgggggggtccctgagactctcctgtcgccgcctctggactcaccttagagctattggatgagctgggtcccnccaggctccgagggggaagggctggaggtggggtggccaaacaagtaaaggaagatagggaaagtcaagaaacaacttatggtggactctggtaggaagggccgattccaccatctaccagacgacaacgccaaagaattcagtgtatcgtgacaaaatcgaaacncgccctagaacgacgacccggaggaccacgggtcccgtgttattacgngtggtgagngacaagtagaacgaacgggtgaacgtaaccggggttggggttaag

SEQ ID NO: 369579 - DNA, 616 bp, Homo sapiens
  misc_feature: GZ8MTXP01AD69W.15.23.C01.1.454.CMB.2.raw
  modified_base (287)..(287): a, c, t, g, unknown or other
  modified_base (482)..(482): a, c, t, g, unknown or other
  modified_base (551)..(551): a, c, t, g, unknown or other
  modified_base (567)..(567): a, c, t, g, unknown or other
tcagtctacgtagccacgaccggtgctcgatttagtacacgtgattagggattgggaggtctcagagaggagccttagacctggactccaaggcctttccacttggtgatcagcactgagcacagaggactcaccatggagttggggctgagctgggttttccttgttgctattttagaaggtgtccagtgcgaggagcagctggtggagtcgtggggggaggcctggtccaggccgggggggtccctgagactctcctgtgcccgcctctggactcacctttaganctattggatgagctgggtcccgccagggcctccgaggggaaggggctgggagtggggtcggaccaaacgaagtaaaagggagagtaggaaagtcaagaaacactaagtggtggactcgtgtagggaacggggccgtaattccaacccatcctacccgaagaacgaacaaaccgcccaaaaggtaaacttcagttntattcgtagggaacaaatgaaacagcctggaagacgcccggaggtaccaccgggtccgtgtacttacgngttggtagaagcgacngtaacgaacgaacgggttagaacggttaacggggtggggtttaagaagg

SEQ ID NO: 369580 - DNA, 634 bp, Homo sapiens
  misc_feature: GZ8MTXP01DDXF1.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggaggtcgtgggggaggccgtgggtccgagggcccgggggggtccctggagactctcctgtcgcccgcctctggactctacctttagagctattggatgagcgtgggtcccgccaggcctccggagggggaagggggcgtggggaggttgggggtggaccaaacgaagtaaaaggagagtaggaagtacaagaaacactaagtgtggtactcgtaggtaggaacgggtcctattccacctatcctaccagaacgaacaaacgccaaagtacttacgagtacgttatcgtaggaactaaagtacgaaacacgcctaggaggacgaccggaaggaccgcggccgttaagtaacttagtggttgtagagacgcttagtaacggaacgtaacgggtagtaacggttaacggggtggggttaacgtaagg

SEQ ID NO: 369581 - DNA, 578 bp, Homo sapiens
  misc_feature: GZ8MTXP01E1946.15.23.C01.1.454.CMB.2.raw
  modified_base (309)..(309): a, c, t, g, unknown or other
  modified_base (381)..(381): a, c, t, g, unknown or other
  modified_base (521)..(521): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggagcctggtccgaggccggggggtccctgagactctcctgtcgccgcctctggactcacctttagagctattggatgagcgtgggtcccncaggctccgaggggagggctgggagtgggtggaccaaagagtaaaggaagagtaggaaagtacaagaaaacnctaaatgtggactcgtgtaggaacggggccattccaccatcctaccagacgacaaacgccaaagacttacagttgtaatctaggacaaatagaacagccctagacgacgccgaaggaccaccgggtcgtgtaaacttcgnggttgtagagacgcagtgaacgtaacgggtgaagttaaccggggtggggttgtaagg

SEQ ID NO: 369582 - DNA, 757 bp, Homo sapiens
  misc_feature: GZ8MTXP01BWQEV.15.23.C01.1.454.CMB.2.raw
  modified_base (701)..(701): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttcctgttgctattttagaaggtgtccagtgcgaggagcagctggtggagtcgtgggggaggcctgggtccgagggcccgggggggtccctggacgtctcctcgtgcgcccgtctcgtcgactctacttagagtctagttgagtggcgtcggtcggtcccgcgacggtccgtacggggaagggggacgggtcgtaggggtaggggtcggggtacggaaccaaacgtaaaggtaaaagggaagtaggtaaaggaacgtaacgaaacgtaaaacctacgttaaaaggttcgggtaacggtacccgttgggttacgggttaaacggggaaaccggggtacccgtttaacttaccccgaaacccgtacttcccaaccggaaaggaaaccgaaacccgtaaaacccgacgtaaaagtacctttacgaggttactactttaccggaaggtaaacgtaaagtaccgaaacgtaccggtaccgaggaaacgggacccggaccggtaacgggaccgtaccggtgttaagttattcggtggttagaggaggancgagtaacggaacgtaagggtaacgaaccggggttacggggttggttaagtaacgg

SEQ ID NO: 369583 - DNA, 634 bp, Homo sapiens
  misc_feature: GZ8MTXP01DF35O.15.23.C01.1.454.CMB.2.raw
  modified_base (589)..(589): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgctattttagaaggtgtccagtgcgaggagcagcgtggtggagtcgtgggggaggcctgggtccgaggcccggggggtccctggagactctcctgtcgcccgcctctggactctacctttagagctattggatgagcgtgggtcccgccgaggcctaccggagggggaagggggctagggggaggtgggggtacggaccaaacgaagtaaaagggagtagtagggaagtacaagaaaaccacgtaaatggtggtactcgtaggtaggaaacggggcctattaccaacctagtcctaccgaagacgaaccaaacgaccaaagtacttcgagtgtatcgtaggaaactaaagtacgaacagccctagacgacgccggaagggaccacgggtcgttaagtaacttacgtggttagtaggagacgnaagtgaaaccgtaagggtagaacggttaacggggtgggttgaagg

SEQ ID NO: 369584 - DNA, 1032 bp, Homo sapiens
  misc_feature: GZ8MTXP01DLD9R.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcttgggttttccttgttgcttattttagaaggtgtccagtgcgaggagcagcgtggtggagtcggtgggggacggccgtggtccgacgggtcccggggggtccctggagtacctctccgtgtcgcccgtcctcgtcggactctaacctttagacgtcttagttggaattggacgtccggttcggggtccccgacccgaggggtccccttacccgggaaaggggggggtaaacggggggtccgttaggggggaacgggtttcggggggttaccgggaaacccccgtaaaaacgtaaaagggttaaaaaaagggggaaacggtaaggttaacgggggaaaacgttaaccgaaaaggtaaaaaaccctacgttaaaggttacgggttaacggggtaaccctttaccgggtagggttaaacgggggaaaacccggggggtccccgtttaaacgtttacccccgaaaacccttaacgttttacccccgtaaccccggaaaagggtaaacccgggaaaacccaaaaaccccggggtaccccctaaaaaaaggggttaaaccttttcccggaaaagggtttaggttaaactttaaccccggttaggggaaaaaccccttaaaaaaggtttaccgggaaaaaaccccgacgggtaaccccccgttagggggaaaacccgggtaaacccgggggaaccccggggttaaaacggggaccccgggtaaacccgggggtttaccccggtttaaagggttttaaccgttttacggtaggggttacgggttaaaggaacgaaacgggaccttaaaggttaaccggggaaaccgtaaaccgggggtttagaaaccggggtttaaaaccggggggttgggggtttaacgttaagggg

SEQ ID NO: 369585 - DNA, 715 bp, Homo sapiens
  misc_feature: GZ8MTXP01BYOFN.15.23.C01.1.454.CMB.2.raw
  modified_base (374)..(374): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccaggccggggggtccctgagactctcctgtcgcccgcctctggactcacctttagagctattggatgagcgtgggtccgccaggctcgaggggagggctgggagtgggtgaccaagagtaaaggagatacggaagtacaagaaacncgtaaatggtcggactcgtggtacggaaacggggcccgtaatttcccgaccctaagttcccgtacccgaaggtaaccgaaccgaaaaccggaccccaaaaggtaactttaccgaagggttagttaaacgttccgttaggggaacctaaaaagttcgaaaaccgtacggccccgttaaggaacggaaacgggccccgggaagggaaccccgtaaccggggtcccgttaaggttaactttaccggtggttaggtacgggaagacggttacgttaagtaacgggaaaccgtaaacggggtaggaaacggttaaacccggggggtaagggggtttaacgtaaggg

SEQ ID NO: 369586 - DNA, 546 bp, Homo sapiens
  misc_feature: GZ8MTXP01ASTNC.15.23.C01.1.454.CMB.2.raw
  modified_base (449)..(449): a, c, t, g, unknown or other
  modified_base (465)..(465): a, c, t, g, unknown or other
  modified_base (469)..(469): a, c, t, g, unknown or other
  modified_base (513)..(513): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctggggttttccttgttgctattttagtaaggtgtccagtgcgaggagcagctggtggagtcgtgggggaggcctggtccgagccggggggtcccgtgagactctctgtgccgcctctggactcacctttagtagctattggatgagcgtgggtcccgccaggctccgaggggaagggggcgtggaggtgggtggaccaacaagtaaaggaagagtacggaagtacaagaaacactaaatgtggactcgtgtggaagggcgattcaccatctacagagactaacgcaagaattcagngtatctggacaaagtnaacngctgagagccgaggacacggcgtgtattacgtgttgtgagacgnatgacaacggtgacgttaacgggtgggttgaag

SEQ ID NO: 369587 - DNA, 632 bp, Homo sapiens
  misc_feature: GZ8MTXP01CPL1I.15.23.C01.1.454.CMB.2.raw
  modified_base (522)..(522): a, c, t, g, unknown or other
  modified_base (593)..(593): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggaggtcgtgggggaggccgtggtccgagggccggggggtccctggacgctctcctgtcgcccgcctcgtcggactctacctttagagctagttggatggacgcgtgggtcccgccgaggcctaccggagggggaagggggcgtgggaggtggggtggaccaaacgaagtaaaagggaagagtaggaaagtcaaagaaacacgtaaagttggtggtaactcgtaggtagggaacgggccgtattccacccatcctacgaagacgacaaacgaccaaagacttcagtgtactcgtaggaactaaaagtcgaaacncgcctagggaacgacggccggaaggaccgacggggtcccgttaagtacttacgtggttgtaggagacgaangtaagacgtaaggtagaacggttacggggtggttgtaag

SEQ ID NO: 369588 - DNA, 801 bp, Homo sapiens
  misc_feature: GZ8MTXP01CRFWH.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgctattttagagtgtccagtgcgaggagcagctggtggagtcgtgggggaggcctgggtccgagggcccgggggggtccctggagacctctccgtgtcgcccgcctcgtggactctacctttagagctattggatgagcgtgggtccgccgaggcctaccggagggggaaggggcgtgggagtcggggtaggacccaaagaagtaaaagggagaagttagggaaacgtacaaagaaaactactaaagtacgttgggaacttcgtagggttagggaaacggggtcccgtaattacccgaacctactccgtaccaaggaaacgaaaccgaaaccggaacccaaaaggtaaactttaccgtaaagttaggttaaacttaccgtaacggggtaacctaaaaaagttacggaaaaccacggaccccgtaggaacggaacgggccccggtaaagggaacccgtacccggggtacccgtttaaggttaaaccgtttacggttacgggttagggttaacggtaacggaaagggttaaaccgttaaacggttaaagggaaaacccgggtaaaaccgggggtttaggtaaaacccgggggttaaaaccggggggttaacggggggtttaacgtttaaaaggggg

SEQ ID NO: 369589 - DNA, 616 bp, Homo sapiens
  misc_feature: GZ8MTXP01BVCCV.15.23.C01.1.454.CMB.2.raw
  modified_base (355)..(355): a, c, t, g, unknown or other
  modified_base (464)..(464): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttctgtgctatttagaggtgtcagtgcgaggagcagctggtggagtcgtgggggagcctggtccgaggccgggggggtccctgacgctctcctgtcgccgtcctctcggactctacctttagagctagttggatggagcgtgggtcccgccagggcctaccggagggggaacgggctggggaggtgggtgaccaaanaggtaaaggagatagggaatacaaggaaaacctgtaaagtggtggactcgtggtacggacggggtacattaccactatccacgagacgaacaacgcaaagtatcagttntactcagaacaagtacgacgcgctaggacgaccggtacggaggtaccgtacgggtcgttaagttaacgttgtggttaaggtacggaagacgttacgaggtaacggaacggtaacgggttaggaaaccggggttacgggggttggttaagtgg

SEQ ID NO: 369590 - DNA, 616 bp, Homo sapiens
  misc_feature: GZ8MTXP01DIK8V.15.23.C01.1.454.CMB.2.raw
  modified_base (325)..(325): a, c, t, g, unknown or other
  modified_base (475)..(475): a, c, t, g, unknown or other
  modified_base (554)..(554): a, c, t, g, unknown or other
  modified_base (610)..(610): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgttgggttttccttgttgcttattttagaaggtgtccagtgcgaggagcagcgtggtggagtcgtgggggaggccgtggtccgagggcccggggggtccctggacgtactcctccgtgtcgcccgcctcgtggacctcacctttagagcttagttggatgagcgtggtcccncaggctccgaggggagggctgggaggtgggtcgaccaaagaagtaaaaggagataggaatacaagaaacactaagtgtggacttcgtaggtaggaacgggccgtattccacctatcctacagacgaaccaaacgccaaagtactcgagtntatctggaaactaaagtcgaaactgcctaggaacggaacgcccggaaggacccgtacgggtcccgttaagttattacgnggttagtagagaacgcaagtcggaaacgtgggtacgaacggttacggggtgggttntaaggg

SEQ ID NO: 369591 - DNA, 664 bp, Homo sapiens
  misc_feature: GZ8MTXP01AXPEM.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcgtgggggagccgtggtccgagggcccggggggtcctgagactctcctgtcgcccgtcctcgtcggactctacctttagagcttagttggatgacgcgtgggtcccgcgaggtcctaccggaagggggaacgggggctggggaggtcggggtacggaacccaaagtaaaggtaaaaagggaagaagtacgggaaacgtcgaaagaaaaccacgttaaagtggtggacttcgtggtagggaacgggtccgtattaccacccgatccacgagaacgacaaacgtcaaagtattcaagtcgtaatcgacgaacaaagtcgaacacgcgagaacggtacgaccggaacggtaccgaccgggtcgttaagttaacgttgtgacgggtacggaagttacgcagtaacggaaacgtaacgggtaggtaacgggttaacgggggtgggttaagtcggg

SEQ ID NO: 369592 - DNA, 728 bp, Homo sapiens
  misc_feature: GZ8MTXP01BU571.15.23.C01.1.454.CMB.2.raw
  modified_base (302)..(302): a, c, t, g, unknown or other
  modified_base (325)..(325): a, c, t, g, unknown or other
  modified_base (558)..(558): a, c, t, g, unknown or other
  modified_base (588)..(588): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttggttttccttgttgcttattttagaaggtgtccagtgcgaggagcagcgtggtggaggtcgtgggggacggccgtgggtcccgacggggcccggggggtccctgacgacctctcctgtcgcccgcctcgtcggactctacctttagngctatggatgagcgtgggtcccncgaggcctaccggagggggaacggggctagggaggtgggggtacggacccaaacgaaggtaaaagggaagtacgtaaggggaaacgttacgaaacggaaaactacgtaaagttgggtaacgggtaccttcgggtaggtacggggaaaccggggtccgtaaatttcccaacctactccctacccgaaggaacgaaaccctaaaccggaccctaaaaggtacttaccgaaggttntaaactcgtagggaactaaaagtgaaaccncggaccctaggaacggaccggtacccgggaaaggaccccgcggggtcccttaagttaaccgtttagtggttggtacgaagttacgacagtaacgaacgtaacgggtgaaacgggttaaccggggtggggttaagtaaggg

SEQ ID NO: 369593 - DNA, 662 bp, Homo sapiens
  misc_feature: GZ8MTXP01CDWRU.15.23.C01.1.454.CMB.2.raw
  modified_base (311)..(311): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggagccgtggtccgaggccggggggtccctgagactctcctgtcgcccgctctggactctacctttagagctattggatgagcgtgggtcccncgaggcctccgagggggaagggctgggaggtggggtgaccaaagaagtaaaaggagagtaggaaagtcaagaaacacgtaaagtggtggacttcgtggtacggaacggggtccgtattacccgacctatcctaccgaaggtaacgaacccaaaaccggaccaaaaggttaactttaccgaaggttacgtaattccgtaagggaacctaaaatcggaaacagcccgtaaggaacgacggccgaagggaccaccggggtcgttaagtaattcgtgttaggtaagaggaacgcgaagtcggaaaacccgtaaggggttgaaaccgggttaaaccgggggtgggttaagtaaggg

SEQ ID NO: 369594 - DNA, 619 bp, Homo sapiens
  misc_feature: GZ8MTXP01CK5NH.15.23.C01.1.454.CMB.2.raw
  modified_base (502)..(502): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccgggggggtccctgagactctcctgtcgccgcctctcggactcacctttagagctattggatgagcgtgggtccgccgaggctccgaggggaagggggctgggaggtgggtcggaccaaagaagtaaaagggagagtagggaaagtcaagaaacactaagtgtggactcgtggtaggaacggggccgtattccgaccctatcctaccgaagacgaccaaccgaccaaagtaacttcaagttgtactcgtaggactaaagtgaaacncgaccctggaacgacggcccggaaggacccgacgggtcccgtaagtaacgtttcgtggttgtaggagagcagtcgaacgtaacgggtgaacggttaaccggggtggggttcgtaagg

SEQ ID NO: 369595 - DNA, 640 bp, Homo sapiens
  misc_feature: GZ8MTXP01CZTDP.15.23.C01.1.454.CMB.2.raw
  modified_base (308)..(308): a, c, t, g, unknown or other
  modified_base (394)..(394): a, c, t, g, unknown or other
  modified_base (565)..(565): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccgaggcccggggggtccctgagactctcctgtgcccgcctctggactctaccttagagctattggatgagcgtgggtccncaggctccgaggggagggctagggagtggggtgaccaaacgaagtaaaaggagagtaggaagtcaaggaaaccacgtaaagttcgnggtactcgtaggtcggaaacggggtccgtattccaccctaattcctaccgaagaagaacccaaaccgtaccaaagtaacttcgagttgtatcgtggaacaaagtacgaaacagcccgtagaacggacgtccggaggaccgcggggtcccgttaagtaacttacggttaggnggtaagacggagaccgagttaacggaaaccgtaacgggttagaagggttaaacccggggtgggggtttgtaaggg

SEQ ID NO: 369596 - DNA, 699 bp, Homo sapiens
  misc_feature: GZ8MTXP01BFMTK.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggagcctggtccgaggccggggggtccctgagactctcctgtgcccgcctcgtggactctacctttagagctagttggatgagcgtcgggtcccgcgaggcctccggaagggggagggggctgggaggtggggtcggaccaaacgaagtaaaagggaagagtacggaaagtcaaagaaacactaaagtggtcggactcgtaaaggtcggaacggggccctattcccaaccctattccaccgaagacgaacctaaaccgaccaaaagtacttcaagttgtaactcgtacgggaactaaaagcgaaaccgacgcccgtaaggaacggaccgggacccggaacggggttaacccgaaccggggtcccgttaagttaaacgtttaccggtggttgggtaagaaggaacggaccaagttaaccggaaacgtaaacggggttaggaaacccggtttaaaccggggggtggggttttaacgtaaggg

SEQ ID NO: 369597 - DNA, 741 bp, Homo sapiens
  misc_feature: GZ8MTXP01CLZ13.15.23.C01.1.454.CMB.2.raw
  modified_base (313)..(313): a, c, t, g, unknown or other
  modified_base (445)..(445): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggagccgtggtccgagggccggggggtccctgagactctcctgtcgcccgctctggactctacctttagagctattggatggagcgtgggtcccncgaggctcggaagggggagggcgtgggaggtgggtaggaccaaagaagtaaaagggaagagtacggaagtacaagaaacactaaagtggtggacttcgtaggtacggaacggggtccctattcccgaaactntaccgtaccgaagaacggaaccaaaccgtaccaaaagtacttacgaagttgaaacttcgtaggaactaaaagtccgaaacgagtcccgtaggaaaccggacggaccccgggaaagggtacccctaacgggggttccgtttaagtttaaaccgtttacggttacgggttagggttaacggggaacgttaaaacggacgttaaaccggttaaggggaaaaaccccggtttaaacgggggttcgggtaaaaacgggggtttaaaaccccggggggggtggggggttttaacgtaacggg

SEQ ID NO: 369598 - DNA, 621 bp, Homo sapiens
  misc_feature: GZ8MTXP01CZSVF.15.23.C01.1.454.CMB.2.raw
  modified_base (522)..(522): a, c, t, g, unknown or other
  modified_base (574)..(574): a, c, t, g, unknown or other
  modified_base (617)..(617): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctcctgtcgcccgcctctggactcacctttagagctattggatgagcgtgggtcccgccgagggcctaccgaagggggaagggggctgggggaggttgggggtcggacccaaacgaagtaaaaggggaagtagtagggaaagtacaagaaaaccactaaatggtggactcgtggtaggaacggggcctattccaacctatcctaccgagacgaaccaaacgacccaaagaactttcagttgtaatccgtaggaactaaaagtcgaaacncgccctaggaacgacggccggaaggaccaccgggccgttaagtattacgtgngtagagagcagtgaacaacgggtgacggttaacgggtgggttnaagg

SEQ ID NO: 369599 - DNA, 727 bp, Homo sapiens
  misc_feature: GZ8MTXP01A5OFF.15.23.C01.1.454.CMB.2.raw
  modified_base (309)..(309): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggagcctggtccgagggccggggggtccctgagactctcctgtcgcccgctctggactcacctttagagctattggatgagcgtgggtccnccgaggctccggaggggaagggctgggagtgggtgaccaaagagtaaaggagataggaagtcaagaaactctaaagtggtgacttcgtaggtaggaacgggccgtattacccacccgtaattcccgtaccccgaaaggaacgaaaccgtaaaacccgacccgtaaaaggtaaactttcccgaaaggttaccgttaaatcccgttaaggggaaacctaaaaagtaccggaaaaccgtacggtcccgtaaggaaaccggaaccggttacccgggaaacggggtaaccacccgggggtacccgttaaggttaaatttaaccggtgggttagtacggaacgaaggttaccaaagggttcggaaaccccgtaaaggggtcgtaaaacgggttaacccgggggtaaggggtttaacgtaacggg

SEQ ID NO: 369600 - DNA, 620 bp, Homo sapiens
  misc_feature: GZ8MTXP01CUSZN.15.23.C01.1.454.CMB.2.raw
  modified_base (306)..(306): a, c, t, g, unknown or other
  modified_base (493)..(493): a, c, t, g, unknown or other
  modified_base (564)..(564): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgccgcctctggactcacctttagagctattggatgagctgggtcccnccgagggctcccgagggggaaggggctggggagtgggggtaggaccaaacgataaaagggagaagtagggaaagtacaagaaaaccactaaagtggtggacttcgtggtaggaacggggccccgattcccaacctatccctaccgaagaacgaaccaaacgccaaaagtaacttcgagttgtatcgngggaacaaaagtcgaaacagccctagaagacggccggaaaggcctaacggggcctaaggttattacgttgngttagaggagcagtaagaaccaagggtgtaacgttaaccgggggtggggtttgaag

SEQ ID NO: 369601 - DNA, 666 bp, Homo sapiens
  misc_feature: GZ8MTXP01BGTJF.15.23.C01.1.454.CMB.2.raw
  modified_base (297)..(297): a, c, t, g, unknown or other
  modified_base (321)..(321): a, c, t, g, unknown or other
  modified_base (404)..(404): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctgggtggagtcggtgggggagccgtgggtccgagggccggggggtccctgacgactctcctgtcgcccgtcctcgtcggacttcacctttagngctagttggatgagcgtgggtccnccaggctccgaggggagggctgggaggtgggtagaccaaagagtaaaaggaagagtaggaaagtacaaagaaacacttaaagnggtcggactcgtaggtacggaaacggggccgtaattccaccctatccctaccgaagaacggaacaaaccgaccaaagtaacttcgaagtgtataccgtaggaactaaaagtcgaaacgcgacccgtaggaggaaccggccggtaagggaccgtaccggggtcccgttaaggttaacgtttacggttggttggacgaagaacggacttagtggaaacgaacgggttaaggaacggttaaccgggtaagggggttaagtaaggg

SEQ ID NO: 369602 - DNA, 687 bp, Homo sapiens
  misc_feature: GZ8MTXP01DUN23.15.23.C01.1.454.CMB.2.raw
  modified_base (306)..(306): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtcagtgcgaggagcagctggtggagtcgtggggggagcctggtccgaggccggggggtccctggagactctctgtcgccgcctctggactcacctttagagctattggatgagctgggtccncgaggctccggaggggaagggggctagggaggtgggggtgaccaaacgaagtaaaagggaagaagttagggaaagtacaagaaaacacttaaatggtcgggaacttcgtaggttaggaaacgggggtcccgtaatttcccgaaccctaattcccgtacccgaaggaaacgaacccgaaaacggacccaaaggtaaattccaaggttacgtacttaccgttaggaaccgtaaaagtcgaaactggaccctaggaagaacggcccggagggaacctcgggtaccgttaagttaacttaaggttggttagtaggaaggacgacttacgtaacggaaacgtaacgggttaaggaaccggttaaaccgggggtggggtttgtaagg

SEQ ID NO: 369603 - DNA, 708 bp, Homo sapiens
  misc_feature: GZ8MTXP01AJYAY.15.23.C01.1.454.CMB.2.raw
  modified_base (291)..(291): a, c, t, g, unknown or other
  modified_base (320)..(320): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcgtgggggagccgtggtccgagggccggggggtccctgagctctcctgtcgcccgcctcgtggactctacctttagngctagttggatggacgtcgtcgggtcccncgaggcctaccggagggggacggggctgggaggtcggggtacgacccgaaagaagtaaaaggaagtagtaggaaagtcaaagaaactacgtaagttcgtggtacctcgtagggtacggaacggggtcctaactttacccaacctaagtcccgtaaccgaaaggaaccgaaacccgaaacccggaccctaaaaggttaactttaccgaagttacgttaacttaccgtagggaaactaaaagttacgaaaaccgtacggacccgtaggaacgaaccggcccggaaacggtaccgaccgggtcgttaagttaagttacgtggttgaggaacgttagacgttagaacggaacgtaaccgggtgaacggttaccggggtaagggttcgtaagg

SEQ ID NO: 369604 - DNA, 642 bp, Homo sapiens
  misc_feature: GZ8MTXP01B6MAB.15.23.C01.1.454.CMB.2.raw
  modified_base (310)..(310): a, c, t, g, unknown or other
  modified_base (595)..(595): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccgaggccggggggtccctgagactctcctgtcgccgcctcgtggactcacctttagagctattggatggagcgtgggtccnccgaggcctaccggagggggaagggcgtgggaggtggggtggaccaaagaagtaaaaggagagtagggaaagtacaaagaaaacacgtaaagtggtggacttcgtaggtacgggaacggggccgtaattcccaccctatcctaccgaaggaacgaaccgaaaccgaccaaaagtaacttcgaagttagtaactccgtaggaactaaaagtcgaaacgtacgcccgtaaggagaacggccggtaaagggaccaccgggtctaagtaattacgtgttgtagagacgnagtaagaaccgtaagggtagaacggttaaccggggtggggttgaagg

SEQ ID NO: 369605 - DNA, 677 bp, Homo sapiens
  misc_feature: GZ8MTXP01EVQID.15.23.C01.1.454.CMB.2.raw
  modified_base (313)..(313): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggaggcctggtccgaggccggggggtccctgagactctcctgtcgcccgcctctggactcacctttagagctattggatgacgcgtcgggtccnccgaggcctccggaagggggaagggggctgggaggtgggggtaggaccaaacgaagtaaaagggaagagtagggaaagttacaaagaaaacacttaagtggtggacttcgtggtagggaaacggggtccgtatttcccgacctaattcctacccgaagaacgaacaaaccgaccaaaagtaactttcgaagttagtaactccgtagggaactaaaagttcgaaaccaggccctaggaacggaaccggaccggtaaggaacccgaaccggggtcccggttaagttaactttaacggtggttggtagaaggttagacttaggtaagaacgaacggtggaacggttaaaccggggtgggttgtaagg

SEQ ID NO: 369606 - DNA, 547 bp, Homo sapiens
  misc_feature: GZ8MTXP01AMX7R.15.23.C01.1.454.CMB.2.raw
  modified_base (469)..(469): a, c, t, g, unknown or other
  modified_base (509)..(509): a, c, t, g, unknown or other
  modified_base (513)..(513): a, c, t, g, unknown or other
  modified_base (538)..(538): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtcacgtgagactctcctgtgccgcctctggactcaccttagagctattggatgagctgggtccgccaggctccgagggaaggggctggagtggggtggaccaaacagtaaaggagagtaggaagtcaagaaacaactaatgtggactcgtgtagaaggggccattccaccagtctccagagacaacgccaaagattcagtgtatctgacaaatgaaacagcctggacncgccgaggaccacgggccgtagttatacttggtagtgagngacngtgaacgagggtgaagtaaccgggnggggtaacg

SEQ ID NO: 369607 - DNA, 754 bp, Homo sapiens
  misc_feature: GZ8MTXP01DY2U8.15.23.C01.1.454.CMB.2.raw
  modified_base (311)..(311): a, c, t, g, unknown or other
  modified_base (407)..(407): a, c, t, g, unknown or other
tcagtctacgtagccacgaccggtgctcgatttagtacacgtgattagggattgggaggtctcagagaggagccttagccctggactccaaggccctttccacttggtgatcagcactgagcacagaggactcaccatggagttggggctgagcttgggttttccttgttgcttattttagaaggtgtccagtgcgaggagcagctggtggagtcgtggggggagcctggtccgaggccggggggtccctgagctctcctgtcgcccgcctcgtggactcacctttagagctattggatgagcgtggtccnccgaggcctccggagggggaaggggctggggaggtggggtacggaccaaagaagtaaaagggagacgtacgggaaagtcgaaagaaacacttaagnggtggacttcgtgtaggaacggggcctaagttccaaccctataccctacccgaagaacgaaccctaaaaccggaccctaaaagaacgtttaccaaggttaggtaaacttccggttaagggaactaaaaggttacgaaaccgtacggaccccgttaagggaacggaaaccgggcccgggtaaacggggaacccggtaaccgggggtccccggttaagtttaacgtttaacggttggttagggtaaacggtaagaagggttaacccagggtttaaccggaaaaccgtaacgggggttaaggtaaccggggttaaaaccggggggtaagggggttttaacggtaaggggg

SEQ ID NO: 369608 - DNA, 621 bp, Homo sapiens
  misc_feature: GZ8MTXP01BTQG4.15.23.C01.1.454.CMB.2.raw
  modified_base (274)..(274): a, c, t, g, unknown or other
  modified_base (390)..(390): a, c, t, g, unknown or other
  modified_base (573)..(573): a, c, t, g, unknown or other
  modified_base (615)..(615): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcgtgggggaggccgtggtccgaggccggggggtccctggagctctcctgtcgcccgcctntggactctacctttagagctattggatggagcgtgggtcccgcgaggctccggaggggaaggggctgggaggtgggtggaccaaagaagtaaaggagagtggaaagtcaagaaacnctaaagtggtggaacttcgtggtaggaacgggtccgtattaccacctatccgtaccagacaacgaaacgccaaagtacttcagttagtacttcgtaggaacaaagttcgaaaacacgcctaggacgacggccggtaaggaccgtacgggtcctaagttacttagtgttacgtgaagttacganaggtaagaacgaacgggttgaacggttacggggtaagggttntaaggg

SEQ ID NO: 369609 - DNA, 663 bp, Homo sapiens
  misc_feature: GZ8MTXP01B5H9U.15.23.C01.1.454.CMB.2.raw
  modified_base (314)..(314): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgttgggttttccttgttgctattttagaaggtgtccagtgcgaggagcagctggtggagtcgtgggggagcctggtccgaggcccggggggtccctgagctctcctgtcgcccgcctcgtggactctacctttagagctagttggatgagcgtgggtcccnccgaggcctaccggagggggaagggcgtgggaggtggggtcggaccaaagaagtaaaggaagagtagggaagtacaagaaacactaaagtggtggactcgtggtaggaacgggcccgtattcccgacctatccctaccgaaggacgaaccaaaccgccaaaggtaactttcgaagttgtaactcgtagggaacttaaaagtcggaaacctacggccctaggaacgaacgggcccgaaagggaccctaccggggtccgttaaggtaactttacgtgggttagaggaagacgccttaagtcggaaacgtaacgggtgaaaccgggttaaccgggggtggggttctaagggg

SEQ ID NO: 369610 - DNA, 701 bp, Homo sapiens
  misc_feature: GZ8MTXP01EAIKT.15.23.C01.1.454.CMB.2.raw
  modified_base (310)..(310): a, c, t, g, unknown or other
tcagtctacgtagccacgaccggtgctcgatttagtacacgtgattagggatttgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggagcctggtccaggccggggggtccctgagctctcctgtcgcccgcctctggactctaacctttagagctattggatgagcgtggtccncgaggctccggaggggagggctgggaggtgggtaggaccaaagaagtaaaggaagagtaggaagtacgaagaaactacgtaatggtggtactcgtagggtaggaacggggcctatttaccacctattcctaccgaaggaacgaaccaaaccgacctaaagtaacttcgaagttgtaacttcgtacggggaactaaaagttcgaaacgacgtcccgttaggaacggaacggaccccgggaagggacccgtaacccggggtcccggtttaagtttaacgtttaccggttaggtttagagggtaaggaaacgggttaccttaaaggttaacggaaaccggtaaacggggttaggtaaacggttaaaccgggggttgggggtttaacgttaaggg

SEQ ID NO: 369611 - DNA, 632 bp, Homo sapiens
  misc_feature: GZ8MTXP01BPPZL.15.23.C01.1.454.CMB.2.raw
  modified_base (316)..(316): a, c, t, g, unknown or other
  modified_base (498)..(498): a, c, t, g, unknown or other
  modified_base (516)..(516): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggacctcaccatggagttggggctgagctgggttttccttgttgctattttagaaggtgtccagtgcgaggagcagctggtggagtcgtgggggagccgtgggtccagggccgggggggtccctgagactctcctgtcgcccgcctcgtggactcgtacctttagagctagttggatgagctgggtcccncgaggctccgaggggaagggctgggagtgggggtcggacccaacgaagtaaacgggagacgttagggaacgtacaaggaaaacctacgttaaagtgtggaccttcgtaggtacggaaggggccctaatttccaccctagtccctacagacacaacgccaaagacttcgagttagtacttacnggaactaaagtgaaacgngtcccaggacgacggccggaaggtaccacggccgttgtaactttacgtgttgtagaagttcgacttagtaagaaccgtaacgggtaggaacgttaaccggggtgggttaagtaagg

SEQ ID NO: 369612 - DNA, 684 bp, Homo sapiens
  misc_feature: GZ8MTXP01A8K6D.15.23.C01.1.454.CMB.2.raw
  modified_base (360)..(360): a, c, t, g, unknown or other
  modified_base (520)..(520): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggagcctggtccgaggccggggggtccctgagctctcctgtcgccgcctctggactcacctttagagctattggatggagcgtgggtcccgcaggctccgaggggagggctgggagtgggtcggaccaaagagtaaagganagtaggaaagtcaagaaacacgtaaatggtggactcgtgggttacggaaacggggtcccgaatttcccaaccctaattccctacccgaaggaaccgaaaccaaaccggacctaaaagtaactttcgagttagtatctacgggactaaaagtcgaaaccgngtaccccgtagaacggaacggacccggtaaagggtaaccgaccggggtacccggttaagttaacgttttaaccggtggttaggtaggtaaggaacgttacgttagtaaggaacccgtaaaggggttacggaaaggttaaaacccgggggtggggtttgtaaggg

SEQ ID NO: 369613 - DNA, 660 bp, Homo sapiens
  misc_feature: GZ8MTXP01DEP5A.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcggtgggggacggccgtgggtccgacgggcccggggggtccctggacgacctctccgtgtcgcccgcctctcggactctactttagagtctagttggatggagtcgtgggtcccgccgaggcctaccggagggggaacgggggcgtgggaggttgggggtacggaccaaagaagtaaaagggagagtaggaaagtacgaagaaaactactaagtaggtggaactcgtaggtagggaacggggccgtactccaaccgtactcctaccgaagacgaaccaaacgaccaaagtaacttcaagtgtactctaggaactaaagtagaacacgccgtagacggacggacccggtaggacccgacgggtcgttaagttaacgttacgtggttagtaggagacgattagtaacgaagtaacgggtagacggttaacggggtgggttaagtaagg

SEQ ID NO: 369614 - DNA, 670 bp, Homo sapiens
  misc_feature: GZ8MTXP01C4QFY.15.23.C01.1.454.CMB.2.raw
  modified_base (512)..(512): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcgtgggggaggccgtgggtcccgagggcccgggggggtccctggagacctcctccgtgtcgcccgcctcgtggactctacctttagagctattggatgagtcgtgggtcccgccgagggcctaccggaagggggaacgggggctagggggaggttcgggggtacggaccaaacgaagtaaaaggggagtagtaggaagtacaagaaaaccactaagtgtggactcgtggtaggaacgggccgtattcccgaacctagttccaccgagaacgtaacaaaccgaccaaagtattcaagttntatcgagaactaaagacgaacgacgccgaggacggaaccggaccggaacggaccgtaccgggtcgttaagttacgttacgtggttagtagaagaacgacgttagtaacgaaacggtaagggtacggtaacgggttacgggggttaagggttgtaacgg

SEQ ID NO: 369615 - DNA, 567 bp, Homo sapiens
  misc_feature: GZ8MTXP01D2QUG.15.23.C01.1.454.CMB.2.raw
  modified_base (438)..(438): a, c, t, g, unknown or other
  modified_base (479)..(479): a, c, t, g, unknown or other
  modified_base (503)..(503): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgctattttagaaggtgtccagtgcgaggagcagctggtggagtcgtgggggagcctgggtccgaggccggggggtccctgagactctcctgtcgcccgcctctggactcacctttagagctattggatgagctgggtccgccgaggctccgaggggaacggggctgggaggtggggtcggaccaaacgagtaaaaggaagagtaggaagtcaagaaaacactaagtgtgggactcgtaggtgaaggggccgattcccactatctaccaganacaacgaccaaagacttcagtgtatcaggacaaatgaaacngctagagacgcgagacacggcgtntacttctggttgtagagagcagtgaacgaacgggttgaacggttacggggtaagggttgtaagg

SEQ ID NO: 369616 - DNA, 648 bp, Homo sapiens
  misc_feature: GZ8MTXP01BBBPZ.15.23.C01.1.454.CMB.2.raw
  modified_base (518)..(518): a, c, t, g, unknown or other
  modified_base (569)..(569): a, c, t, g, unknown or other
  modified_base (578)..(578): a, c, t, g, unknown or other
  modified_base (590)..(590): a, c, t, g, unknown or other
  modified_base (647)..(647): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggagcctggtccaggccggggggtccctgagctctcctgtcgccgcctctggactctacctttagagctagttggatgagcgtcgggtcccgccgagggcctaccggagggggaacggggctggggaggtggggtcgaccaaacgaagtaaaaggagagtaggaaagtacaagaaactacgtaaatgggtcggaactcgttagggtacgggaacggggtcccgtaatttcccgaaccctattccccgaccgaaaggaacgaaccctaaacggccaaaaggtaactttcgaagtgttacncgtagaacgtaaaatcggaaacctgcctaggaacgacgccggtaaggaccncgggtcgtnttaacttacggnggttgagaagagacttagtaacgaacgtaaggtaggtaacggttacggggtggttgng

SEQ ID NO: 369617 - DNA, 574 bp, Homo sapiens
  misc_feature: GZ8MTXP01AGQNB.15.23.C01.1.454.CMB.2.raw
  modified_base (309)..(309): a, c, t, g, unknown or other
  modified_base (349)..(349): a, c, t, g, unknown or other
  modified_base (380)..(380): a, c, t, g, unknown or other
  modified_base (530)..(530): a, c, t, g, unknown or other
  modified_base (573)..(573): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctgggtccaggccgggggggtccctgagactctcctgtcgcccgcctctggactcacctttagagctattggatgagcgtgggtccncaggctccgaggggagggctgggaggtgggtggaccaaanaagtaaaggagagtagggaagtcaagaaacnctaaagtggtggactcgtgtgaacgggcattccacatccacagacgactaaacgcaaagtacttcgaagttgtactctaggacaaagtcgaaaccagtccaggagtacgccgaggtaccacgggcgtgtaattcgtgttgtagaagcganagtaagacgtaagggtcgaaggttaaccgggtggggtttaagng

SEQ ID NO: 369618 - DNA, 782 bp, Homo sapiens
  misc_feature: GZ8MTXP01DILED.15.23.C01.1.454.CMB.2.raw
  modified_base (314)..(314): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccgaggcccggggggtccctggagactctcctgtcgcccgcctctggactctacctttagagctagttggatgagcgtgggtcccnccgaggcctccggagggggaacgggggctggggaggtggggtcggaccaaacgaagtaaaaggagagtagggaaagtacgaagaaacactaaagtggtggacttcgtgggtaggaaacggggtccgtattccgaaccctagttccctaccgaaggaacgaaaccaaaccgggtaccctaaaaggtaactttaccgaaggttacgttaacttccgttaaggggaaaccctaaaagtttacggaaaaccgaggtaccccgttaagggaacgggtaaccggcccgggtaaagggaacccgtacccgggggtccggtttaaggtttaaagtttaccggtgggttcgggttaaacgggaacggttaaaagggcccttaagggtttaaccgggaaaacccgggttaaccgggggttaagggtaaaccggggtttaaacccggggggttaaggggggttttaacgttaacggggg

SEQ ID NO: 369619 - DNA, 783 bp, Homo sapiens
  misc_feature: GZ8MTXP01BXS02.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggagccgtggtccgagggccggggggtccctgagcctctcctgtcgccgcctctggactcacctttagagctattggatgagcgtgggtcccgccgaggcctccgagggggaaggggtctaggggaggtgggggtcggacccaaacgaagtaaaacgggagagtagggaaagtacgaagaaaacctagtaaagttcgggtggtactcggttagggtacgggaaacggggtcccgaatttacccaaccctattcccgtacccgaaggaaccgtaaaccgaaacccggtacccaaaaggtaactttaccgaaggtttgtaacttccgtaggggtaaacctaaaagttacggaaacccacggtaccccgtaagggaacggaaacccggggaccccggtaaacgggggaacccgaccccgggggttcccggtttaaagggtttaaccttttaccgggtaggttacgggtacgggaaacggttaggaaccgttagttaacgggaaccgtaaacgggggttacggtaaaacggggttaaaccccggggggtaagggggtttcgttaagggg

SEQ ID NO: 369620 - DNA, 681 bp, Homo sapiens
  misc_feature: GZ8MTXP01C5KX5.15.23.C01.1.454.CMB.2.raw
  modified_base (609)..(609): a, c, t, g, unknown or other
  modified_base (628)..(628): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcgtgggggaggccgtggtccgagggcccggggggtccctggagactctcctgtcgcccgcctcgtggactctacctttagagctattggatgacgcgtgggtcccgccgaggcctaccggagggggaaggggctgggaggtggggtggaccaaagaagtaaaggagagtaggaagtacaagaaactacgtaaatggtggactcgtaggtaggaacgggccgtaattccaacctatccgtacccgaaggaaccgaaaccgaaaccgacctaaaaggtaactttcgaaggttcttaaactccgtagggaaacctaaaagtacgaaaccgacgtcccgtagggaacgaaccggcccggtaaagggacccgaccgggtccgttaagttaactttacggnggttagtaggagttaacgnagtcgaaaccgtaagggttacggaacgttaacgggggtaagggttcgtaaggg

SEQ ID NO: 369621 - DNA, 631 bp, Homo sapiens
  misc_feature: GZ8MTXP01EOO40.15.23.C01.1.454.CMB.2.raw
  modified_base (265)..(265): a, c, t, g, unknown or other
  modified_base (508)..(508): a, c, t, g, unknown or other
  modified_base (577)..(577): a, c, t, g, unknown or other
  modified_base (625)..(625): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcgtgggggagcctggtccgagggccggggggtcctgagactctcctgtgccncctctggactctacctttagtagctagttggatgagcgtgggtcccgcaggctccggaggggaaggggctgggaggtgggtcggaccaaagaagtaaaagggaagagtaggaaagtacaagaaaacactaaagtggtggactcgtagggtagaacggggtccgtattaccaccctatcctaccaaggaacaacgaaaccgaccaaagtaattcagtacgtaattctaggacaaaagtgaaacnggacctagaggaacgcggtaaggaccgacgggtccgtaagttaagttacgtggttgaggaacggacganagtggaactaaacggggtgaaacgggttaaccggggtaagggggtttntaaggg

SEQ ID NO: 369622 - DNA, 654 bp, Homo sapiens
  misc_feature: GZ8MTXP01DL9E9.15.23.C01.1.454.CMB.2.raw
  modified_base (305)..(305): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggggggagcctgggtccaggccggggggtccctgagactctcctgtgccgcctctggactcactttagagctattggatgagcgtggtccncaggctcgaggggagggcgtggaggtgggtcgaccaaagaagtaaaagggaagagtagggaaacgtacgaaaggaaaacctacgtaaagttggtcgggtaacttcgtagggtagggaacggggtccgtaacttacccaacctattcccgaccgaagaacgaaccaaaccggaccaaaagtacttacgagttgtacttaccgtagggaaacctaaaagtacgaaaccaggccctaggaacgaacggcccgaagggtaccgaccgggtcgttaagttaacgttcgtgttaggtagagttacgacttagtaacgaacgtaaggttgaacgttaacgggggtgggttgtaagg

SEQ ID NO: 369623 - DNA, 621 bp, Homo sapiens
  misc_feature: GZ8MTXP01ARS4M.15.23.C01.1.454.CMB.2.raw
  modified_base (500)..(500): a, c, t, g, unknown or other
  modified_base (515)..(515): a, c, t, g, unknown or other
  modified_base (559)..(559): a, c, t, g, unknown or other
  modified_base (571)..(571): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttcctgttgctattttagaggtgtccagtgcgaggagcagctggtggagtcgtgggggagcctggtccgagggcccggggggtccctggagactctcctgtcgcccgcctctcggacctctacctttagagctagttggatgagtcgtcgggtcccgcgaggcctaccggaagggggaacgggggctggggaggtcggggtacggacccaaaagaagtaaaaagggagtaacgtagggaaagtacaaagaaaaccacgttaaagtggtcggaacctgtaggtacgggaacggggcctattccacctatccaccgagacgacaacgtcaaagtattcgagtntatctaggactaaangaacagcctgacgacgccgtaggacacggtcgtaagtaacttgnggttgacggaancgacagtaacgacggtaaggtgacgttaaaccggggtgggtttaagaagg

SEQ ID NO: 369624 - DNA, 619 bp, Homo sapiens
  misc_feature: GZ8MTXP01B060D.15.23.C01.1.454.CMB.2.raw
  modified_base (311)..(311): a, c, t, g, unknown or other
  modified_base (382)..(382): a, c, t, g, unknown or other
  modified_base (554)..(554): a, c, t, g, unknown or other
  modified_base (614)..(614): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgctattttagaaggtgtccagtgcgaggagcagcgtggtggagtcgtgggggagccgtgggtccgagggccggggggtccctggagactctcctgtcgccgcctctggactcacctttagagctattggatgagctgggtcccncgaggctccgaggggagggctgggaggtgggtcgaccaaagaagtaaaaggagataggaagtcaagaaacnctaatgtcggactcgtggtagaacgggccgtattccacctagtcctaccaaggaacgaaccaaaccggccaaagtaacttcgaagttgttatcctagggaactaaaagtcgaaaccgtagccctaggaagacggccggtaagggacctacgggccgttaagttaacttacgngttagtaggaagagacttagtaacgaacgtaacgggtgaacggttaacggggtggggttntaagg

SEQ ID NO: 369625 - DNA, 808 bp, Homo sapiens
  misc_feature: GZ8MTXP01DZ91H.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaggtgtccagtgcgaggagcagcgtggtggagtcgtgggggaggcctggtccgaggccgggggggtccctggagactctcctgtcgccgcctctggactcacctttagagctattggatgagcgtgggtccgccgaggcctccggagggggaagggggcgtggggaggtgggggtcggaccaaacgaagtaaaagggaagagtaggaaagtacaaagaaacactaaatgtgggactcgtggtaggaacggggccgtaagttaccaaccctaattcccgtaccgaaggaacgaaaccaaaccggaccaaaaggtaactttccgaaggttacgttaaactccgttaggggaaacctaaaaagttacggaaaaccgacgggtaccccgttaaggggaacgggaaaccggggaccccgggtaaaagggggtaaaccccggaaacccgggggttccccggggtttaaaggttttaaacgttttaaccggttgggttagggttaaacgggaacgggttaaacgggaaaccttaaaggttaaccggggaaaaaccggttaaaacccggggggtttaggggaaaaaccgggtttaaaacccgggggggttaaggggggggtttttaacgtaaaggggg

SEQ ID NO: 369626 - DNA, 652 bp, Homo sapiens
  misc_feature: GZ8MTXP01DHC1Z.15.23.C01.1.454.CMB.2.raw
  modified_base (204)..(204): a, c, t, g, unknown or other
  modified_base (525)..(525): a, c, t, g, unknown or other
  modified_base (593)..(593): a, c, t, g, unknown or other
  modified_base (603)..(603): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagngtggtggagtcgtgggggagcctggtccgaggcccggggggtcctgagctctcctgtcgcccgcctcgtggactctacctttagagctagttggatggagcgtgggtcccgccgagggcctaccggagggggaagggtcgtagggaggtggggtacgacccaaagaagtaaaaggagagtaggaagtacgaagaaaccactaagtgtcggaacttcggtaggtacggaacgggcctattcccaaccattccaccgagaacgaaaccaaacgccaaaagtacttcgaagttcgttataccgtaggaactaaagtcgaaaccnggtcctaggaaggaccggaccgaaggaacccgtccggtccgtttaagttacttacgtggttgtaaggngttaacgacngttaacgaaacggtcgggttagaacggttaacgggggtggttcgtaagg

SEQ ID NO: 369627 - DNA, 644 bp, Homo sapiens
  misc_feature: GZ8MTXP01DND8H.15.23.C01.1.454.CMB.2.raw
  modified_base (319)..(319): a, c, t, g, unknown or other
  modified_base (585)..(585): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcttgggttttccttgttgcttattttagaaggtgtccagtgcgaggagcagcgtggtggagtcgtgggggagccgtggtccgagggcccggggggtccctgagacctctccgtgtcgcccgcctctggactctacctttagagctagttggatgagtcgtgggtcccncaggcctcgagggggaagggctgggagtggggtcgaccaaacgaagtaaaaggagacgtaggaagtacaaagaaaccacttaagtggtcggactcgtaggtaggaacggggcctattcccaaccgtattcctaccgagacgaccaaacgccaaagtacttcaagtgtaatctaggaactaaaagtgaaaccgacgccccggaagtacgacccggaaggtaccgaccggtcgttagtaattcgttggtgttgaacggagttaaccgngttacgaacgtaaacgggtgtaaacggtaccggggttaggggttaacgaagttttcggg

SEQ ID NO: 369628 - DNA, 731 bp, Homo sapiens
  misc_feature: GZ8MTXP01AHLKV.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcggtgggggacgccgtggtccgacggggtcccggggggtccctggacgctctccgtgtcgcccgtcctcgtcggtactctacctttagagtcttagttggataggagtccggtcgggtccccgccgagggtccctacgggaagggggacggggcgtaggggtaggtcgggggtacgaacccaaagtaaaggtaaaaaggaaggaagttacgggaaacgttacgaaacgtaaaaccacgttaaagtgggtaacggtactcgtagggtacgggaaacggggtccctaacgtttcccaacctacttacccgaccgaaagaaccggaaaccaaacccggaccgtaaaagtaccgtttacgaagttcgttaacgtccgtaggaaacctaaagtacaacgacgtccgaggacggacgaccggtaaggacccgtacggtcgttaagttacttacgtggcgtaagagttacgacttgtaacggaacgtaacgggtagaacggttaccggggtgggttaacgtaagg

SEQ ID NO: 369629 - DNA, 654 bp, Homo sapiens
  misc_feature: GZ8MTXP01BNXHU.15.23.C01.1.454.CMB.2.raw
  modified_base (409)..(409): a, c, t, g, unknown or other
  modified_base (486)..(486): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagtcgttgggttttccttgttgtcttattttagaaggtgtccagtgcgaggagcagcgtggtggagtcggtgggggaggccgtgggtccgagggcccggggggtccctggagctctccgtgtcgcccgtcctcgtcggactctacctttagagctattggatgagcgtgggtccgccgaggcctccggagggggaacggggctggggaggtggggtcgaccaaacgaagtaaaaggagtagtagggaatacaagaaacnctaagtgtggactcgtggaggaacggggcctattccactatcctacaagaacaacaaacggaccaaagtactcagtntatctaggggaactaaagtgaaacgacgccgtaggaacgaacgcccgggtaaaggaccgtaccgggtccgttaagttaactttcggtggttgtaggaacgttagacgttagtaacggaaacgaacggggttacgaacggggttaaacccgggggtgggtttggtaagg

SEQ ID NO: 369630 - DNA, 668 bp, Homo sapiens
  misc_feature: GZ8MTXP01DK9PC.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccgaggccggggggtcctgagactctcctgtcgccgcctctggactctacctttagagctattggatgagcgtgggtcccgccgaggcctccgagggggaacgggctgggaggtggggtacgaccaaagaagtaaaaggaagagtacggaaagtacaaagaaaactactaaagtggtcggactacgtagtaggaacgggccgtattccaaccctagtacctaccgaaggaacgaaccaaacggaccctaaagtaacttcagttatatccgtaggaacctaaaagtcgaaactacgtcccaggaacgacggtacccggaaaggaccctaccgggtccgttaagtaacgtttacgttggagttagaaggaacgttacgttagtaacggaaacgtaaccggggttagaacgggttaaacccgggggtggggtttaacgtaaggg

SEQ ID NO: 369631 - DNA, 624 bp, Homo sapiens
  misc_feature: GZ8MTXP01BVLHD.15.23.C01.1.454.CMB.2.raw
  modified_base (377)..(377): a, c, t, g, unknown or other
  modified_base (445)..(445): a, c, t, g, unknown or other
  modified_base (572)..(572): a, c, t, g, unknown or other
  modified_base (584)..(584): a, c, t, g, unknown or other
  modified_base (622)..(622): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggaggcctgggtccgagggcccgggggggtccctgagctctcctgtcgcccgcctctggactctacctttagagctagttggatgacgcgtgggtcccaccgaggcctccgaagggggaggggctgggaggtgggtcggaccaaagaagtaaaaggganagtaggaagtacaagaaacactaaagtgtggacctcgtagtagggaaacgggtccgaattccaacctntcccacgaagacaacgaaccgactaaagtattgagttagtaatccgtagggaactaaaagtcgaaactacggcctaggacggaaccggcccggaaggggacctaccggggctaagttattacgtggngtagagttaganagtaacgacgaacgggtgacgttaacggggtggggttngg

SEQ ID NO: 369632 - DNA, 731 bp, Homo sapiens
  misc_feature: GZ8MTXP01A1FWK.15.23.C01.1.454.CMB.2.raw
  modified_base (640)..(640): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccagggccggggggtccctgagctctcctgtcgccgcctctggactcacctttagagctattggatgagcgtgggtcccgcgaggcctccggagggggaagggggcgtggggaggtgggggtcggaccgaaacgaagtaaaagggaagagtagggaaagtacgaaagaaacacttaagtcggtggacttcgtagggtacggaacggggccgtaacttacccaacccgtaattcccgaaccgaacggaacgaaaccgaaacccggaccctaaaagtaacgtttaccaaggttagttaacttaccgtaggggaaacctaaaagttacgaaaccgaacggcccgtaaggggaacgaaccgggacccgggaaacggggtaacccgaccgggttcccggtaagttaacgtttacgngggttgtagggaacggttagaaccgagttaacggaacggtaaaccgggtagggaaacgggttaaccgggggtaagggggtttaagtaaggg

SEQ ID NO: 369633 - DNA, 640 bp, Homo sapiens
  misc_feature: GZ8MTXP01C2C6O.15.23.C01.1.454.CMB.2.raw
  modified_base (261)..(261): a, c, t, g, unknown or other
  modified_base (284)..(284): a, c, t, g, unknown or other
  modified_base (300)..(300): a, c, t, g, unknown or other
  modified_base (333)..(333): a, c, t, g, unknown or other
  modified_base (339)..(339): a, c, t, g, unknown or other
  modified_base (375)..(375): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggttttcctgtacggctattttagaaggtgtccagtgcgaggagcagctggtggagtcgtggggggagcctggtccaggccgggggggtccctgagactctcctgngcccgctctggactcactttagngctagttggatacggngtcgtcggccgcgacggcgacggaggggagggngtgggnggtgggcgaccaagaagtaaaggacgagtacggaanacgaaagaaactactaagtggtgactgtcggtaggacggctatccacatcacgagacgaacaacgtacgaaagtatcgtagtacttatcgtaacggaaactaaagtaacgaacgacgacgtacgacggaacggaccggtacggaccggtaccggtacggtaacgttacgttacgttaggttaggtaggtaaggagacgttacgtaacggtaacggtaacggtaacgggtaacgggttaacggggttaacggggttaaggttaagg

SEQ ID NO: 369634 - DNA, 813 bp, Homo sapiens
  misc_feature: GZ8MTXP01DQ1FT.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggaggccgtggtccgagggccgggggggtccctgagactctcctgtcgccgcctcgtggactctacctttagagtctaagttgatgagtcgtcgggtcccgccgaggcctaccggaagggggaacgggggtctagggggaggttgggggtacggaacccaaaagtaaagtaaaaagggaaagtagtaggggaaaagtacaaaggaaaaccacgttaaagttggtaacgggaccttgtagggtaggaaacggggccctaattcccaacctattccgacgaacgaacgaaaccgtaaacccggaccctaaaaaggtaactttaccgaaggttagtaaactttccgtaggggaaacctaaaagttacggaaaaccacgggtaccctaaggggaacggaaaccgggcccgggtaaacgggttaaacccgaacccgggggtcccgtttaacgggttttaaactttaacgtggggtttacggtaacgggaaacgttaaggaaacccgaggttaacgggaaaaccccggtaaacgggggtttaagggaaaaccgggttaaaaacccgggggggttgggggtttttaacccgtaaacggggg

SEQ ID NO: 369635 - DNA, 633 bp, Homo sapiens
  misc_feature: GZ8MTXP01BF0NN.15.23.C01.1.454.CMB.2.raw
  modified_base (619)..(619): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggagccgtggtccagggccggggggtccctgagactctcctgtcgcccgcctcgtcggactctacctttagagctattggatgagcgtggtcccgcaggcctccgaggggagggctgggagtgggtcgaccaaacgaagtaaaaggaagagtacggaaagtacgaagaaacactaagtacggtggactcgtggtacggaacggggcccgtagttccaaccctatcctacccgaagaacgaaccaaacgaccaaagtaacttacagttagtactccgtaggaacaaagtcgaaacacgccgtaggaacgacggcccggaagggaccgaccgggccgtaagttaacttacgtggttagtgaacgttagcaggtaacgacgtaacggtagaaggttaccggggngggtttcgtaaggg

SEQ ID NO: 369636 - DNA, 589 bp, Homo sapiens
  misc_feature: GZ8MTXP01BW6XK.15.23.C01.1.454.CMB.2.raw
  modified_base (356)..(356): a, c, t, g, unknown or other
  modified_base (380)..(380): a, c, t, g, unknown or other
  modified_base (543)..(543): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctgagactctccgtgtgccgcctctcggactcacctttagagctatggatgagctgggtcccgccaggcctccgagggggagggggctggggaggtgggtcggaccaaanaagtaaaggaagagtacggaagtnaacgaaacactaaatggtggactcgtaggtggaacgggtccgattccacctaatctaccagacgacaaaccggacctaaagaacttcaagtgtaatctagggactaaatgaaacagcctggacgagccggtaagcgaccggcgttgtaacttagtgttgagancggcataagacgaagggtagacggttaacggggtggggttgaacgg

SEQ ID NO: 369637 - DNA, 674 bp, Homo sapiens
  misc_feature: GZ8MTXP01BBJ6E.15.23.C01.1.454.CMB.2.raw
  modified_base (315)..(315): a, c, t, g, unknown or other
  modified_base (341)..(341): a, c, t, g, unknown or other
  modified_base (380)..(380): a, c, t, g, unknown or other
  modified_base (474)..(474): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagtcttgggttttccttgttgcttattttagaaggtgtccagtgcgaggagcagcgtggtggagtcgtgggggagccgtggtccgagggccggggggtcctgagctctcctgtcgccgcctcgtggactctacctttagagcttagttggatgagcgtgggtccncaggctccggaggggacgggctgggnggtgggcggaccaaagaagtaaaggagagtaggaaagtnaaacgaaactctaaagtggtggacttcgtagggtggaaacggggcctattcccacatccacagaacgacaaaccggacaaagtacttcaggttntaactcgtagaaactaaagtacgaaacgacgccgtaggaacggaccggaccgggtaaacggacccgtaccgggtccgttaagttaaacgttcgggttggttaggtaaggaacggaacgttacgttaacggtaacgggaaaccgggttaacggggtaccgggtaaaacggggttaaaccggggggtaaggggtttgaaggg

SEQ ID NO: 369638 - DNA, 654 bp, Homo sapiens
  misc_feature: GZ8MTXP01EEV28.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgcttattttagaaggtgtccagtgcgaggagcagctgggtggagtcgtggggggagccgtggtccgagggccggggggtccctgagactctcctgtcgcccgcctcgtggactctacctttagagtctattggatgagcgtgggtcccgccgaggcctccggagggggaaggggcgtgggaggttgggggtacggacccaaagtaagtaaaagggaagtaagtaggaagtacgaagaaaaccactaatggtcggactcgtggtaggaacgggcgattccacctatccaccgaagacaacaaacgaccaaagtacttcgagttgtaatcgtaggactaaaagtcgaaaccagcccgtagacgaacggcccggaaggaccgtacccgggtcgtaagttacgttacgtggttgtaggaagacggttaacagtaacgggaaacgtaaccgggtaggtacgggttaaaccgggggttggggttaagtaaggg

SEQ ID NO: 369639 - DNA, 598 bp, Homo sapiens
  misc_feature: GZ8MTXP01BZSU2.15.23.C01.1.454.CMB.2.raw
  modified_base (490)..(490): a, c, t, g, unknown or other
  modified_base (569)..(569): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttcctgttgctattttagaaggtgtccagtgcgaggagcagctggtggagtcgtgggggaggcctgggtccgaggccgggggggtccctgagctctcctgtgcccgcctctggactcacctttagagctattggatgagctgggtccgcaggctccgaggggaagggggctggggagtggggtggaccaaacaagtaaaagggaagatagggaaatacgaagaaaaccactaagtgtgggaactcgtggtagaaggggccgaattccacctatccgtaccagacgacaacgcaagacttcagtgtaatctagggacaaagtgaacagtccngaagacggcccgaaggggacccacgggccttaaggtaactttagtggttgtaggagacgacagtaagacgaacgggttnaacgggttaaccgggtggggttcgtaagg

SEQ ID NO: 369640 - DNA, 689 bp, Homo sapiens
  misc_feature: GZ8MTXP01DRY59.15.23.C01.1.454.CMB.2.raw
  modified_base (294)..(294): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctgggtggagtcgtggggggaggcctgggtcccgaggcccggggggggtccctggagactctccctgtgcccgcctctggactcacctttagngctattggatgagcgtgggtccgccaggctccgagggggaagggctggaggtgggtggaccaacgaagtaaaggagagtaggaagtacaagaaacactaagtgtggactctaggtaggaacggggccagttaccaccaattcctaccgaaggaacgaacaaacgaccccaaaaggtaactttacgaagttagtaacgttccttaggggaacaaaaacgttgaaaaccgtggcccgtaggaacgggaacggcccggaaacggggtaccgaaaccgggtcccggttaaggttaactttaacggttgggttagttaggaagggttaagacgaagtaagggaaactaaaccgggggttgaaacgggttaaccgggggtaagggggttttaacgtaaggg

SEQ ID NO: 369641 - DNA, 621 bp, Homo sapiens
  misc_feature: GZ8MTXP01B7C8V.15.23.C01.1.454.CMB.2.raw
  modified_base (503)..(503): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtggagtcgtgggggagccgtggtccgaggccggggggtccctgagctctctgtcgccgcctctggactcacctttagagctattggatggagcgtgggtcccgccgaggctccgaggggaagggggctgggaggtgggtggaccaacgaagtaaaaggaagagtgggaaagtacaaggaaaccacgttaatggtggacttcgtggttaggaacggggccgattccacctatcctcccgaagaacgaacaaaccggaccaaagtaacttcgaagtgtatcctggacaaagtgaaacgngccgtgagacgccgtaggaccgtacggccgtaagtactttacgtggttgtggaagacgaacgagtaacggaacgtaacgggtaggtaacggttaaccgggggtggggttaaggtaagg

SEQ ID NO: 369642 - DNA, 557 bp, Homo sapiens
  misc_feature: GZ8MTXP01B0Z6M.15.23.C01.1.454.CMB.2.raw
  modified_base (285)..(285): a, c, t, g, unknown or other
  modified_base (380)..(380): a, c, t, g, unknown or other
  modified_base (445)..(445): a, c, t, g, unknown or other
  modified_base (468)..(468): a, c, t, g, unknown or other
  modified_base (505)..(505): a, c, t, g, unknown or other
  modified_base (512)..(512): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctgagactctcctgtgccgcctctggactcacctttagngctattggatgagcgtgggtcccgccaggctccgaggggaagggctgggagtggggtgaccaaagagtaaaggagagtacggaagtcaataaacncgtaatgtggactcgtggtagaagggccattcacatcacagagaacaacgccaaagacttcagtntatctaggactaaagtcgaaacngcctgaagacgccgaggacaccgggctaagtattcgngttgagngagcagtgaacgaacggtgacggttaccggggtaaggggttgaag

SEQ ID NO: 369643 - DNA, 689 bp, Homo sapiens
  misc_feature: GZ8MTXP01CBKPE.15.23.C01.1.454.CMB.2.raw
  modified_base (285)..(285): a, c, t, g, unknown or other
  modified_base (307)..(307): a, c, t, g, unknown or other
  modified_base (475)..(475): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggagcctgggtccaggccggggggtccctgagctctcctgtcgccgcctctggactctacctttagngctatggatgagcgtgggtccnccaggcctacgaggggaagggctgggagtgggtgaccaaacagtaaaggagagtaggaagtacaagaaacactaaagtgtcggactcgtaggtggaacgggcccgtattcccaaccgtatcccgtaccgaaggacgaaccgaaaccgaccaaaaggtacttcaggttntaatccgttagggaactaaaagtcggaaaccacggtcccgtaggaacggaaccggaccgggaacgggtaacccgaaccgggcccggtttaaagtttaaacggtttccgttagggttacggtacgggaaagaacgttaaccttaaggttaacggaaacccggtaaagggggtttacgaaaccgggtttaacccgggggtaagggggtttgtaagg

SEQ ID NO: 369644 - DNA, 557 bp, Homo sapiens
  misc_feature: GZ8MTXP01EZ19X.15.23.C01.1.454.CMB.2.raw
  modified_base (307)..(307): a, c, t, g, unknown or other
  modified_base (350)..(350): a, c, t, g, unknown or other
  modified_base (375)..(375): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggggaggcctggtccaggccgggggggtccctgagctctcctgtgcccgcctctggactcacctttagagctattggatgagctggggtcccnccagggcctccgagggggaaggggctgggagtgggtggccaanataaaggagatggaagtcagaaacnctaatgtgactctgtgaagggccgatccaccatccacagagacaaacgccaaagaattcagtgtatctggcaaatgaaacagcctggagacgccgaggaccacgggccgtgtaattactggttgtggaagagacagtgaccaaacggggttgaacgttaacccggggtaaggggtttgaagg

SEQ ID NO: 369645 - DNA, 627 bp, Homo sapiens
  misc_feature: GZ8MTXP01BMNE4.15.23.C01.1.454.CMB.2.raw
  modified_base (505)..(505): a, c, t, g, unknown or other
  modified_base (579)..(579): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggaggcctgggtccgagggccggggggtccctggagactctcctgtcgcccgcctctggactctacctttagagctagttggatgagcgtgggtcccgccaggcctccgagggggaggggctgggaggtgggggtcgaccaaagaagtaaaaggagagtagggaagtcaagaaacacgtaatggtggactcgtgggtagaacggggcctaagttcccacctatcctccgaagacgaccaaacgccaaagtacttcgagttgtactcgtggaactaaatcggaaacngacccgtggaacggacggcccgaagggaccaaccggggtcctaagttactttacgtgttggtagaaggttacgnacgtaaggaactaaccgggtagacgttaacgggggtgggttgtaacgg

SEQ ID NO: 369646 - DNA, 665 bp, Homo sapiens
  misc_feature: GZ8MTXP01E2FEK.15.23.C01.1.454.CMB.2.raw
  modified_base (660)..(660): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggagcctggtccgagggccggggggtccctgagctctcctgtcgccgcctctggactctacctttagagctattggatgagcgtgggtcccgccgaggcctccgagggggaggggctgggaggtggggtcgaccaaacaagtaaaagggagagtagggaaagtcaaagaaacactaaatggtggactcgtggtaggaacggggtcccgattcccaaccctatccctacccgaaggaaccggaaccaaacccgccaaaaagtaactttccgagttgtaactccgtaggacaaaatcggaaaaccaggtccctaggaacggacggaccccgggtaaagggacccaccggggtcccgttaagttaacgttacgtgggttgtagaacggagaccagtcggaaacccgtaacggggttgaacggttaaaccgggggtgggggtttnaaggg

SEQ ID NO: 369647 - DNA, 610 bp, Homo sapiens
  misc_feature: GZ8MTXP01D61KB.15.23.C01.1.454.CMB.2.raw
  modified_base (271)..(271): a, c, t, g, unknown or other
  modified_base (287)..(287): a, c, t, g, unknown or other
  modified_base (307)..(307): a, c, t, g, unknown or other
  modified_base (329)..(329): a, c, t, g, unknown or other
  modified_base (353)..(353): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcttgggttttccttgttgcttattttagaaggtgtccagtgcgaggagcagcgtggtggagtcgtgggggagccgtggtccgagggccggggggtcctgagactctcctgtcgccgcctntggactcactttaganctattggatgagcgtggccncaggctcgaggggaggctgggngtgggcgaccaaagagtaaagganagtacggaactacaaagaaacactaagtggtcgggacttcgtggtaggaacggggtccgtattccacctatccaccgagacgaacaaaccgacaaagtacttcaagtcgtaatccgtaggaactaaagtcgaaacgagccctaggaagaccggccggaacggaccaccgggtcttaagttaacttcgtgttgagaacgagacttagaacggaacgtaacggggtgaacgggttaaaccggggtgggttaagtaaggg

SEQ ID NO: 369648 - DNA, 704 bp, Homo sapiens
  misc_feature: GZ8MTXP01AUF89.15.23.C01.1.454.CMB.2.raw
  modified_base (325)..(325): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcgtgggggagccgtggtccgagggcccggggggtccctggacgctcctcctgtcgcccgtcctctggactctacctttagacgcttattggatggacgcgttcgggtcccnccgagggcctaccggaagggggaaggggctggggaggtggggtacggaccaaacgaaagtaaaacgggagagtagggaaatcgaaagtaaacactaaagtggtggacttcgtagggtacgaaacggggtccaacgtttaccaacccgtattcccacccgaagacggaacccaaaccgacctaaagtaacttcgaagttgtaactcgtaggaacctaaagtacgaaacccgtagacccgtaggaaacggaccggaccgggtaaacgggacccaaacggggtcccgttaagttaacgtttaccgtggttaggtagacggagttaaccttaggcgtaacccgaaagggttgaaaccggttaacgggggtaagggttcgtaag

SEQ ID NO: 369649 - DNA, 724 bp, Homo sapiens
  misc_feature: GZ8MTXP01AEGDL.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccgaggccggggggtccctgagactctcctgtgcccgcctctggactctacctttagagctagttgatgagtcgtgggtcccgcgaggctccggaagggggaacggggcgtaggggaggtggggtcggaccaaacgtaagtaaaaggaagagttacgggaaagtacgaaagaaaaccacgtaagttggtcggaactcgtagggtagggaacggggtccgtaactttaccaaccctaattccctaccgaaggaaccgaaaccgaaaccgtacctaaaaggtaaactttccgaaggttagttaacgtttcctaaggggaactaaaagttacggaaaaccgtcgggaccctaagggaacggaaccgggacccgggtaaacggaacccggtaaccgggtcccggtttaaggttaactttacgtggttggtaggaaggagaaccgttaggaacgaacggaacggttaggaacggttaaaccgggggtgggttaagtaaggg

SEQ ID NO: 369650 - DNA, 634 bp, Homo sapiens
  misc_feature: GZ8MTXP01A91JO.15.23.C01.1.454.CMB.2.raw
  modified_base (288)..(288): a, c, t, g, unknown or other
  modified_base (311)..(311): a, c, t, g, unknown or other
  modified_base (493)..(493): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagagactcacatggagttgggctgagtcttgggttttccttgttgcttattttagaaggtgtccagtgcgaggagcagcgtggtggagtcgtgggggagccgtggtccgagggccggggggtccctgacgctctcctgtcgccgcctctggactctacctttagngctattggatgagcgtcggtccnccgaggcctaccggagggggaacggggtctgggaggtggggtacgaccaaagaagtaaaaggaagagtaggaagtacaaaggaaacacttaagtggtggaactcgtagggtacggaaacggggccgtaattccacctatcctaccgagaacgaacaaaccgtaccaaagtacttacaaggtntaactcgtaggactaaaagtcgaaacagtccgaggagaccggtaccgaggaccgtacgggccgttaagttaacttcgtgttagtagaagttacgacacgtaagaacgtaacggtgaaggttaaccggggtgggttcgtaag

SEQ ID NO: 369651 - DNA, 731 bp, Homo sapiens
  misc_feature: GZ8MTXP01EW70I.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtcccgaggccgggggggtccctgagactctcctgtgcccgcctctggactctacctttagagctattggatggagcgtgggtcccgccgaggcctccggagggggaacgggggcgtgggaggtggggtacggaccaaacgaagtaaaagggaagagtagggaaagtcaaggaaacacgtaagtggtggactctggtaggaacggggcccgatttccgaaccctatcctacccaaggaacgaacccgaaaccgcccaaaagtaacttacgagttacgtaaattcgagggtaaactaaaagttacgaaacgtacgacccgttggaaacgaacgggtccccggaacggggaaccgacccgggggtacccggttgttaaacgttttaccggttgggttacggttacggaaaggaaccggttaaccgttaagttaacggaaacccggtaaaagggggttccgggaaaacgggttaaaccggggggtaagggggttttaacggtaagggg

SEQ ID NO: 369652 - DNA, 716 bp, Homo sapiens
  misc_feature: GZ8MTXP01DS9LD.15.23.C01.1.454.CMB.2.raw
  modified_base (320)..(320): a, c, t, g, unknown or other
  modified_base (550)..(550): a, c, t, g, unknown or other
  modified_base (710)..(710): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagtcttgggttttccttgttgcttattttagaaggtgtccagtgcgaggagcagcgtggtggagtcgtgggggagcctggtccgagggccgggggtcctgacgactctcctgcgcccgctcgtggtactctacctttagagcttagttggattggagtccgtcgggtcccnccgagggtcctaccgggaagggggaacgggtctaggggaggttcgggggtacgacccgaaaagaagtaaaagggagtaagtacggaaagtaccgaaagaaaacctacgtaaagttcgggtaagtacccttgtagggttacgggaaaaccgggggtccctaaatttcccaaaccctataccctaccgaaagaacgaacctaaacccgacctaaaagtactttacaggttanaacttacgtaggaactaaaagtacgaaactacgcccgtagaacggacggaccgtaggaaccgaccgggtcgtaagttaagttacgtgttacgtaggaacgttacgacttacgtaacgaaacgtaaccgggttagtaaccggttaacggggtgggggtttntaaggg

SEQ ID NO: 369653 - DNA, 642 bp, Homo sapiens
  misc_feature: GZ8MTXP01EGEH6.15.23.C01.1.454.CMB.2.raw
  modified_base (321)..(321): a, c, t, g, unknown or other
  modified_base (350)..(350): a, c, t, g, unknown or other
  modified_base (419)..(419): a, c, t, g, unknown or other
  modified_base (463)..(463): a, c, t, g, unknown or other
  modified_base (594)..(594): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggctcaccatggagttggggctgagtcttgggttttccttgttgctattttagaaggtgtccagtgcgaggagcagtcgtgggtggagtcggtgggggaggccgtcgggtcccgaggggcccgggggggttccctggacgtactcctccgtggtcgcccgtcctcgtggactcctacctttagagtcttagtggntggagtcgtcgggtcccgaccgaggtccncggaagggggacgggcgtaggggtggtggggtcgacccaaagtaaagtaaaaggagagtaggaacgtanaaagaaacactaagtggtgtactgtaggtaggtacgggaccgtntaccactactaccacgagaacgacgaaccgacaatactagtagtagtactagacgaactaaagtcgaacgcgacgagacgacggacggacgacggcggtgtaagttacgttgtgttagtagaagacgttancgtaagaacggtaacggtaggtaacggttacggggttaagggttgtgg

SEQ ID NO: 369654 - DNA, 675 bp, Homo sapiens
  misc_feature: GZ8MTXP01DYI8N.15.23.C01.1.454.CMB.2.raw
  modified_base (669)..(669): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcgtgggggagccgtggtccaggccggggggtccctggagactctcctgtcgcccgtcctcgtggactctacctttagagctagttggatgacgcgtcgggtcccgccgacggcctaccggaagggggtaacggggcgtagggaggttcggggtacgacccgaaataagtaaaagggaagacgtaggaaagtacgaaagaaaacctacgtaaagtgtcgggactacgtgggtacggaacggggtccgtatttccaaccgtattccgaccgagaacgaacaaacgccaaagtacttacgagtacgtatccgtaggaacctaaagtcgaaacgcgtccaggacgaacggccgaaacgggacgtaccgggccgttaagttacgttacggtggttagtaagaggaacgttcaagttaacggaacgaaccgggtttagaacggttaacggggtgggggtttntaaggg

SEQ ID NO: 369655 - DNA, 764 bp, Homo sapiens
  misc_feature: GZ8MTXP01CLMK2.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcgtgggggacaccgtggtccgacgggcccggggggtccctggacgtactctccgtgtcgcccgtcctcgtcggtacctctacctttagagtcttagttggaatggacgcgtcgggtcccgccgacgggcctaccggagggggaacgggcgtggggaggtggggtacgaccaaagaagtaaaaggagagtacggaagtacaaagaaacctactaagtgtcggactcgtaggtacggaacgggcccgtattcccaacctatccaaccgaaggaaccgaaaccgaaacggtaccaaaagtaacgtttcgaagttacgtattccggaggtaaacctaaaaggttcgaaaccgtacggcccgtaagggaaggaaacccggaccggaaacgggtaacccgacccggggttccgggttaaactttaagttaccggttagggttacggtaaacggtaaggaaacggttcaaacgggtttaaggaaaaccccggttaacgggggttaagggtaaaacccgggggttaaaccgggggttgggggtttaattaaccggggg

SEQ ID NO: 369656 - DNA, 730 bp, Homo sapiens
  misc_feature: GZ8MTXP01A0G31.15.23.C01.1.454.CMB.2.raw
  modified_base (247)..(247): a, c, t, g, unknown or other
  modified_base (310)..(310): a, c, t, g, unknown or other
  modified_base (334)..(334): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcgtgggggagcctggtccgaggccgggggtccngagctctctgtcgcccgctctggactctacctttagagcttattggatgagtcgtcgggtccncgaggctccggagggggacggggntgggaggtggggtcgaccgaaagaagtaaaaggaagagtaggaacgtacgaagaaactacgtaaagtcggtggacctacgtggtacggaacggggtccgtaactttacccgaccctaaacgttcccgacccgaaagaacggtaaacccgaaacccggtacctaaaggtaactttacgaaacgttagttaacgttcgacggtaactaaaacgttacgaaaaccgacggtaccctagggaaaccggaggaccccgggaagggaaccggtacccgggtcccgttaagtttaacccgtttaggttacgggttgtaacgggaagttacggaccttaggtaacggaaacggaacggtaacgggtaacgggttaaacccgggggttggggttaacgttaaggg

SEQ ID NO: 369657 - DNA, 553 bp, Homo sapiens
  misc_feature: GZ8MTXP01E0S86.15.23.C01.1.454.CMB.2.raw
  modified_base (307)..(307): a, c, t, g, unknown or other
  modified_base (346)..(346): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagagctattggatgagctgggtcccnccaggctccgaggggagggctgggagtgggtggccaaanataaaggagataggaagtcaagaaacactaatgtggactctggtagaaggggccgattcaccatcctaccagagacaaacgccaaagaattcagtgtatctggacaaaatgaaacagccctgagacgccgaaggtaccacgggcctggtaattacgtgttgtagaagagacatgacgaacgtagagttaacggtaagggttggtaag

SEQ ID NO: 369658 - DNA, 923 bp, Homo sapiens
  misc_feature: GZ8MTXP01D2NYB.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagagactcaccatggagttgggctgagtcgttgggtttttccttgttgtcttattttagaaggtgtccagtgcgaggagcagcgtggtggaggttcggtgggggacggccgttcgggtcccgacggggtcccggggggtccctggacgtacctcttccgtggtcgcccgtcctcgtcggtactcgtacctttagacgtctagttggatggacgtcggtcgggtccccgccgaaggtcctaccgggaagggggtaaacgggggtcgtgggggtacgggttgggggtaccggaaaccccgtaaaagtaaaaggttaaaaaaggggaaaggtaaacggttaaacgggggtaaaaacggttaacgaaaaacggtaaaaaaccttaacccgtttaaaagggttacgggttaacggggtaaacctttccggggttacgggttaaacgggggaaaacccgggggtaccccttaaacttttaccccgaaaccctacgtttacccgtacccgaaaggaaaccgaaaaccgtaaaacccgaacccgttaaaagtaaacttaccgtaagttacgttaacttacgtaaggggtaaacctaaaaggtaacgaaaaccgtacggacccgtaagggaacgggaacccggaaccggggaaacggtacccggtaaccggggttacccggtttaaggtttaaacgtttaccgggtagtttagggaagttaaagggaaccgaagttaacgggtaaacgaaacggtaaccgggttaagggtaaacgggttaaaccggggggttaagggtttcgtaaaggg

SEQ ID NO: 369659 - DNA, 643 bp, Homo sapiens
  misc_feature: GZ8MTXP01A9QVP.15.23.C01.1.454.CMB.2.raw
  modified_base (324)..(324): a, c, t, g, unknown or other
  modified_base (416)..(416): a, c, t, g, unknown or other
  modified_base (501)..(501): a, c, t, g, unknown or other
  modified_base (526)..(526): a, c, t, g, unknown or other
  modified_base (582)..(582): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttcctgttgctattttagaggtgtcagtgcgaggagcagctggtggagtcgtgggggagccgtgggtccgagggcccgggggggtccctggacgtaccgtctccgtgtcgcccgtcctcgtggactctaccttagagctagttggatggacgcgtcgggtcccncgacggcctaccggagggggaacggggtcgtggggaggttggggtacgaccgaaagaagtaaaggaagagtacggaaacgtacaagaaaccntaaagttcggtggacctgtaggtagaacgggtcattacccactatccgacaaggacaacgaacccgtcaaaagtacttacagttntatctagggaactaaagtcgaaacncgcgtagaggacgtaccggagaccgtacggtcgttaataacgttgtggagaggaanacgacgttagtaacggaacggtaacgggtaggtaaacgggttaacggggttggttaagtcg

SEQ ID NO: 369660 - DNA, 711 bp, Homo sapiens
  misc_feature: GZ8MTXP01DLJEI.15.23.C01.1.454.CMB.2.raw
  modified_base (579)..(579): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcgttgggtttttccttgttgtcttattttagaaggtgtccagtgcgaggagcagcgtggtggagtcgtgggggagccgtggtccgagggcccggggggtccctgacgactctccgtgtcgcccgcctcgtggactctacctttagagcttagttggatggacgtcgtcgggtccccgccgaggccgtaccggaagggggaacggggtcgtggggaggttgggggtacggacccaaagtaagtaaaagggagtagtaggaaacgtacgaaagaaactacgtaaagtggtcggacttcgtagggtacgggaacgggtccctagttcccaacctagtaccctacccgaaaggaaccgaaacccgaaaccgtacccgtaaaagtaacttacgaagttagtactaccgtagggaactaaaagtcgaaaaccgngtacccgtaggaacggaacggtccccggtaaagggacccgaccggttccgtaagttaacgtttgaggttgtaggaagacgacagtcggaaacgtaacggtaggaaacggttaaccggggtgggttaagtaag

SEQ ID NO: 369661 - DNA, 667 bp, Homo sapiens
  misc_feature: GZ8MTXP01AHRQJ.15.23.C01.1.454.CMB.2.raw
  modified_base (329)..(329): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggacggccgtgggtccgagggcccggggggtccctggacgactcctcctgtcgcccgcctcgtcggactctacctttagagcttagttggatggacgtcgtcgggtcccnccgaggcctaccggagggggaggggctgggaggtgggtacgacccaaagaagtaaaaggaagagtaagggaaacgtcgaaaggaaaacctacgtaagttacggtgggtaacttcgtagggtacgggaaacggggcctaattcccaactactcctaccgaagaccgaacgtaaaccgcaaagtacttcagttgtactcgtaggaactaaagtcgaaactcggaccaggacgtaaccggccgaagggtacccaacgggtcttaaggtaacttgtggagtagaagttacgaacagtaaggaacccgtaagggtgtaaacggttacgggggtggttgtaagg

SEQ ID NO: 369662 - DNA, 663 bp, Homo sapiens
  misc_feature: GZ8MTXP01A6DI1.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggagcctggtccgagggccggggggtcctgagctctcctgtcgccgcctctggactctacctttagagctagttggatgagcgtgggtcccgccgaggcctccgagggggaagggcgtgggagtggggtcggaccaaagaagtaaaaggaagagtagggaagtcaagaaactactaatggtggactcgtagtacgggaaacggggccctaagtttcccaccctattcccgacccgaagaaccgaaccaaaccggacccaaaagtaactttacgaagttacgtaattccgtagggaaactaaaagtcgaaaacgacgtccgtaggaaggaccgccggaacggtaaccgaccggggaccgttaagttaacgttcgtaggttgaagaagttaagacttagtaacgaaccgtaagggttgaacggttaaccgggtaaggggttgaagg

SEQ ID NO: 369663 - DNA, 586 bp, Homo sapiens
  misc_feature: GZ8MTXP01DPTBD.15.23.C01.1.454.CMB.2.raw
  modified_base (313)..(313): a, c, t, g, unknown or other
  modified_base (489)..(489): a, c, t, g, unknown or other
  modified_base (582)..(582): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaagtgtccagtgcgaggagcagctggtggagtcgtgggggaggccgtgggtccgaggcccgggggggtccctgagactctcctgtcgccgcctctggactcacctttagagctattggatggagcgtgggtcccncaggctccgaggggaagggctggagtgggtggaccaaagataaaaggagatagggaatacaagaaaacactaaagtggtggactgtcggtaggaaacgggccgtaattccgacctattccacccaagaacgaacaacgaccaaagaacttcgagtgtatctggacaaatcgaaacngcctgagaacgccggtaaggacacgggcctaagtaacttacgtgttgtagagagacagtcgagtaacggtgaaacgttacgggaaggggtttnaagg

SEQ ID NO: 369664 - DNA, 707 bp, Homo sapiens
  misc_feature: GZ8MTXP01ADFAL.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttaggttttccttgttgcttattttagaaggtgtccagtgcgaggagcagctggtggaggtcgtgggggagccgtggtccgagggcccggggggtccctggacgacttcctcctgtcgcccgtcctcgtcggactctacctttagagctagttggatggacgcgtcgggtcccgccgaggcctaccggaagggggacgggtcgtgggaggtcggggtacgaccaaagaagtaaaaggaagtacgtagggaaactacgaaagaaaccacgttaaagtcggtcgggtaccttcggtagggtacggaaacggggtcctaacttaccaacctacttccaacccgaaggaacgaaccaaaccggacctaaaaggtaccttacgagtttagtacttccagggaacctaaaagtcggaaaaccctcggacccgttaggaaacggaccggaccggaaacggttaacccggaccgggttccgttaagttaagttcgtggttgtaacgaaggattcgagtaacggaacgtaacggtgtaaacgggttacgggtgggttcgtaag

SEQ ID NO: 369665 - DNA, 722 bp, Homo sapiens
  misc_feature: GZ8MTXP01EZVMT.15.23.C01.1.454.CMB.2.raw
  modified_base (344)..(344): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccaggccgggggggtccctgagctctcctgtgcccgcctctggactcacctttagagctattggatgagctgggtccgccaggctccgaggggaggggctgggagtgggtggccaanataaaggagatggaatcaagaaacactaatgtggactcgtggtaggaacggggtccgaagtttaccaaccctattcccgtacccgaaggaacgaaccaaaacccggcccaaaagggtaaactttaccgaagttaggttaacttccgttacggggacctaaaaagttcggaaaccgtaggaccccgttaggaacggaacgggaccccgggaaaggggtaacccgacccgggggtccccggttaagggtttaaacttttaaaccggtgggttttagggtacgggtaaggacgggaaccttaaggttaaccgggaaaccggtaaacgggggttacgggaaaacggttaaacccggggggtaaggggggtttttggaagggg

SEQ ID NO: 369666 - DNA, 723 bp, Homo sapiens
  misc_feature: GZ8MTXP01DIRT9.15.23.C01.1.454.CMB.2.raw
  modified_base (568)..(568): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtggcgaggagcagcgtggtggaggtcgtgggggaggccgtggtcccgagggcccggggggtccctgacgtctcctccgtgtcgcccgcctcgtggactctaccttagagctagttggatggacgcgtgggtcccgccgagggcctaccggagggggaacgggtcgtgggtaggtcgggggtacggacccaaacgtaagtaaaagggagtaagtaggaaacgtacgaaagtaaaaccacgttaaagtcggtcggtaccttcggtaggtaggaacggggtcctaaacgttccaacccgtatccctaaccgaagaacgaaaccaaacgtccaaaagtacttacgagttgtaactacgtacggaaactaaatacggaaaccncggtcccgtaggaacggaacggccccggtaaacggggaacccgaccgggtccgttaagtaaactttccggttgttacgggtaggaacgttaagacgttaagtaacggaaacccgtaaggggtacgaaacgggttaacgggggtgggttgtaaggg

SEQ ID NO: 369667 - DNA, 606 bp, Homo sapiens
  misc_feature: GZ8MTXP01BV734.15.23.C01.1.454.CMB.2.raw
  modified_base (499)..(499): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagagctattggatgagcgtgggtcccgccaggcctccgagggggaagggggcgtgggaggtggggtggaccaaacgaagtaaaagggaagagtacgggaagtacaagaaacacgtaaattggtggactcgtggtaggaacggggtccgattccacccattcctaccgaagacgaacaaccgccaaagattcgagttgtatcgtggactaaatgaaacngcctggagacgccgaaggaccacgggtcctgttaacttcgtgttgtacgagttacgcgttatggaaccgtaacgggtgaacgggttacggggtggggttgtaacggg

SEQ ID NO: 369668 - DNA, 794 bp, Homo sapiens
  misc_feature: GZ8MTXP01AKPBZ.15.23.C01.1.454.CMB.2.raw
  modified_base (657)..(657): a, c, t, g, unknown or other
  modified_base (725)..(725): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggaggcctggtccgagggcccggggggtccctggacgactcgtcctgtcgcccgcctcgtggactcacctttagagcttagttggatggagcgttcggggtacccgcccgaagggcccgtacccggaaggggggtaaacggggggtccgtttaggggggaacgggtttggggggttacgggggaaccccctaaaaacggtaaaaggttaaaaaaacgggggaaacgtaaacggtttaagggggaaaaacggttaccgaaaacgggtaaaaaaccctacggttaaaagtttacgggtaacggggtaacctttacgggttaggtacggggaaacgggggtccccgtaatttccccgaaccctattcccgtacccaaaggaaccgaaccgaaacccgacctaaagtacttacgagttagtaatccgtaggaactaaaacgngaaactacgcccgtaggacgaaccggaccggtacgggaacctaccgggtccgttaagtactttacggngttacgtagaaggacagagtaacggacggtaacggtaggtaacgggttacgggggttaagggttgtcgg

SEQ ID NO: 369669 - DNA, 646 bp, Homo sapiens
  misc_feature: GZ8MTXP01A6G4K.15.23.C01.1.454.CMB.2.raw
  modified_base (259)..(259): a, c, t, g, unknown or other
  modified_base (281)..(281): a, c, t, g, unknown or other
  modified_base (306)..(306): a, c, t, g, unknown or other
  modified_base (378)..(378): a, c, t, g, unknown or other
  modified_base (385)..(385): a, c, t, g, unknown or other
tcagtctacgtagccacgaccggtgctcgatttagtacacgtgattagggattggggaggtctcagagaggagccttagccctggactccaaggcctttccacttggtgatcagcactgagcacagaggactcaccatggagttggggctgagctgggttttcctgttgctattttagaaggtgtccagtgcgaggagcagctggtggagtctgggggagcctggtccaggcccggggggtccctgagactctcctgtncccgctctggactcactttagngctattggatgacgcgtgggtcccncaggctaccgagggtaacgggctgggagtgggtcggaccaaagagtaaaggagagtggaatcaaggaaaccncgtaaanggttcggactcgtagtggaaggggtaccctagttccaaccctagttcctccgaaaggacgaaacccttaaacggacccaaaggtaatttccgaaagttggtaaactcctttaggggacgaaataagaacgaacgaccgtaccgaggaacgaccggtaacggtacgaacggccggtcggtaacgttaagtgttgtcggtagaggaccagtaacgtacgaaccggttacggaggttacccgggtaacgggttcggttaacggg

SEQ ID NO: 369670 - DNA, 587 bp, Homo sapiens
  misc_feature: GZ8MTXP01EUMYJ.15.23.C01.1.454.CMB.2.raw
  modified_base (308)..(308): a, c, t, g, unknown or other
  modified_base (349)..(349): a, c, t, g, unknown or other
  modified_base (358)..(358): a, c, t, g, unknown or other
  modified_base (522)..(522): a, c, t, g, unknown or other
  modified_base (530)..(530): a, c, t, g, unknown or other
  modified_base (539)..(539): a, c, t, g, unknown or other
  modified_base (562)..(562): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgctattttagaagtgtccagtgcgaggagcagctggtggagtcgtgggggagccgtggtccgaggcccggggggtcctgagactctcctgtcgcccgcctctggactcacctttagagctattggatgagcgtgggtcccnccaggctccgagggggaagggctgggagtgggtgaccaaanataaagganataggaagtacaagaaacactaaagtgtcggactcgtggtaggaaacggggtccaagttccaaccctatcctacccaaggaacgaacgtaaacgcccaaaaggatttacgagtgtaatcgtaggactaaaatgaaacagcctagagacgcgagacgtacgcgtntaattcgngttgtaganagacttagtggaaccaaggggtnaagttaccgggtaaggggttgtaag

SEQ ID NO: 369671 - DNA, 714 bp, Homo sapiens
  misc_feature: GZ8MTXP01BDGKO.15.23.C01.1.454.CMB.2.raw
  modified_base (303)..(303): a, c, t, g, unknown or other
  modified_base (326)..(326): a, c, t, g, unknown or other
  modified_base (555)..(555): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagtcttgggttttccttgttgcttattttagaaggtgtccagtgcgaggagcagcgtggtggagtcgtgggggagccgtggtccgagggcccggggggtccctggacgtaccttctccgtgtcgcccgtcctcgtcggactcctacctttagngctagttggatgagcgtggtccncgaggcctccggaggggacgggtcgtgggaggtgggtcggacccaaagtaagtaaaggaagtacggtaggaaacgtacgaaacgaaaccgtacttaaagtggttcggacttcggttaggtacgggaacggggtcctattacccactagtccacgaagaacgaaccaacgacctaaagtatttacgagttcgtaatccgtaggtaaacctaaagcgaaacgcggtaccgnggaacgaccggtcggaacggacgtaccggggtactttaagggttactttaccgggttgcgggttaaagaacggttcgttaaccgaagtttaacgggaaacccggttaacggggtaagtaacggggttaaacccgggggtttaagggggtttcgtaaggg

SEQ ID NO: 369672 - DNA, 673 bp, Homo sapiens
  misc_feature: GZ8MTXP01AUDVO.15.23.C01.1.454.CMB.2.raw
  modified_base (306)..(306): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccgaggccgggggggtccctgagactctcctgtgccgcctctggactcacctttagagctattggatgagctgggtccnccaggctccgaggggaggggctgggagtgggcggaccaaagaataaaagggagagtacgggaaagtcaaggaaaaccctagtaaatcgggttggaaccctgtagggttaggaaacgggggcccctaatttcccaaccctaagttccctacccgaaaggaacggaaacccaaaaccggccctaaaaaggtaaactttccgaaagttggttaactcgttaggggaaccaaaagtagaaacaacgtaccgtagagacggaccggacgggaaccgaccgggcccgtggtattaacgtggttggtagaaggaggaacgacgtaagaacgtaacggtaaggtaacggttaacgggtaacggggttaaggtaag

SEQ ID NO: 369673 - DNA, 639 bp, Homo sapiens
  misc_feature: GZ8MTXP01CACU4.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggccgggggggtccctgagactctcctgtcgcccgcctctggactcacctttagagctattggatgagctgggtcccgccaggcctccgagggggaaggggctgggaggtggggtggaccaaacgagtaaaagggagagtagggaagtcaaggaaacactaaatgtgggacttcgtggtagaacggggccctagtttcccaacctatccctccgaaggacgaaccaaaccgacccaaagtaacttccgaagttgtaactcgttagggaactaaagtcgaaacacggaccctgggaacgaacggcccgaaaggggacccgaccgggtcccggtgttaacttacgtgttggtagaagagcataaggacgaacgggtagaacggttacccgggtaaggggttgtaacgg

SEQ ID NO: 369674 - DNA, 606 bp, Homo sapiens
  misc_feature: GZ8MTXP01DGY5C.15.23.C01.1.454.CMB.2.raw
  modified_base (484)..(484): a, c, t, g, unknown or other
  modified_base (507)..(507): a, c, t, g, unknown or other
  modified_base (528)..(528): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagtcttgggttttccttgttgcttattttagaaggtgtccagtgcgaggagcagcgtggtggagtcgtgggggacgccgtgggtccgacgggcccggggggtccctggacgacctctcctgtcgcccgcctctggactctacctttagagctattggatgagcgtgggtcccgcgaggcctaccggagggggaagggctggggaggtgggtcgaccaaagaagtaaaaggagagtaggaagtcaaagaaacactaaagtgtcggactcgtaggtaggaacgggccgtatccaactatccacgagacgaacaaacggctaaagtacttcgaagttntattcaggaacaaatcgaaacgngcgagacgacgcgtaggaccncggtgttaagtacgttgtgagtagagaagcagtaagaaacggtaacggtaagtacgggttaacggggttggttgtaag

SEQ ID NO: 369675 - DNA, 774 bp, Homo sapiens
  misc_feature: GZ8MTXP01ANZUY.15.23.C01.1.454.CMB.2.raw
  modified_base (286)..(286): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccgaggccggggggtccctgagctctccgtgtcgccgcctcgtggactctacctttagngctagttggatggagtcgtcgggtcccgccgaggcctacggagggggaacgggggcgtagggggaggttgggggtacggacccaaaacgtaagtaaaaagggaacgtaagtaggggaaagtacgaaagaaaaccacttaaagtgggttaaggaaccttcgtagggtacgggaaaccgggggtcccgtaaatttacccgaacctaacgttacccctaacccgaacgggaaacgaaacccgaaacccggtaaccccgtaaaaggtaacttttaaccgaaggtttaggttaaactttaccggtaagggaaacctaaaagttacgaaaaccgtacgacccgtagggaacgaaccggggacccggtaaccggggacgaacccggggtccgttaagttaagttaccgttggttacggttaggaagttacggacgttagtaacggaacgtaacggggttagaacgggttaaccgggggtaaggggttcgtaaggg

SEQ ID NO: 369676 - DNA, 666 bp, Homo sapiens
  misc_feature: GZ8MTXP01C8EQP.15.23.C01.1.454.CMB.2.raw
  modified_base (360)..(360): a, c, t, g, unknown or other
  modified_base (391)..(391): a, c, t, g, unknown or other
tcagtctacgtagccacgaccggtgctcgatttagtacacgtgattagggattgggaggtctcagagaggagccttagccctggactccaaggccttttccacttggtgatcagcactgagcacagaggactcaccatggagttggggctgagcttgggttttccttgttgcttattttagaaggtgtccagtgcgaggagcagctggtggagtcgtgggggtgcctggtccgaggcccggggggtcctgagactctcctgtcgcccgcctctggactctacctttagagctattggatgagtcgtgggtcccgccgaggcctccggaggggaaggggctgggaggtgggtcgaccaaanaagtaaaggagagtacggaatacaagaaacnctaagtgtggactcgtaggtaggaacgggccgtattcccaaccgtattacccgtaccaaaggaacgaaaccaaaccggaccctaaaagtaacttacgagttgttaactccgtaggaactaaaagtcgaaaccgagacccgtaggaacggaacgccggaagggaaccaccgggtccgttaagttactttacggtggttgtaggaacgttaagacgttagtaaggaaaccgtaacggggtagtaaccggttaacgggggttaagggttcgttaaggg

SEQ ID NO: 369677 - DNA, 755 bp, Homo sapiens
  misc_feature: GZ8MTXP01AK8VI.15.23.C01.1.454.CMB.2.raw
  modified_base (287)..(287): a, c, t, g, unknown or other
  modified_base (310)..(310): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaggtgtccagtgcgaggagcagctggtggagtcgtgggggagccgtggtccgaggccggggggtccctgagactctcctgtcgccgcctgtcggactctacctttaganctagtggatgagcgtgggtcccncgaggcctccgaggggaagggcgtgggagtgggtcggaccgaaacgaagtaaaaggggaagagtacgggtaaacgtacgaagaaaaccctacgtaagtacgggtcggaacttcgtagggttaggaaaccgggggtccctaatttacccaccctaagtcctaacccgaaggaaaccgaacccgaaaccggtaccctaaaaggtaacttaccgtaagggttagtaactttacgaccggggtaaaacgtaaacgtacggaaaccgacgtaccggtaacggaacggaccgggacccggtaaacgggaacccggtaccgggtaccggttaaggtttaacgtttacggtaggttaggtaccggaaggttacgttacgttacggtaacgggaacccgttaacgggggtacggtaaacggggttaaccgggggttaaggggttaacggtaagg

SEQ ID NO: 369678 - DNA, 699 bp, Homo sapiens
  misc_feature: GZ8MTXP01A4T0F.15.23.C01.1.454.CMB.2.raw
  modified_base (377)..(377): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcggtgggggaggccgtgggtccgacgggcccgggggggtccctggacgactctcctgtcgcccgcctcgtggacctctacctttagagcttagttggatgagcgtcgggtcccgccaggcctccggagggggagggggctggggaggtggggtcggaccaaanaagtaaaagggaagtagtacgggaaagtcaaagaaaaccacgtaaagtgggtggacctcgtagggtagggaacggggtccgtaatttacccaaccctagttcccaccgaaagaacgaaccaaaccggaccaaagtacttcgagttgtattcgagggactaaaagtcgaaaaccgcgtccgtaggaacgacggacccgggaacggtaacccgaccgggtccgttaagttaacttacggtggttagtacggaacgacgttacgaaggtaaccggaacggtaacgggtaaggtaacgggttaaccgggggtgggttaagtaacgg

SEQ ID NO: 369679 - DNA, 670 bp, Homo sapiens
  misc_feature: GZ8MTXP01AOHYJ.15.23.C01.1.454.CMB.2.raw
  modified_base (324)..(324): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcgtgggggagcctgggtccgacgggccggggggtccctggacgctctcctgtcgcccgtcctctggactctaacctttagagcttagttggattgacgcgtcgggtcccnccgaggcctaccggagggggaggggctggggaggtgggggtcgaccaaagaagtaaaagggaagagtacgggaagtacgaaagaaaccagtaagtggtaacgggacttcgtgggtacggaacggggcctaattccgaccctattccaccaaggaacgaccaaaaccggccaaagttaaattccgaggttactacttccgaggtaactaaagtacgaaaccgtgtacccgaggaacggaccggtacccgggagggccaaccggggtcgttaacgtattacgtggttgtacgaagagttcaagtcggacgtaacgggaggtacggttaacggggtgggttcgtaaggg

SEQ ID NO: 369680 - DNA, 675 bp, Homo sapiens
  misc_feature: GZ8MTXP01DTOMQ.15.23.C01.1.454.CMB.2.raw
  modified_base (370)..(370): a, c, t, g, unknown or other
  modified_base (540)..(540): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcacatggagttgggctgagctgggttttctgttgctattttagaggtgtccagtgcgaggagcagcgtggtggagtcgtgggggagccgtgggtccgagggccggggggtcctgagactctcctgtcgccgcctcgtggactctacctttagagctagttggatggagtcgtgggtccccgcgagggcctccggaagggggaacgggggcgtaggggaggtgggggtacgacccgaaanaaaggtaaaaggaaagtagtaagggaaacgtacgaaagaaaacacttaaagtgtggacttcgtaggtaggaacggggcctattaccaacctatcctaaccgaaggaacaaccgaaacgacctaaaagtacttacgagttacgttatcgttaggaactaaatacggaaacncgtaccgtaggaacgaaccggacccggtaaagggacctaaccgggggtccttaagttaacgttagtgggttgaaggaacgaaggcaaagttcgaaacgtaacgggtagaacgttaacgggggtgggttgtaaggg

SEQ ID NO: 369681 - DNA, 745 bp, Homo sapiens
  misc_feature: GZ8MTXP01BCHL8.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcttgggttttccttgttgcttattttagaaggtgtcagtgcgaggagcagcgtggtggagtcgtgggggagccgtggtccgagggccggggggtccctgagactctcctgtcgcccgcctcgtggactctacctttagagcttagttggatggagcgtcgggtcccgccgagggcctaccggagggggaaggggcgtgggaggtggggcgaccgaaagaagtaaaaggaagagtaggaaagtacgaaagaaaccactaattggtggactcgtaggtacggaacggggcctattcccgaacctagttcctaccgaaggtaaacgaaacccgaaaaccggacctaaaaggtaaactttacgaagtttacggttaacttaccgtaaggggtaaacctaaaagttaaccgaaacgtaaccggacccgttagggaaacggaaccggacccgggtaaacgggacccgtaccggggtccggtttaagttaaccggtttacgttgggttaggtaaggaaggttaacgaacgaagttaacgggaaaacgtaaccggggttaagggaaacggttaaaccggggggttaagggtttaaggtaagg

SEQ ID NO: 369682 - DNA, 786 bp, Homo sapiens
  misc_feature: GZ8MTXP01DK93R.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtggagtcgtgggggagcctgggtccaggccgggggtcctgagactctcctgtcgcccgcctcgtggactctacctttagagctagttggatgagtccgtgggtcccgcgaggcctaccggaagggggaagggctgggaggttggggtacggacccaaagaaaggtaaaagggaagagttacggggaaagttaccgaaaggtaaaacctacgttaaagtgggttcggtaaccttcgttagggtacgggaaacggggtccgtaattcccgaacctaagtccctacccgaaaggtaacgaaacccgaaaacgaccgtaaaagtaactttaccgaagtttcggtaacttacccgtagggggaaacctaaaaggttccggaaaaacccgtcggtaccccgttaaggggaaaccggtaaaccgggccccgggaaaggggtaaccccgaacccgggggttccgttaagggtttaactttaaccggtgggttaggaaccggtaaggaacgttaaccagggttaacggaaaacccggtaacggggttaacgacgggggtttaaaaccgggggtgggggtttgtaacggg

SEQ ID NO: 369683 - DNA, 619 bp, Homo sapiens
  misc_feature: GZ8MTXP01CVQLO.15.23.C01.1.454.CMB.2.raw
  modified_base (297)..(297): a, c, t, g, unknown or other
  modified_base (388)..(388): a, c, t, g, unknown or other
  modified_base (553)..(553): a, c, t, g, unknown or other
  modified_base (613)..(613): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcttgggttttccttgttgcttattttagaaggtgtccagtgcgaggagcagcgtggtggagtcggtgggggagccgtgggtccgagggcccggggggtccctggagactctcctgtcgcccgtcctcgtggacctctacctttagngctattggatgagcgtggtccgcaggctcgaggggagggctgggagtgggtgaccaaagaagtaaaaggagagtaggaagtacaagaaacnctaagtgtggactcgtaggtaggaacggcctattccactatcacagacaacaacgacaaagacttcgagttataatcgtaggaaactaaagtcgaaacacgcctaggacgaacggaccgtaacgggaccgaccgggtcttaagttaacttagttggttgtaaggngttaaagccgaagtaaggaaacccgtaacgggtaggaacgggttaaccggggttgggttntaaggg

SEQ ID NO: 369684 - DNA, 647 bp, Homo sapiens
  misc_feature: GZ8MTXP01B2BXZ.15.23.C01.1.454.CMB.2.raw
  modified_base (315)..(315): a, c, t, g, unknown or other
  modified_base (600)..(600): a, c, t, g, unknown or other
tcagtctacgtagccacgaccggtgctcgatttagtacacgtgattagggattgggggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtgggtggagtcgtgggggagccgtgggtccgagggcccggggggtcctggagctctcctgtcgccgcctctggacctcacctttagagctagttggatgagcgtgggtccnccgaggcctccggaggggaaggggctgggaggtggggtcgacccaaagaagtaaaaggaagagtaggaaagtcaaagaaacactagtaggtggaactcgtggtagggaaacggggtcccgtaatttcccaaccctatccctaccgaaggaacgaaccaaacggtacccaaaggtaacttcgaagttacgtatactagacaaaagtggaaaccagtacccagaaggacggacccggaggaccgacgggtccgtagtaacgttacgttggtgttcgaaagtagacgngttacggaacgacgggtgtaacggtacgggttaggggtgaaggttgg

SEQ ID NO: 369685 - DNA, 626 bp, Homo sapiens
  misc_feature: GZ8MTXP01BA0I0.15.23.C01.1.454.CMB.2.raw
  modified_base (283)..(283): a, c, t, g, unknown or other
  modified_base (581)..(581): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggagcctggtccaggccggggggtccctgagctctcctgtcgccgcctctggactcactttaganctattggatgagcgtcgggtcccgccgaggcctccggaagggggaaggggcgtgggaggtggggtcgaccaaacagtaaaaggagagtaggaagtcaagaaacactaagtgtggactcgtaggtagaacggggcccattaccaccctattccgaccaaggacaacgaaaccgcctaaaagacttcgagttagtaactcgtaggggaacaaagtgaaaacgcgccgtaggaagaccggcggtaacggaccctaccgggccgttaagtaactttacggtgttggtagaagacgacgttanaacggaacaacgggtagacgggttaacggggtaagggtttgaagg

SEQ ID NO: 369686 - DNA, 815 bp, Homo sapiens
  misc_feature: GZ8MTXP01BDOHD.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggagcctgggtccagggccgggggtccctgagactctccgtgtcgcccgtcctcgtcggactctacctttagagcttaagttggatggacgccgtagggtccccgacgagggtcctaccggaagggggaacgggggcgtgggggaggttcgggggacggtaacccgaaaacgtaagtaaaaaaggggaagtaaggtacgggtaaaacgttacgaaaggtaaaaaccctaccgtttaaaagtcgggttaacgggaacccgtttccggttaaggggtaccggggtaaaaccggggggtacccccgttaaacgttttaaccccccgaaacccttaaaccggttccccttaaccccggaaacgggtaaaaccgggaaaaccccgaaaaaccccgggtaccgtaaaaacgttaaaacgtttccgtaaagggttaccgtttaaagttccttaacgggggaaactaaaacggttaacgaaccgtaacgcccgtaggaacgacgacgtacggaacgtacgggtccgtaagtacttagtcgttgtagtaaggacaccgagtaacgacggtaacgaggtaacggttaaccgggtggggttgtaaggg

SEQ ID NO: 369687 - DNA, 652 bp, Homo sapiens
  misc_feature: GZ8MTXP01DJ41O.15.23.C01.1.454.CMB.2.raw
  modified_base (522)..(522): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttcctgttgctattttagaaggtgtccagtgcgaggagcagcgtggtggagtcgtgggggagcctggtccagggccggggggtccctgacgactctccgtgtcgcccgcctcgtcggacctctacctttagagctattggatgagcgtgggtcccgccaggctaccgaggggagggctgggtaggtgggtcgaccaaacaagtaaaggagagtacggaagtacgaagaaactacgtaagtgtcggacttcgtaggtacggaacgggtcccgtaatttccaacccgtattcccaccgaagaaccgaactaaaccgaccgaaagtaacttcgaagttgtaactccgtaggacaaaatcgaaaccncgccgaggacgacgaccggtaaggaccgtacggtcgtaagttacttacggtggttagtaagaagaacgacgttaacggtaacgaaacggtaacgggtacgtaacgggttaacgggggtggttaacgtaag

SEQ ID NO: 369688 - DNA, 813 bp, Homo sapiens
  misc_feature: GZ8MTXP01CIIAG.15.23.C01.1.454.CMB.2.raw
  modified_base (348)..(348): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctgggtggagtcgtgggggaggccgtggtccgagggccgggggggtccctgagactctcctgtcgccgcctctcggactcacctttagagtctattggatgagcgtcgggtcccgccgaggcctaccgagggggaacggggctgggnggtggggtcgaccgaaacaagtaaaaggaagaagtagggaaacgtacaaagaaaaccacgtaaagttgtcgggaactcgtggtacgggaaacggggcctagttcccaaccctatccgtacccgaggaaacgaacccgtaaacgaacccgtaaaggtaactttaccgaagtttacggtaactcccgttaggggaaacctaaaaaagttcggaaaacccgtaacggaccccgttaaggggaaccgggtaaacccggggacccccggggtaaaaggggttaaaccccggaccgggggttaccccggtttaaagggtttaaacctttttaacgggtcggggttaaaggttacgggggaaaggaacccggttaaacggttaacggtttaacgggaaacccgggtaaaacggggtttaggggaaacccggggttaaaaacggggggttcgggggtttaaggggttaaaggg

SEQ ID NO: 369689 - DNA, 782 bp, Homo sapiens
  misc_feature: GZ8MTXP01DZAS1.15.23.C01.1.454.CMB.2.raw
  modified_base (308)..(308): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctgggtccagggccgggggggtccctggagactctcctgtcgccgcctctggactcacctttagagctatgatgagcgtgggtccncgaggcctccgagggggaaggggctgggaggtggggtacggaccaaagaagtaaaagggaagaacgtagggaaagtacgaaagaaaaccgtactaaagttgggtaacgggacttacgtagggttaagggaaaccgggggtcccgtaaatttaccccgaaaccctaatttcccgtacccgaaagaaaccggtaaacccgaaaaccggacccctaaaaagggtaaacttttccgaaaaggttgttaaacttccgttaggggaaacctaaaaattacgggaaactacgtacccggtaaggaaccggaaccgggtccccggtaaagggtaaccgaaacccggggttcccggttaagttaaacgttttaaccgtgggtttggaacggaacgggaagttaccgaagtttaacgggaaaacccgtaaagggggttacgaaaacgggttaaacccgggggttgggggtttaacgttaagggg

SEQ ID NO: 369690 - DNA, 712 bp, Homo sapiens
  misc_feature: GZ8MTXP01AS47F.15.23.C01.1.454.CMB.2.raw
  modified_base (684)..(684): a, c, t, g, unknown or other
  modified_base (707)..(707): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggagcctggtccgagggccggggggtcctgagctctcctgtcgcccgtcctcgtacggtactcctacctttagagtcttagttggatggacgtcgtgggtccccgccgacgggctaccggagggggaaggggtctggggaggtggggtgaccaaagaagtaaaagggagagtagggaaatcaaagaaactacgtaattcggtcggaacttcgagggttacggaaacgggggtcctacttacccacccaatttcccgaccgaaagggaacgaacctaaaccggaccctaaaaggtactttacgagtttagtaattacccgagggaactaaaaagttcggaaacccaggttacccgtgggaaacgttacgggacccggtaaacggttaacccgaccgggggttcccgtaagttaaagtttccgtggttggtaaccgaagacggattagtaacgaaccggtaagggtanacgggttaaaccggggtgggttntaagg

SEQ ID NO: 369691 - DNA, 781 bp, Homo sapiens
  misc_feature: GZ8MTXP01AXD8R.15.23.C01.1.454.CMB.2.raw
  modified_base (333)..(333): a, c, t, g, unknown or other
tcagtctacgtagccacgaccggtgctcgatttagtacacgtgattagggattgggggtctcagagaggagccttagccctggactccaaggcctttccacttggtgatcagcactgagcacagaggactcaccatggagttgggctgagtcttgggttttccttgttgcttattttagaaggtgtccagtgcgaggagcagcgtggtggagtcggtgggggagccgtgggtccgacggggcccggggggtcctggacgtctctccgtgtcgcccgtcctcgtggtacctctacctttagtacgcttagttggatggaggcgtcggggtcccnccgaggcctaccggagggggaacgggggctagggaggtgggggtcgacccaaagtaaagtaaaggaagagtagggaacgtacgaaagaaacactagtaggtcggtaactcgtagggacgggaacgggtcccgtaattccaaccctattcccgacgaaacgaacgaaccaaaccggacctaaaagtaactttacgaagttagtaacgttcgttaacggaaacttaaacgttacggggaaaacctacggtacccgtaaagggaacggaaccggtaacccgggaacgggtaaacccggccgggttacccggtttagttaaacgttttaaccggttgggttaggttacggaaaggtaacgttaaccgttaagttaaccgggtaaacggtaaacccggggttaagtaaaccggggtaaccgggggttagggttaacgttaaggtttaaccggg

SEQ ID NO: 369692 - DNA, 786 bp, Homo sapiens
  misc_feature: GZ8MTXP01BMHAA.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaggtgtccagtgcgaggagcagcgtggtggagtcgtgggggagccgtggtccgagggcccggggggtccctggagtacctctccgtgtcgcccgtcctcgtcggaccttctacctttagtagtctagttggatggacgtccgtcgggtccccgccgacgggcctaccgggaagggggaacgggggtcgtgggggtacggtgggggtcggaacccgaaacgaaagtaaaaggggaaagtaggtaacgggaaactacgaaaggaaaacctacgttaaagtggtcggtacttacggtagggtacgggaacggggtcccgtaactttccgaaaccctattcccgtaaccgaaggtaaccgaaacccaaaccggacccctaaaaggttaacgtttacgaagggtttacttaactactacggggaaactaaacggtacgaaacccgtggtcccctagggaaacccggacggtaccccggggaaggtaaaccccggtccgggtcccgtttaagttaaccgtttaccgtaggttcggtagaacgacgttaaccaggttaacgaaacggaaccggggtttaggaaaccggttacgggggtaagggtttaagaagg

SEQ ID NO: 369693 - DNA, 919 bp, Homo sapiens
  misc_feature: GZ8MTXP01DCCPA.15.23.C01.1.454.CMB.2.raw
  modified_base (317)..(317): a, c, t, g, unknown or other
tcagtctacgtagccacgaccggtgctcgatttagtacacgtgattagggattggggaggtctcagagaggagccttagccctggactccaaggcctttccacttggtgatcagcactgagcacagaggactcaccatggagttggggctgagcttgggttttccttgttgctattttagaaggtgtccagtgcgaggagcaggcgtggtggaggtcgtgggggaggccgtggtccgagggcccggggggtccctgacgactctcctgtcgcccgcctctggactctactttagagctattggatgagcgtggtccnccgaggccgtacggagggggacgggtcgtgggagggtggggtacgaacctaaagtaaaggtaaaaggaagtaggtaacggaaacgtaacgaaaggtaaaacctacgttaaagggttacgggttaacgggtaaccttaccgggttaggggtaacggggaaacccgggggtacccttaaaccgttacccaaacccttacgtttaccctaacccggaaagggtaaacccgaaaacccgtaaaaccccgggaaccctaaaagggtttaaaccctttacggaaacggtttaggttaaactttacccggttaaaggggaaaaaaacctttaaaagggtaaaccggaaaaccccgtacggttaaccccggtaagggggaaacggaaacccgggggtacccggggaaacggggtaaccccgtaacccggggggttaccggttttaaaaggtttaaccgtttaccgggttaggggttacggggtaaacggaagggggaaaaccttaaccgggttaggttaaaaccggggaaaaccggggtttaaccggggttaaggggtaaaaccccgggggttaaccggggggtttaaggggggtttaattaaccggggg

SEQ ID NO: 369694 - DNA, 638 bp, Homo sapiens
  misc_feature: GZ8MTXP01D6ZON.15.23.C01.1.454.CMB.2.raw
  modified_base (286)..(286): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctgagactctcctgtgcccgcctctggctctaccttaganctattgatgagcgtgggtcccgccgaggccgtccgagggggaaggggcgtgggaggtggggtagaccgaaagaagtaaaaggaagagtaggaagtacaagaaacactaagtgtggactcgtggtaggaacggggccgtattccgaccaattccgtaacccaaggaacgaaaccaaacggccaaaagtaacttcagttagtaactcgtaggaactaaaagtcgaaacgacgcctaggaacgaaggcccggaaggaccgacgggtccgttaagtattacggtgttcggtaagacgaggttacagtggaaacccgtaagggtggaaaccggttaacgggggtgggtttaagaagg

SEQ ID NO: 369695 - DNA, 573 bp, Homo sapiens
  misc_feature: GZ8MTXP01CO3AL.15.23.C01.1.454.CMB.2.raw
  modified_base (287)..(287): a, c, t, g, unknown or other
  modified_base (315)..(315): a, c, t, g, unknown or other
  modified_base (467)..(467): a, c, t, g, unknown or other
  modified_base (481)..(481): a, c, t, g, unknown or other
  modified_base (486)..(486): a, c, t, g, unknown or other
  modified_base (489)..(489): a, c, t, g, unknown or other
  modified_base (491)..(491): a, c, t, g, unknown or other
  modified_base (541)..(541): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcgtgggggaggcctggtccgaggccggggggtcctgagactctcctgtcgcccgctctggactctaccttagngactattggatggagtcgtcgggtcccncaggcctacggaggggtaacggggctgggacggtgggtaggaccaaagaagtaaaaggatagtacggaaactacgaagaaaacactaaagtcgtggactgtaggtacgaacgggcctatacaccatccgacgaagacaaacaacgtacaaanactactagtatatntaganaananaacacacagagacgacgacgacgacgcgtaatattagtgttgagagaganagaagacgaacgtagtagacggtaaggttgtg

SEQ ID NO: 369696 - DNA, 831 bp, Homo sapiens
  misc_feature: GZ8MTXP01AR2JL.15.23.C01.1.454.CMB.2.raw
  modified_base (329)..(329): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggacggccttggttccgacgggtccggggggtccctgacgacttcctcctgtcgcccgtcctcgtcggactcctacctttagagctagttggatgagtcgtcgggtcccnccgaggcctaccggaagggggacggggtcgtaggggaggtcggggtcgaccaaagaagtaaaaggaagagtacggaaagtagaaagaaaactcttaaagtggtcggtacttcgtagggtacgggtaacggggtacccgtaagtttccccaaaccctagtaccctaaccggaacggaaaccgaaacccaaaaccccggtaaacccgtaaaaggttaaaacctttcccggaaagggtttacgttaaacttacccgttaaggggaaaacccttaaaaagtaccgaaaaccgtaccggtacccctaaggggaaacgggaacccggacccgggtaaaggggaaaccccgtaccggggttcccggttaaggtttaaacgtttccggttagggttaggttaaagggaacgttaacgggacttaacggtaacgggaaacccgggtaaaggggtttaaccgggaaaaccggggtttaaaaccggggggtgggggtttaacgttaacggggg

SEQ ID NO: 369697 - DNA, 607 bp, Homo sapiens
  misc_feature: GZ8MTXP01EB9G2.15.23.C01.1.454.CMB.2.raw
  modified_base (308)..(308): a, c, t, g, unknown or other
  modified_base (493)..(493): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccgaggccggggggtccctgagactctcctgtgcccgcctctggactcacctttagagctattggatgagcgtgggtcccncaggctccgaggggaagggctgggagtgggtgaccaaagagtaaaggaagacgtggaagtacaagaaacactaaagtgtggactcgtaggtaggaaacgggtccgattccaccattccaccaggaagaaccaaacggccaaagtaattcgagttatacttctagggaaccaaaagttcgaaacgngcccgtaggaacgaacggccgtaacgggaccgtaccgggtccgtaagttattacgtggttgacggagaagcagtgaaaccgaagggtgaagttaccggggtaagggttgtaagg

SEQ ID NO: 369698 - DNA, 569 bp, Homo sapiens
  misc_feature: GZ8MTXP01EAU4V.15.23.C01.1.454.CMB.2.raw
  modified_base (305)..(305): a, c, t, g, unknown or other
  modified_base (343)..(343): a, c, t, g, unknown or other
  modified_base (471)..(471): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaggtgtccagtgcgaggagcagctggtggagtcgtggggggagcctgggtccaggccggggggtccctgagctctcctgtcgcccgctctggactcacctttagagctattggatgagctgggtccncaggctccgaggggaagggctgggagtgggtgaccaanagtaaaggagatagggaagtacaagaaacactaatggtggactcgtggtagaacggggccgtattccaccatcctaccagagaacaaacggaccaaagaacttcagtgtaatctaggacaaatgaacngcctgagaacgccgaaggcgacggccgtaagtcttacgtgttgtagagttagcagtgaaccgaacgggttgaagttaaccggggtaagggttgtaagg

SEQ ID NO: 369699 - DNA, 547 bp, Homo sapiens
  misc_feature: GZ8MTXP01DQAJY.15.23.C01.1.454.CMB.2.raw
  modified_base (350)..(350): a, c, t, g, unknown or other
  modified_base (371)..(371): a, c, t, g, unknown or other
  modified_base (449)..(449): a, c, t, g, unknown or other
  modified_base (470)..(470): a, c, t, g, unknown or other
  modified_base (488)..(488): a, c, t, g, unknown or other
  modified_base (502)..(502): a, c, t, g, unknown or other
  modified_base (510)..(510): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctgggtggagtcgtggggggagcctgggtccgaggccgggggggtccctgagactctcctgtcgccgcctctggactctaccttagagctattgatgagcgtggtcccgcaggctaccgaggggaggggctgggagtgggtgaccaaanagtaaaggagagtaggaagtnaagaaacactaaatgtggactcgtagtaggaagggcccgtatccacctatccacagagaacaaacgcaaagatcagtntatctaggacaaagtcgaaancgcagagacgcgaggacncggcgtgtacttgngttgtganagcagtgaacgaaggtgacgacgggtgggttctaagg

SEQ ID NO: 369700 - DNA, 737 bp, Homo sapiens
  misc_feature: GZ8MTXP01CTWM1.15.23.C01.1.454.CMB.2.raw
  modified_base (667)..(667): a, c, t, g, unknown or other
tcagtctacgtagccacgaccggtgctcgatttagtacacgtgattagggattgggggtctcagagaggagccttagccctggactccaaggcctttccacttggtgatcagcactgagcacagaggactcaccatggagttgggctgagctgggttttccttgttgcttattttagaaggtgtccagtgcgaggagcagctggtggagtcgtgggggagccgtggtcccgaaccggggggtccctgacgactctcctgtcgccgcctcgtggacctctacctttagtagctagttggatgacgtcgtcgggtccccgcgaggcctaccggaggggaaggggcgtagggaggtgggggtgacccaaagaagtaaaaggaagagtagggaaagtacccaaaggaaaactcgttaaagtggttaacgggaccttcggtagggtacgggaaacgggggtcccctaagtttcccaaaccgtaacttcccgtaacccgaaaggaaccgaaccgaaacccggaaacctaaaaggtaactttaccgaggttagttaactccgtaagtaacctaaaaggttcgaaaacgacggaccgtaaggaacggaacggaccggaaacggaccgtaccgggtaccgttagtaacgttaacgtaggttggtagaggtaaacgnttaaagttcgaaaccggtaagggttacgaacgggttaaaccggggaggggttagtaacgttcgggttaag

SEQ ID NO: 369701 - DNA, 650 bp, Homo sapiens
  misc_feature: GZ8MTXP01EYJGB.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggaggccgtggtccgaggccggggggtccctggagactctcctgtcgcccgcctctggacctctacctttagacgcttagttggatggagtcgtgggtcccgccgagggcctccggaagggggaagggggcgtgggaggtgggggtcggacccaaagaagtaaaaggaagagtagggaaacgtcaaagaaaccactaaagtggtggactcgtggtaggaacggggtcctattaccacctattccgaccaaggaacaaccaaaccgaccaaagtacttcagtagtatctaggactaaaagtcgaaacgtacgccgtggaacgacggccggtaaggaccgtaccgggtccgtaaggttaacttacgtggttgtaggagaacgttacagtgaaacgtaacgggtagaacggttacgggggtaagggttgtaagg

SEQ ID NO: 369702 - DNA, 790 bp, Homo sapiens
  misc_feature: GZ8MTXP01BSY8S.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgttgggtttttccttgttgcttattttagaaggtgtccagtgcgaggagcagctggtggaggtcgtgggggacgccgtggtccgagggtcccggggggtccctgagactctccgtgtcgcccgcctcgtggacctctaccttttagacgtcttaagttcggaattggacgtccgttcgggggtccccgccccgaaggggtcccgttacccggaaaggggggaacggggggtcctagggggtaggtcgggggtacggaaccccaaaacgtaaagttaaaaaaggggaagtaaacgttgggaaacggttacgaaagtaaaaaccctacgtaaagttcggtaacgggtactcgttgggtaggtaaacggggccccgtatttacccgaccctaagtacctacccgaaggaacgaaccgaaaccgtacccgtaaagtaactttaccgaaagttcggttaaactcgttacgggtaacaaaagttcgaaaccgtaggccccgttaggaacgaccggaccgtaaacgggaccgtaaacccgggcccggttaagtaacgtttacgtggttggtagaacgttacggacgaagttaacgaacgtaacgggtacgtaaacggaaccggggttaacggggttgtaacggg

SEQ ID NO: 369703 - DNA, 680 bp, Homo sapiens
  misc_feature: GZ8MTXP01APRYP.15.23.C01.1.454.CMB.2.raw
  modified_base (304)..(304): a, c, t, g, unknown or other
  modified_base (597)..(597): a, c, t, g, unknown or other
  modified_base (634)..(634): a, c, t, g, unknown or other
  modified_base (677)..(677): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtgggtggagtcggtgggggtggccgtgggtccgacgggcccgggggggtccctggacgactctcccgtgtcgcccgcctctcggacctctacctttagngcttattggatggagcgtgggtcccgccgaggccgtaccggagggggaacgggggcgtggggaggtgggggtacggaaccctaaacgaagtaaaaaggggaagaagtaggggaaacgtacgaaaggaaaaccctattaaagtgggtaacgggaccttcgtggtaggggtaaacgggccgttaacttcccgaaccctagttcccaccgaaggaacgaaccaaccggaccaaagtaacttcagttacgtatctaggaacaaagtacaaccagccagaggacgcgaagggtacccncgggtcctaagttcttagtggttgtaggagacgttanagtcggaacgtaacgggtacgaaagggttacgggtggggtttnggg

SEQ ID NO: 369704 - DNA, 677 bp, Homo sapiens
  misc_feature: GZ8MTXP01BG4BL.15.23.C01.1.454.CMB.2.raw
  modified_base (203)..(203): a, c, t, g, unknown or other
  modified_base (311)..(311): a, c, t, g, unknown or other
  modified_base (340)..(340): a, c, t, g, unknown or other
  modified_base (566)..(566): a, c, t, g, unknown or other
tcagtctacgtagccacgaccggtgctcgatttagtacacgtgattagggatttgggaggtctcagagaggagccttagccctggactccaaggcctttccacttggtgatcagcactgagcacagaggactcaccagtggagttggggctgagtcttgggttttccttgttgtcttattttagaaggtgtccagtgcgaggngcagcgtggtggagtcggtgggggacggccgttgggtccgacggggtccggggggtccctggacgaccttctccgtgtcgcccgtcctcgtggactctacctttagancttagttggactggagtcgtcgggtcccnccgagggccctcggaaggggaggggtcctggggcggtggggtacgaaccaaacgtaaagtaaaagggagtagtacggaaaggtcaaagaaaactctaaaagttgggtgaacctcgtagggtacggaacggggcctaattcccgaacctgttcccaccgaaagaccaaacgaaaccgacgtaaagtaaccttagagtttagacttaccgagtaaccaaatacgaacncgtccgagacgacgacgacgacgcgtccgtaagtaacttcgagttgtagagttacgcgttagaacggaccggtaaggtacgtaaacgggttaaccgggtgggttcgtaagg

SEQ ID NO: 369705 - DNA, 570 bp, Homo sapiens
  misc_feature: GZ8MTXP01C1QED.15.23.C01.1.454.CMB.2.raw
  modified_base (269)..(269): a, c, t, g, unknown or other
  modified_base (285)..(285): a, c, t, g, unknown or other
  modified_base (329)..(329): a, c, t, g, unknown or other
  modified_base (342)..(342): a, c, t, g, unknown or other
  modified_base (351)..(351): a, c, t, g, unknown or other
  modified_base (358)..(358): a, c, t, g, unknown or other
  modified_base (360)..(360): a, c, t, g, unknown or other
  modified_base (367)..(367): a, c, t, g, unknown or other
  modified_base (373)..(373): a, c, t, g, unknown or other
  modified_base (451)..(451): a, c, t, g, unknown or other
  modified_base (501)..(501): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccaggcccggggggtccctgagactctcctgtgcccgctcnggactcacctttaganctagttgatgagcgtggtccgcaggctccgaggggagggctggngtgggtgaccaanataaagganagaggananagaaacntaatgnggtactcgtggtaggaacgggctatccgactagtccacaagacgaaccaacgaccaaagtacttacgagtcgttaacncgttaggaacgaaagttcgaaactaggcctaggagacgaccgaggtaacncggacgttgtattacgtgttgtaggagagcagtgaacgaacggtagagttaaccggggtggttgtaagg

SEQ ID NO: 369706 - DNA, 723 bp, Homo sapiens
  misc_feature: GZ8MTXP01ALT5I.15.23.C01.1.454.CMB.2.raw
  modified_base (285)..(285): a, c, t, g, unknown or other
  modified_base (347)..(347): a, c, t, g, unknown or other
tcagtctacgtagccacgaccggtgctcgattttagtacacgtgattagggattgggaggtctcagagaggagccttagccctggactccaaggccttttccacttggtgatcagcactgagcacagaggactcaccatggagttggggctgagcttgggttttccttgttgcttattttagaggtgtccagtgcgaggagcagcgtggtggagtcgtggggaggcctggtccgaggccgggggtcctgagctctcctgtcgccgctcgtggctctacctttagngtcttagtggatggagtcgtcgggtcccgccgacggccgtacggagggggaggggcgtgggnggtggggtcgaccgaaacgaagtaaaggaagagtagggaagtacgaaagaaacctacgttaagtaggtcggtaccttacgttgggtaggaacggggtaccgttaacttcccgaacctactccgttaacccgaaggaaaccgaaacccgaaacccggtaaccaaagttaacttacgtagtttacgtattacgtacgaaacgtaaagtacgaacgacgtcctaggaacggaccgcggtaacggaccgtccgggtccgttaagttaacgttacgtagggttaggtacggaacgaacgttacgaacgtaacgggtaaaccggtaacggggttaacggtaacgggttaaaaccgggggtaagggggttttaagttaacggg

SEQ ID NO: 369707 - DNA, 703 bp, Homo sapiens
  misc_feature: GZ8MTXP01EI96N.15.23.C01.1.454.CMB.2.raw
  modified_base (556)..(556): a, c, t, g, unknown or other
  modified_base (585)..(585): a, c, t, g, unknown or other
  modified_base (639)..(639): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtgggtggaggtcgtggggggagtccgtgggtccgacgggccccggggggttccctggacgtaccttcctccgtgtcgccctcctgtcggactctacctttagacgcttagttggatggagtcggtcgggtcccgccgagggccctaccgggagggggaacgggggtcgtaggggtagggtcgggtacgaccaaacgtaaagtaaaagggaagtagttaagggaaactacgaaaggtaaacctacgttaagtaggtaaggtactcgttaggaggtaacgggtacccgtatttacccgacctaagttccaacgaacggaacaacgaaacccgtacaaaggtacttacgagttntaactccgtaggaaactaagtacgaacgngtccgaggacgacggacccggtaggaccgtacggtccgtaaggtattacgggtnttaggagaacgagttcaacgtaaggaacgtaacggttagaacgggttaacgggtggtttgtaag

SEQ ID NO: 369708 - DNA, 623 bp, Homo sapiens
  misc_feature: GZ8MTXP01ACA9S.15.23.C01.1.454.CMB.2.raw
  modified_base (517)..(517): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcttgggttttccttgttgctattttagaaggtgtccagtgcgaggagcagctggtggagtcgtgggggagccgtggtccgagggcccggggggtccctgagactctcctgtcgcccgcctctggactcacctttagagctattagatgagcgtgggtcccgcaggcctccggaggggaaggggctgggaggtgggtcggacccaaagaagtaaagggaagtacgtagggaaagtcgaaagaaaccctattaaagtggtcggtacctcgtaggtacggaacggggtccagtttcccgaccctatccgtaccgaagacgaaccaacgaccaaagtaacttcgagtagtatcgagactaaagtgaaacngccagagacgcggtagacgacggccgttaagtaacttcgtggttagtgaagagacacgtaagtaacgaacgggtgtacggttaaaccggggtgggttaagtaaggg

SEQ ID NO: 369709 - DNA, 815 bp, Homo sapiens
  misc_feature: GZ8MTXP01BMZ85.15.23.C01.1.454.CMB.2.raw
tcagtctacgtagccacgaccggtgctcgatttagtacacgtgattagggattgggaggtctcagagaggagcccttagccctggactcccaaggcctttccacttggtgatcagcactgagcacagaggactcaccatggagttgggctgagctgggttttccttgttgctattttagaggtgtccagtgcgaggagcagctggtggagtcgtgggggaggccgtggtccgagggccggggggtccctggacgaccttctcctgtcgcccgcctctggaccttctacctttagtagcttagttggatggagtcgtcgggtccccgccgaggccgtccggaagggggaacggggtctagggggaggtggggtacggaccaaacgaagtaaaacggaagtagtacggggtaaacgtacgaaacgaaaacctaccgttaaagtcgggttaacgggaccctttaccgttagggttacgggaacggggtccccgtaagtttacccgaacccctacgtacccgttaccccgaaggaacgaaacccgaaacccggacccctaaaaggtaaaccgttttaccgaaggttagttaacttacccggttaggggaaaccctaaaagttaccggaaaacgaccggtaacccgttaggaaacggaacccgggtaccgggaaccggaaccgtacccggggtacccggttaaggttaaacttttccggacgttggtacgaagggacggttacccttaagtaacggaaaacccggtaacggggttacggaaaaccgggttaacccggggtaacgggggttttcgtaaggg

SEQ ID NO: 369710 - DNA, 710 bp, Homo sapiens
  misc_feature: GZ8MTXP01EZZWQ.15.23.C01.1.454.CMB.2.raw
  modified_base (318)..(318): a, c, t, g, unknown or other
  modified_base (568)..(568): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcgtgggggaggccgtggtccgagggccggggggtccctgagctctcctgtcgccgcctcgtggactctacctttagagtctagttggatgagcgtcgggtcccnccgaggcctaccggaagggggaacgggggcgtgggaggtgggggtacgaccaaagaagtaaaagggaagaagtacgggaaacgtacaaagaaacctactaaagtggtcggaaccttcgtagggtacgggaaacggggtcccgtactttacccaaccctaattcccgtaccgaaggaaaccgaaccgaaacccggaccaaaaggtaactttaccgaagtttgtactccgtaggaactaaaagtcgaaaccncgcccgtaggaacggaccggacccggaagggaaccccgccggggtaccgttaagtttaacgtttacgtggttagaggaagacgaacaggtaacgaaacggtaacgggtggaacggttaaccgggggtaagggttcgtaaggg

SEQ ID NO: 369711 - DNA, 723 bp, Homo sapiens
  misc_feature: GZ8MTXP01BX8NQ.15.23.C01.1.454.CMB.2.raw
  modified_base (317)..(317): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggagccgtgggtccagggccggggggtccctgagactctcctgtcgcccgctctacggctctacctttagagctagtggatgagtcgtacggggtcccnccgaggtcctaccggagggggaacggggtctgggggtaggttcgggggtggaacccgaaactaagtaaaagggagagtaacgggaagtacgaagtaaaaccgactaagtggttcggaccttagtcgggttaacgaacggggtccgtaactttaccgacccttaatcccgtaacccgaggtaaaccggaaccctaaaaccgggaccctaaaaggtaaccctttgaaacggtttacgttaacgtccggtaaggaaactaaaggtacgaaccgtacgccgtagaacggaccggacgtacgggacccgtaacgggtcgttaagtacgttcggtagaggtaacgaaggacgcgttacgtaaccggaacggtaacgggtaggaaacggggttaccgggggtggttaaggaag

SEQ ID NO: 369712 - DNA, 658 bp, Homo sapiens
  misc_feature: GZ8MTXP01AZAAX.15.23.C01.1.454.CMB.2.raw
  modified_base (331)..(331): a, c, t, g, unknown or other
  modified_base (425)..(425): a, c, t, g, unknown or other
  modified_base (550)..(550): a, c, t, g, unknown or other
  modified_base (592)..(592): a, c, t, g, unknown or other
  modified_base (611)..(611): a, c, t, g, unknown or other
  modified_base (631)..(631): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcttgggttttccttgttgcttattttagaaggtgtccagtgcgaggagcagcgtggtggagtcgtgggggacgccgtgggtccgagggtcccggggggtccctgacgactctccgtgtcgcccgtctcgtggtacctctacctttaggatacttagttggatgacgtcggtcgggtcccnccgaggtcgtaccggagggggaacggggctagggaggtgggggtcgaaccaaacgaagtaaaaggagagtaggaaacgtacaaagaaaaccgtntaaggtagtcggtactcgtagggtacggaacggggtcctattacccacctagttccacgaacgacgaactaaccgacctaaagtacttcgagttctaactcgaggaaactaaagtacgaacgacncgagaacgtacgcgtacggacgaccggtcgtaatctttacgnggttgtaggaagacgttanaggtaacgaacgtaacgggngtaacgggttacgggtggttaacggtg

SEQ ID NO: 369713 - DNA, 672 bp, Homo sapiens
  misc_feature: GZ8MTXP01ET119.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgcttattttagaaggtgtccagtgcgaggagcagctggtggagtcgtgggggagcctggtccgaggccggggggtcctgagctctcctgtcgccgctcgtggactctactttagagtctagttggatggagcgtgggtccccgcgagggcctaccggaggggaacggggctggggaggtgggggtggaccaaagtaagtaaaagggaacgagtagggaaagtacaaagaaacctacgtaaatgggtggaactcgtggtacggaaacgggtccgaatttaccacctatccgtaccaagacgaacgaaaccgaccaaagtacttacgagttagtaatcgtaggaactaaagtacgaaacgacgccgtaggaacggaccggccggaaggaccgaccgggtcccggttaaggttaacctttaggtagttgtaggaagaggttaccaagtaacgaaaccgggtaacggttaggaacggttaaaccgggggtggggttttaacggtaaggg

SEQ ID NO: 369714 - DNA, 812 bp, Homo sapiens
  misc_feature: GZ8MTXP01CF2B7.15.23.C01.1.454.CMB.2.raw
  modified_base (634)..(634): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggaggttggggctgagtcgttgggttttccttgttgtcttattttagaaggtgtccagtgcgaggagcagcgtggtggaggtcggtgggggaggccgtgggtccgacggggtcccggggggtccctggacgtactcctccgtgtcgcccgtcctcgtggactcctacctttagacgtctagttggatggacggccggttcgggtcccgccgacggggcccgtaccgggaaggggggaacgggggtcgttacgggggagggttgggggtacggaacccaaacgtaaagtaaaaggggaagtagttaaccggggaaagtacgaaaggtaaaactaccgttaaagtcgggttcgggaccttcggtagggttagggaaacggggccccgtaatttacccaacccgtattaccccgtaccgaagaacgaaaccaaacccggacctaaaaggtactttaccgagttacgttactaccgtagaacgtaaaacgtcgaaaaccgnggtaccccgtagggaacggacggacccggaacgggtaaccgtccgggtcccggtttaagttaaccttttagggcggtttagggtaacggaggaacgttaaccgttagttaacccgggaacggttaacggggtaacggtaaccggggttaaccgggggtgggggtttaactaacggggg

SEQ ID NO: 369715 - DNA, 565 bp, Homo sapiens
  misc_feature: GZ8MTXP01AP806.15.23.C01.1.454.CMB.2.raw
  modified_base (315)..(315): a, c, t, g, unknown or other
  modified_base (345)..(345): a, c, t, g, unknown or other
  modified_base (352)..(352): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggaggcctgggtccgaggcccgggggggtccctggacgactctcctgtcgcccgcctctggactcacctttagagctattggatgagctgggtccncaggctccgagggaggggctgggagtgggngaccaanagtaaaggagatggaatcaagaaacactaagtgtggactcgtgtaggaacgggccattccaccctatcctaccagacgacaacgccaaagtaattcagttgtactctaggacaaatcgaaacagcctgagacgccggtaggacacgggccgtaagtattacgtgttgtagagagcagtgacgtaacggtgacgttaccgggaagggttgaagg

SEQ ID NO: 369716 - DNA, 685 bp, Homo sapiens
  misc_feature: GZ8MTXP01A2PRS.15.23.C01.1.454.CMB.2.raw
  modified_base (319)..(319): a, c, t, g, unknown or other
  modified_base (619)..(619): a, c, t, g, unknown or other
  modified_base (630)..(630): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggccggggggtccctggagactctccgtgtcgcccgtcctacgtggactctacctttagagctattggatggacgcgtgggtcccnccgaggtcctaccggagggggacggggcgtgggaggtggggtacgacccaaagaagtaaaaggaagagtagggaaacgtacgaaagtaaacctagttaaagtcggtaaggtactcgtagggtacgggaaagggcccctattaccaacctattacccacccgaaggaaccaaccgtaaaccgaccaaaagtaccctttagaagttcgttaaactccgttaagggaactaaaaagttcggaaaacctggacccgttagaacggacgacccggaaggttacccgacgggtctgttaattcggngttagtggaanacgacttacgaacgaacggtaacgggtagtaacgggttacggggtggttgtaagg

SEQ ID NO: 369717 - DNA, 616 bp, Homo sapiens
  misc_feature: GZ8MTXP01DEFQF.15.23.C01.1.454.CMB.2.raw
  modified_base (288)..(288): a, c, t, g, unknown or other
  modified_base (309)..(309): a, c, t, g, unknown or other
  modified_base (547)..(547): a, c, t, g, unknown or other
  modified_base (569)..(569): a, c, t, g, unknown or other
  modified_base (610)..(610): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagtcttgggttttccttgttgcttattttagaaggtgtccagtgcgaggagcagctgggtggagtcgtgggggagccgtggtccgaggcccggggggtcctgagactctcgtgtgcccgcctctggactctacttagnctattgatgagcgtggtcccncaggctccggaggggacgggctgggaggtgggtaggaccaaagaagtaaaaggagagtacgggaaatacaaggaaacactaagtaggtgaactcgtaggtacggacggccgtatccacctatccgacaaggacaaccgaaacgtaccaaagtacttcgagttacgtatccgtaggaactaaagtcgaaacgcgtccgagacggaaccgccggtaaggaccaccggggtcttaaggttnttacggtgttgagtaagagacngtaacgaacgtaagggtcgtaaacggttacggggtgggttntaaggg

SEQ ID NO: 369718 - DNA, 587 bp, Homo sapiens
  misc_feature: GZ8MTXP01A99WX.15.23.C01.1.454.CMB.2.raw
  modified_base (381)..(381): a, c, t, g, unknown or other
  modified_base (460)..(460): a, c, t, g, unknown or other
  modified_base (482)..(482): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccaggccggggggtccctgagactctcctgtgccgcctctggactcgacctttagagtctaattggactgagctgggtcccgcaggtcctccgagggtagggctgggagtgggtggaccaacaagtaaaaggacgagtacggaatcaagaaacnctaaagtcgtggaactcgtaggtgaacgggcgtattccacctatcaccgaagacgacaacgtccaaagacttcaagttntatcgagaacaaagtacgaacngcgagacgacgccgacgacgtaccggcgtgtacttcgtggttagacgaagagttacttagaagacgaacggaggtaacggttaacgggtaacgggttaaggtaag

SEQ ID NO: 369719 - DNA, 696 bp, Homo sapiens
  misc_feature: GZ8MTXP01D8NFI.15.23.C01.1.454.CMB.2.raw
  modified_base (306)..(306): a, c, t, g, unknown or other
  modified_base (308)..(308): a, c, t, g, unknown or other
  modified_base (587)..(587): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagtcgttgggtttttccttgttgcttattttagaaggtgtccagtgcgaggagcagcgtgggtggagtcgtgggggagccgttcggtccgacgggccggggggtccctagacgtacttcctccgtgtcgcccgtcctgtcgtactctacctttagngntagttgatgacgtcgtgggtcccgcgacggtaccgtccggaaggggggaacggggtcgttagggggaggttcgggggtacgggaacccctaaaagtaaaggtaaaaaggggaaagtaggttaacgggaaagtacgaaacgtaaaactacgttaaagttcggtgggtacttcgtaggtaggaacggggaccgtatttaacccactactccgtaccaaggactaaccgaaacgaccaaagtactacgagtactaacttctaggaactaaagtacgaaaccncgaccgtagacggacgaccgacggacgtacggccgttaagtagttacgtgttgtaaggagacgacgagtaacgaacgaaggtacgagggttaccgggtgggttgtaagg

SEQ ID NO: 369720 - DNA, 732 bp, Homo sapiens
  misc_feature: GZ8MTXP01ET4FS.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagtcttgggttttccttgttgcttattttagaaggtgtccagtgcgaggagcaggcgtggtggaggtcggtgggggacggtccgttcgggtcccgacggggtcccgggggggttccctaggacgtaccttccgttcccgtgtccgcccgtcctcgtcggactctacctttagagtctagttggatggacgtcgtcgggtcccgaccgacggtcctaccgggaagggggaacgggtcgtagggggtacgggtgggggtacggaaccgaaagaaagtaaaagggaagtagtaagggaaacgttacgaaacgaaactacgttaagtacggtcggtaacttcggtaggtacggggaaccgggtcctaacttaccacgtatccacgaacgacgtaacaaacgtacaaagtattacagttatactcgaaggaaactaagtacgaacgtcgacgtagggaagacccgggacgtaaacgggaccgtacggtcgtttaagttaatttcggtggttagtgaaacgttacgacttacggtaaggaaacccgtaaggggtagaaaccgggttaacgggggtaaggtttcgaaggg

SEQ ID NO: 369721 - DNA, 776 bp, Homo sapiens
  misc_feature: GZ8MTXP01BGR4O.15.23.C01.1.454.CMB.2.raw
  modified_base (183)..(183): a, c, t, g, unknown or other
  modified_base (319)..(319): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgctattttagaaggtntccagtgcgaggagcagcgtggtggagtcggtgggggacgcgtggtccgagggccggggggtccctggagactcgtcctgcgccgcctactggacctctaccttagacgctagttggatggacgcgtcgggacccncaggcctacggaggggaacgggctgggaggttcgggacgacctaaagaaggaaaacggagtagtaccccggaaattacgaaagaaaccgtataaagtgtaacgggaaccttcgtaacggtaggaaaccgggcccgtaattacccaaccctaggtccaccgaaggaacgaaacccgaaacccggactttaaaaggaactttaccgaggttagttaaactccgttaggggaaaccaaagttacggaaaccccaggtttaccccgagggaaccggaacggaccccgggtaagggtttaaccccaccggggtacccgttaaggttaaacgttcggtttacggttacgggtaacggtaacggaaacccccgttgaaaggttaacccggggaaaagttttaacccggggtaggaaaccccgggtttaaaacggggggttcgggttttaacggtaaaccccggg

SEQ ID NO: 369722 - DNA, 700 bp, Homo sapiens
  misc_feature: GZ8MTXP01AKOKJ.15.23.C01.1.454.CMB.2.raw
  modified_base (217)..(217): a, c, t, g, unknown or other
  modified_base (329)..(329): a, c, t, g, unknown or other
  modified_base (626)..(626): a, c, t, g, unknown or other
  modified_base (645)..(645): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcttgggttttccttgttgattattttagaaggtgtccagtgcgaggagcagcgtggtggagtcggngggggacggccgtggtccgacgggcccggggggtccctggagacctctccgtgtcgcccgtcctcgtggacctctacctttagagtcttagttgatgagtcgtcgggtcccncgaggcgtacggaggggagggctagggaggtgggtacgaccaaagtaagtaaaggagagtaggaagtacaaagaaacacttaaagtggtcggtactacggtaggttacgggaaacgggtcccgttaaacttacccaacccgttacgttacccgtaaccaacgggtaaacgaaacccaaaacccggggtaccaaaaaggttaacttccgtaaagttaggttaactacgttaacgggaaactaaaagttacgaacaacgcccgtaggaaggaccgaccggaggaccctcgggtccgttnttaaacgttgtgttggaanaggacgttcgaagtcgtaaacggaaggtagaacggttaacggggtgttgtaacgg

SEQ ID NO: 369723 - DNA, 713 bp, Homo sapiens
  misc_feature: GZ8MTXP01A0OYI.15.23.C01.1.454.CMB.2.raw
  modified_base (554)..(554): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcgtgggggagccgtggtccgagggccggggggtccctgagactctcctgtcgccgcctcgtggactctacctttagagtctattggattggagcgtcgggtccgccgaggctaccgagggggaaggggtctggggaggtcgggggtacggacctaaacgaagtaaaacggggaagagttacggggaaactacaaaggaaaacctacgttaaaagttcgggtaacggtaacccttcgtaggggttacgggaaacgggggtccctaaatttcccaaccgtattacccacccgaagggaaccaaaccgaaaccggaccctaaaaggtaactttcgaaggtttntactacgaggaaactaaagtcgaaacgcgtaccgaggaacgaccggaccgtaacggacctcgttcggtaaccgttagtttaacgtaggttggtagtacgaagcgaactaaggtacgtaaaccggtaagggtaggaaacgggttaacgggggttgggtaa

SEQ ID NO: 369724 - DNA, 562 bp, Homo sapiens
  misc_feature: GZ8MTXP01BDJKP.15.23.C01.1.454.CMB.2.raw
  modified_base (247)..(247): a, c, t, g, unknown or other
  modified_base (295)..(295): a, c, t, g, unknown or other
  modified_base (387)..(387): a, c, t, g, unknown or other
  modified_base (422)..(422): a, c, t, g, unknown or other
  modified_base (478)..(478): a, c, t, g, unknown or other
  modified_base (493)..(493): a, c, t, g, unknown or other
  modified_base (513)..(513): a, c, t, g, unknown or other
  modified_base (525)..(525): a, c, t, g, unknown or other
tcagtctacgtagccacgaccggtgctcgatttagtacacgtgattagggattggggaggtctcagagaggagccttagccctggactccaaggcctttccacttggtgatcagcactgagcacagaggactcaccatggagttggggctgagctgggttttcctgttgctattttagaaggtgtccagtgcgaggagcagctgggtggagtctgggggagcctggtccagccgggggggtccctgngactctcctgtgcccgctctggactcacctttagagctattggatgancgtggtccgccaggcctccgaggggaagggctggacggtgggtgccaaacagtaaaggaagacgtacggaagttacaagaaactacgtaaancgtggaactcgtgtacgaagggccattcaccatcnccagacgacgaacgcctaaagattcagtgtatctgggacaaatgaacagaccctgngaagcccgaggtacnccggcgaagtacttattggngtagacgagttnacgtgtacgaaggtagacgttaaccgggtggttgtcg

SEQ ID NO: 369725 - DNA, 605 bp, Homo sapiens
  misc_feature: GZ8MTXP01EKSBQ.15.23.C01.1.454.CMB.2.raw
  modified_base (269)..(269): a, c, t, g, unknown or other
  modified_base (311)..(311): a, c, t, g, unknown or other
tcagtctacgtagccacgaccggtgctcgatttagtacacgtgattagggattgggaggtctcagagaggagccttagccctggactccaaggccctttccacttggtgatcagcactgagcacagaggactcaccatggagttggggctgagctgggttttccttgttgctattttagaaggtgtccagtgcgaggagcagctggtggagtcgtggggggagcctggtccaggccggggggtccctgagactctcctgtgcccgcctntggacctctacctttagagctattggatgagcgtgggtcccnccgaggctccgaggggaggggctgggagtggggtgaccaaagagtaaaggaagagttacggaagtacaagaaacactaaagtgtggactctggtagaacgggccgatttccacatcctcaagacgacaacgacaagattcgagtgtactctagggactaaaagtcggaacacgccgtaggaacggacggaccgagggtaaccgccgggtcccgtaagttaacttagtggttgaggaagagttacttagtcgaaccgtaagggtaggaccggttaaacggggtggggttgtaagg

SEQ ID NO: 369726 - DNA, 714 bp, Homo sapiens
  misc_feature: GZ8MTXP01DO3IX.15.23.C01.1.454.CMB.2.raw
  modified_base (500)..(500): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcacatggagttggggctgagctgggttttccttgttgctattttagaaggtgtccagtgcgaggagcagcgtggtggagtcgtgggggaggcctgggtccgagggcccgggggggtccctggacgtactcgtccgtgtcgcccgcctcgtcggactctaacctttagacgctagttggatggagcgtgggtcccgcaggcctacggaggggaaggggctgggaggtggggtacgaccaaagaagtaaaggaagataggaactacgaagaaacactaagtgtcggactcgtaggtaggaaacgggctattccaaccgtattccaccgaaggaacgaacaaaccggaccaaaggtaactttcaaaggtttnttaactacgtaggaaactaaagtacgaaacgtacggccgtaggaacggaacggaccggtaaacggaacccggtacgggtccgtttaaagttaacgtttacggtagggttaggtaacggaacggttaacggacgttaaaggttaacgggaaaaccggtaacggggttaaggtaaaccggggtttaaaccgggggtaaggggtttaaggtaaccgg

SEQ ID NO: 369727 - DNA, 687 bp, Homo sapiens
  misc_feature: GZ8MTXP02HT771.15.23.C01.1.454.CMB.2.raw
  modified_base (295)..(295): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcggtggtttcgtgtaggcgtattttagaaggtgtccagtgcgaggagcagctggtggagtctgggggagcctggtccagccgggggggtccctgagactctcctgtgccgcctctggactcacctttagtagctattggatgngcgtcggtccgcgacgcgtccgaggggaggggcggtgggaggtgggtcggaccgaaacgaagtaaaaggaaagaagtaggaagtacgaacgaaacaactagtagtgtacgtacgtgtaggaagggacgtactacacctactctacgaacgacgaacgaacgaaccgaaacgtaactacgtagtagttattacgtagtaacgtaaagtaacgaacgaacgaccgtacggacggacggaccggaacggaccggaaccgggtacccggttacggttaacgtttacgttacggttaggttacggtaacggtaacggtaacgtaacgtaacggtaaacggtaaacgggttaacgggtaaacggttaaaccggggtaacgggggtttacgggtaacgg

SEQ ID NO: 369728 - DNA, 586 bp, Homo sapiens
  misc_feature: GZ8MTXP02G5WCN.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagtagctattggatgagctgggtccgccaggctccgaggggaaggggctgggagtggggtggccaaacgataaaaggaagatgggaaagtcaagaaacactatggtgggacttctggtagaaggggccgattccaaccattccctaccaaggacaaccaacgaccaaagaacttcagtgtaatctagactaaaatcgaaacagacccgtagacgacgccggaaggaccgacgggccgttagtacttacgtggtagtagagagacagtgaacgaacgggtgaacgtaaccggggaggggtataagg

SEQ ID NO: 369729 - DNA, 550 bp, Homo sapiens
  misc_feature: GZ8MTXP02JFZXN.15.23.C01.1.454.CMB.2.raw
  modified_base (378)..(378): a, c, t, g, unknown or other
  modified_base (527)..(527): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccagccgggggggtccctgagactctcctgtgccgcctctggactcacctttagtagctattggatgagctgggtccgccaggctccgaggggaaggggctgggagtggggtggccaaacataaaaggaagatgggaaagtcaagaaaacnctaatgtggactctgtgaaggggccattcaacccatctccagagacaacgccaaagaattcagtgtaatctgacaaaatgaaacagccctgagagcccgaaggacacggccgtagtacttactgtagtgagagacatgacaaacgggtnaagtaaccgggaggggtttagag

SEQ ID NO: 369730 - DNA, 601 bp, Homo sapiens
  misc_feature: GZ8MTXP02IFT6N.15.23.C01.1.454.CMB.2.raw
  modified_base (384)..(384): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttcctgttgctattttagaaggtgtccagtgcgaggagcagctgggtggagtcgtgggggaggcctgggtccaggccggggggtccctgagactctcctgtgccgcctctggactcacctttagtagctattggatgagctgggtccgccagggctccgaggggaaggggctgggagtggggtggccaaacaagtaaaagggaagatgggaaagtcaagaaaacnctaatgtgggacttcgtggtagaacgggggcccatttccaaccctatcctacccagaacgaaccaaacggcccaaagaacttcagtgtaatctaggactaaaatgaaacagaccctaggaacgaggacccggaaggaccacgggcccgtaggttattacgtgtagtggacgagacagtgaacgaacggtagaagtaaccggggtaggggttagtagg

SEQ ID NO: 369731 - DNA, 547 bp, Homo sapiens
  misc_feature: GZ8MTXP02HKPUU.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctgggtccaggccgggggggtccctgagactctcctgtgccgcctctggactcaccttagtagctattggatgagctgggtccgccaggctccgaggggaaggggctgggagtggggtggccaaacataaaaggaagatgggaaagtcaagaaaacactaatgtggactctgtgaaggggccattcaccatctccagagacaacgccaaagaattcagtgtaatctagcaaaatgaaacagccctgagagccgaaggaccacggccgtagtacttatgtgtagagacgacataagacaacgtagagtaacggacgggtaggtagg

SEQ ID NO: 369732 - DNA, 614 bp, Homo sapiens
  misc_feature: GZ8MTXP02HEOLZ.15.23.C01.1.454.CMB.2.raw
  modified_base (435)..(435): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgccgcctctggactcacctttagtagctattggatgagctgggtccgccaggctccgaggggaagggcgtgggaggtggggtcggccaaacgaagtaaaagggaagatagggaaagtcaagaaaacactaatggtggactctgtagaaggggccattcacctatcctaccaagganaaccaacgccaaagtaacttcgagtgtatcgtagactaaaagtcggaaactacgccctaggaacgacgacccggaggtaaccgaccgggtcccgttagtaaccgttgtaggtaggtacgaagacgaacgagtaaggaacgtaacgggtagtaaccggtaacggggtaggggtacgtagg

SEQ ID NO: 369733 - DNA, 562 bp, Homo sapiens
  misc_feature: GZ8MTXP02JXV66.15.23.C01.1.454.CMB.2.raw
  modified_base (352)..(352): a, c, t, g, unknown or other
  modified_base (477)..(477): a, c, t, g, unknown or other
  modified_base (513)..(513): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttcctgtgctattttagaaggtgtccagtgcgaggagcagctggtggagtcgtgggggaggcctgggtccaggccgggggggtccctgagactctcctgtgccgcctctggactcacctttagtagctattggatgagctgggtccgccagggctccgaggggaaaggggctggggaggtggggtggaccaaanaagtaaaaggaagatagggaaagtcaaggaaaacactatgtggactctgtagaaggggcccgaattccaccatctccagacgacaacgccaaagaattcagtgtatctagacaaatgaacagccngagagccgaggacgacggccgtagtattacgtgtgngacgacgactagaagacgaacggtgacgtaaacgggtagggggttagag

SEQ ID NO: 369734 - DNA, 551 bp, Homo sapiens
  misc_feature: GZ8MTXP02G4H3M.15.23.C01.1.454.CMB.2.raw
  modified_base (418)..(418): a, c, t, g, unknown or other
  modified_base (507)..(507): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttctgttgctatttagaaggtgtccagtgcgaggagcagctggtggagtcgtgggggaggcctggtccaggccgggggggtccctggagactctcctgtgccgcctctggactcacctttagtagctattggatgagctggggtccgccagggctccgaggggaaggggctgggagtggggtggccaaacgagtaaaggaagatacgggaagtcaagaaacactatggtggactcgtgtagaagggccgattcaccatcncagagacaacgccaagaattcagtgtatcgtagcaaaatgaaacagacctagagagccggaggacacgggtccgtagtattacgtgtgngagagacagaagagaacggtacgagtaacggtagggtaggtagg

SEQ ID NO: 369735 - DNA, 598 bp, Homo sapiens
  misc_feature: GZ8MTXP02H68YV.15.23.C01.1.454.CMB.2.raw
  modified_base (557)..(557): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggttttcctgttgctattttagaaggtgtccagtgcgaggagcagctggtggagtcgtgggggagcctggtccaggccgggggggtccctgagactctcctgtgccgcctctggactcacctttagtagctattggatgagctgggtccgccagggcctccgaggggaaggggctgggagtggggtggccaaacagtaaaaggaagatgggaaagtcaagaaaacactagtggtgggacttcgtggtagaaacgggggccctaatttcccaaccctatcctacccaaggaacgaaccaaacgccctaaaagaacttcaagtgtaatcgtgaccaaaatcgaacagccctggaagcgacccggaggaccgacgggccgttagtacttatggtgtagagacganataagacgaacggtacggagtaacggtacggggtaggtagg

SEQ ID NO: 369736 - DNA, 541 bp, Homo sapiens
  misc_feature: GZ8MTXP02J2JOS.15.23.C01.1.454.CMB.2.raw
  modified_base (416)..(416): a, c, t, g, unknown or other
  modified_base (445)..(445): a, c, t, g, unknown or other
  modified_base (449)..(449): a, c, t, g, unknown or other
  modified_base (453)..(453): a, c, t, g, unknown or other
  modified_base (455)..(455): a, c, t, g, unknown or other
  modified_base (508)..(508): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggttttcctgttgctattttagaaggtgtccagtgcgaggagcagctggtggagtcgtgggggaggcctgggtccaggccgggggggtccctgagactctcctgtgccgcctctggactcacctttagagctattggatgagctgggtccgccaggctccgaggggaaggggctgggaggtggggtggccaaacgagtaaaaggagatacggaagtcagaaacactatgtggactctgtgaagggccgtattccaccatcnccagacgacaacgccaaagtaattcagtntatnagananagacagcgagagacgacgacgacgacgcgtacgtagtactgtgtagagacganagaagacgacgacgtagtacggtacggtaggtg

SEQ ID NO: 369737 - DNA, 587 bp, Homo sapiens
  misc_feature: GZ8MTXP02JX0DR.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttcgtgtgctattttagaaggtgtccagtgcgaggagcagctggtggagtcgtgggggaggcctgggtccaggccgggggggtccctgagactctcctgtgccgcctctggactcacctttagtagctattggatgagctggggtccgccagggctccgaggggaaggggctggggagtggggtggccaaacgaagtaaaaggaaggatgggaaacgtcaagaaaacactagtgtgggaccttgtggtgaaacggggccgaattccaccctattcccacccaagacgaaccaacggacccaaaaggtaacttacagtgtaactcagacaaatagaacacgacctagagacgacgacggacgacggaccgtcgtatagtgtgtagagacgaagagaagacgaacgtacgacggtacggtacgggtaggtg

SEQ ID NO: 369738 - DNA, 553 bp, Homo sapiens
  misc_feature: GZ8MTXP02HGE8N.15.23.C01.1.454.CMB.2.raw
  modified_base (456)..(456): a, c, t, g, unknown or other
  modified_base (458)..(458): a, c, t, g, unknown or other
  modified_base (463)..(463): a, c, t, g, unknown or other
  modified_base (518)..(518): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttccgtgttagctattttagaaggtgtccagtgcgaggagcagctggtggagtctgggggaggcctggtccagccgggggggtccctgagactctcctgtgccgcctctggactcacctttagtagctattggatgagctggggtccgccagggctccgaggggaaggggctgggagtggggtggccaaacataaaaggaaagatagggaaagtcagaaaacactaatgtggactctgtgaaggggccattcaaccatcctccagagacaaacgccaaagaattcagtgtaatctnanaatanacagacagagacgacgacgacgacgacgtacgtagttagtagtgtagagagaganaagacgaacggtacgagaacggtacgggtaggtag

SEQ ID NO: 369739 - DNA, 618 bp, Homo sapiens
  misc_feature: GZ8MTXP02HGX94.15.23.C01.1.454.CMB.2.raw
  modified_base (420)..(420): a, c, t, g, unknown or other
  modified_base (425)..(425): a, c, t, g, unknown or other
  modified_base (448)..(448): a, c, t, g, unknown or other
tcagtctacgtagccacgaccggtgctcgatttagtacacgtgattagggattgggaggtctcagagaggagccttagccctggactccaaggcctttccacttggtgatcagcactgagcgacagtaggacgtcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagtagctattggatgagctgggtccgccaggctccgaggggaaggggctgggaggtggggtggccaaacaagtaaaaggaagagtagggaaagtcaagaaaaccatatgtggactgtgtgaaggggcatcacatcncaganacacgccaaagaattcaaggttntatctagaactaaatacgaaacacgccgtaggaacggacggacccggaagggaaccgaccggggttaccgttagtttaacgttacggtggttaggtaggaacggaacgactaagtaagaacgaaacgggtaacggtaacggtaaaccggggtaacgggggttagggtagg

SEQ ID NO: 369740 - DNA, 542 bp, Homo sapiens
  misc_feature: GZ8MTXP02I29JG.15.23.C01.1.454.CMB.2.raw
  modified_base (412)..(412): a, c, t, g, unknown or other
  modified_base (417)..(417): a, c, t, g, unknown or other
  modified_base (436)..(436): a, c, t, g, unknown or other
  modified_base (439)..(439): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctgagactctcctgtgccgcctctggactcacctttagtagctattggatgagctgggtccgccaggctccgaggggaaggggctgggagtggggtgccaaacagtaaaggaagatggaagtcaagaaaacactatgtggactctgtgaagggccattcaccatcncaganacaacgccaagaatcagtntanctgacaaatgaacagcctgagagccgaggacacgggcctagtattactgtgtagagacgacagtcgaacgaaacggtgaacgtaaccggggaggggtttagag

SEQ ID NO: 369741 - DNA, 561 bp, Homo sapiens
  misc_feature: GZ8MTXP02JQVBO.15.23.C01.1.454.CMB.2.raw
  modified_base (347)..(347): a, c, t, g, unknown or other
  modified_base (443)..(443): a, c, t, g, unknown or other
  modified_base (447)..(447): a, c, t, g, unknown or other
  modified_base (453)..(453): a, c, t, g, unknown or other
  modified_base (455)..(455): a, c, t, g, unknown or other
  modified_base (458)..(458): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttcgtgtaggctatttagaaggtgtcagtgcgaggagcagctggtggagtcgtgggggtggcctgggtccaggccggggggtccctgagactctcctgtgccgcctctggactctacctttagtagctattggatgagctgggtccgccaggctccgaggggaaggggctgggaggtgggtggccaaanagtaaaaggagatcggaagtcaagaaacatatgtggactgtggtagaaggggcctattccaacctatcctaccagacgacaaacgctaaagaattnagtntatctnanaanagacagacgagagacgacgacggacgacggacgtacgtacgttagtgtgtagacgacgagagaagacgaacggtacggtaacggtaacggtacgggtaggtag

SEQ ID NO: 369742 - DNA, 594 bp, Homo sapiens
  misc_feature: GZ8MTXP02II2AW.15.23.C01.1.454.CMB.2.raw
  modified_base (468)..(468): a, c, t, g, unknown or other
  modified_base (532)..(532): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctgggtggagtcgtgggggaggcctgggtccaggccggggggtcctgagactctcctgtgccgcctctggactcacctttagtagctattggatgagctgggtccgccaggctccgaggggaaggggctgggagtggggtggaccaaacgaagtaaaaggaaagataggaaagtacaagaaaacactaatggtgggactcgtggtaggaaacgggggccaattccaaccatccctccaagagaacaaacgcccaaaagattacagtntaatctagacaaaatgaaacagcctagaacgaggccggaaggactacgggccgttagtattacngttagagagggacatacggaacgaacggtacggagtaaaccggggtggggttagaagtcggg

SEQ ID NO: 369743 - DNA, 579 bp, Homo sapiens
  misc_feature: GZ8MTXP02IJ591.15.23.C01.1.454.CMB.2.raw
  modified_base (404)..(404): a, c, t, g, unknown or other
  modified_base (531)..(531): a, c, t, g, unknown or other
  modified_base (569)..(569): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggtttccttgttgctattttagaaggtgtccagtgcgaggagcagctggtggagtcgtgggggaggccgtgggtccgaggccggggggggtccctgagactctcctgtgccgcctctggactcaccttagtagctattggatgagctgggtccgccaggctccgaggggaaggggcgtgggaggtggggtggaccaaacgaagtaaaagggaaagatagggaaagtacaagaaacataatgtggactntgtgaaacggggccattccaaccctatcctccagagaaccaacgaccaaagaattcagtgtaatctagactaaaatgaaacagcctgaagacggcccgaaggacgacggccgttagtaactttacgngtgtgaacgagacatgaactaaggtgaagtaaccgggngggttagagg

SEQ ID NO: 369744 - DNA, 539 bp, Homo sapiens
  misc_feature: GZ8MTXP02JJPIF.15.23.C01.1.454.CMB.2.raw
  modified_base (494)..(494): a, c, t, g, unknown or other
  modified_base (509)..(509): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccaggccgggggggtccctgagactctcctgtgccgcctctggactcacctttagtagctattggatgagctgggtccgccaggctccgaggggaaggggctgggagtggggtggccaaacagtaaaaggaagatcgggaaagtcaagaaaacactatgtggactctgtgaagggccattcaccatctccagagacaacgccaaagaattcagtgtatctagacaaatgaacagcctagagagccgaggaccacggccgtgtatacngtgtagacgagacangacgaacgtagagtaccggacgggtagtag

SEQ ID NO: 369745 - DNA, 561 bp, Homo sapiens
  misc_feature: GZ8MTXP02H1XFA.15.23.C01.1.454.CMB.2.raw
  modified_base (507)..(507): a, c, t, g, unknown or other
  modified_base (558)..(558): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggtggcctggtccgaggccgggggggtccctgagactctcctgtgccgcctctggactcaccttagtagctattggatgagctgggtccgccaggctccgaggggaaggggctgggagtggggtggccaaacgaagtaaaaggaagatggaaagtcaagaaaacactatgtggactctgtagaaggccgattcaccatcctccagagacaacgccaaagaacttcagtgtatctagactaaatgaacagcctaggacgacggccgaggaccacgggccgtagtattacgngtgtgagacgacataacgaacgaacggtgaacgtaaccggggaggggttanagg

SEQ ID NO: 369746 - DNA, 545 bp, Homo sapiens
  misc_feature: GZ8MTXP02GZPAT.15.23.C01.1.454.CMB.2.raw
  modified_base (475)..(475): a, c, t, g, unknown or other
  modified_base (499)..(499): a, c, t, g, unknown or other
  modified_base (503)..(503): a, c, t, g, unknown or other
  modified_base (524)..(524): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggaggcctggtccaggccggggggtccctgagactctcctgtgccgcctctggactcacctttagtagctattggatgagctgggtccgccagggctccgaggggaaggggctggagtggggtggccaaacaagtaaaaggaagataggaagtcaagaaaacactaatgtggactctgtgaagggccgattcaccatctccagagacaacgccaaagaattcagtgtatctagacaaaatgaaacagccctagaagngccgagacacggcgtagtattacngtgngagagacatgaacaacgggtnaagtaaccgggagggttgaag

SEQ ID NO: 369747 - DNA, 550 bp, Homo sapiens
  misc_feature: GZ8MTXP02G90K2.15.23.C01.1.454.CMB.2.raw
  modified_base (418)..(418): a, c, t, g, unknown or other
  modified_base (424)..(424): a, c, t, g, unknown or other
  modified_base (546)..(546): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttccttgttgctattttagaaggtgtccagtgcgaggagcagctggtggagtctgggggaggcctgggtccaggccgggggggtccctgagactctcctgtgccgcctctggactcacctttagtagctattggatgagctgggtccgccagggctccgaggggaaggggctgggagtggggtggccaaacataaaggaagatgggaaagtcaagaaaacactatgtgggactctgtagaagggccgattcaccatcnccaganacaacgccaagattcagtgtatctgacaaatgaacagcctagagagccgaggacacggcgtagtacttatggtgtgacgagacagtgaaccaacggtgaaacgttaaccgggaggggtttanaagg

SEQ ID NO: 369748 - DNA, 716 bp, Homo sapiens
  misc_feature: GZ8MTXP02JJ396.15.23.C01.1.454.CMB.2.raw
  modified_base (379)..(379): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctggagactctcctgtgccgcctctggactcacctttagtagctattggatgagctgggtccgccagggctccgaggggaaggggctgggagtgggtggccaaacataaaggaagatgggaagtcaagaaacnctatgtggactctggtgaagggggccctattccgaaaccctatccctacccgaaggacgaaccaaaccgcccaaaaggtaaactttccgaaaggttgttaaactccgttaggaacctaaaaagttgggaaaacctaaggttcccttaagggaaggaacggaccccggaaagggaacccgtaaccgggggcccgtttaaggtttaaaacgtttaaccgttgggttacggttacgggtaaacggtaacggtaaaccaaggttcggaaaaacccgtaaaaccgggggttacggtaaaaccgttaaaaaccccgggggggtgggggttttacgtaaacggg

SEQ ID NO: 369749 - DNA, 557 bp, Homo sapiens
  misc_feature: GZ8MTXP02HM1G5.15.23.C01.1.454.CMB.2.raw
  modified_base (507)..(507): a, c, t, g, unknown or other
  modified_base (555)..(555): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagtagctattggatgagctgggtccgccaggctccgaggggaaggggctgggagtggggtggccaaacagtaaaaggaagatgggaaagtcagaaaacactaatgtggactctgtagaacggggccgaattccaaccatcctaccagagacaaacgccaaagattcagtgtaatctgactaaatgaaacagcctagagagccgaggacacggcctagtacttacgngtgtgagagacagtgaacaacgggtgaagtaaccgggagggggtttanag

SEQ ID NO: 369750 - DNA, 543 bp, Homo sapiens
  misc_feature: GZ8MTXP02FSXUF.15.23.C01.1.454.CMB.2.raw
  modified_base (349)..(349): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggtttccttgttgctattttagaaggtgtccagtgcgaggagcagctggtggagtctgggggaggcctgggtccaggccgggggggtccctgagactctcctgtgccgcctctggactcacctttagagctattggatgagctggggtccgccaggctccgaggggaaggggctgggagtggggtggccaaanagtaaaaggaagatcgggaagtcaagaaacactaatgtggactctgtgaaggggcattcaccatctccagagacaacgccaaagaattcagtgtatctgacaaatgaaacagcctgagagccgaggacacgggcgtagtattacgtgtgtgacgagacagaagacgaacggtagagtaacggagggtaggtagg

SEQ ID NO: 369751 - DNA, 541 bp, Homo sapiens
  misc_feature: GZ8MTXP02I7Z19.15.23.C01.1.454.CMB.2.raw
  modified_base (414)..(414): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccaggccgggggggtccctgagactctcctgtgccgcctctggactcacctttagtagctattggatgagctggggtccgccaggctccgaggggaaggggctgggagtggggtggccaaacataaaggaagatggaagtcagaaacactatgtgggactctgtgaagggcgattcacatctcaganacaacgccaaagattcagtgtatctagacaaatgaaacagcctagagagccgaggacacgggcgtgtattactgtagtgagagacagtgaacaacgggtagaaacgtacggggtagggttagtacgg

SEQ ID NO: 369752 - DNA, 601 bp, Homo sapiens
  misc_feature: GZ8MTXP02IERIQ.15.23.C01.1.454.CMB.2.raw
  modified_base (307)..(307): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctgagctctcctgtgccgcctctggactcaccttagtagctattggatgagcgtgggtccnccgaggctccgaggggaaggggctgggaggtggggtcggaccaaacgaaagtaaaagggaagagtagggaaagtacaagaaaaccacgttaagtgtgggacttctggtaggaacgggggcccatttcccaccctatcctaccgagaagaaccaacgaccaaagtaattacagtgtaatctagaactaaatgaaaccagcctagagagccgaggaccgtacggaccgtgtacttagtgttggagacgagacagtaacgaacgaacggtgaaacgtaccggggtaggggttagagg

SEQ ID NO: 369753 - DNA, 577 bp, Homo sapiens
  misc_feature: GZ8MTXP02JWZOK.15.23.C01.1.454.CMB.2.raw
  modified_base (517)..(517): a, c, t, g, unknown or other
  modified_base (574)..(574): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagtagctattggatgagctgggtccgccaggctccgaggggaaggggctgggagtggggtggaccaaacaagtaaaagggaagatagggaagtcaagaaaacactagtggtgggacttcgtggtaggaaggggcccgattccaccatcctccgagagacaaacgccaaagaacttcagtgtatctgacaaatgaacagcctaggagacgccgaaggaccgacggcgtgtattacgngtaggtgagacgacagtcggaactaacgggtgaaacggtaaccgggtagggggttanagg

SEQ ID NO: 369754 - DNA, 552 bp, Homo sapiens
  misc_feature: GZ8MTXP02JOXXK.15.23.C01.1.454.CMB.2.raw
  modified_base (350)..(350): a, c, t, g, unknown or other
  modified_base (380)..(380): a, c, t, g, unknown or other
  modified_base (385)..(385): a, c, t, g, unknown or other
  modified_base (391)..(391): a, c, t, g, unknown or other
  modified_base (411)..(411): a, c, t, g, unknown or other
  modified_base (434)..(434): a, c, t, g, unknown or other
  modified_base (446)..(446): a, c, t, g, unknown or other
  modified_base (451)..(451): a, c, t, g, unknown or other
  modified_base (509)..(509): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttccgtgtaggctatttagtaaggtgtccagtgcgaggagcagctggtggagtctggggggaggcctgggtccaggccgggggggtccctgagactctcctgtgccgcctctggactcacctttagtagctattggatgagctgggtccgccaggctccgaggggaaggggctgggagtggggtggccaaanaataaaagggagatggggaatcaagaaacntatgnggactngtgaagggcattcaccatcncagagacaacgcctaaagaatanagtagtatctanacaanagacagacgagagacgacgacgaacgacgacgtacgtacgtagtgtagtagagacganagtaagacgaacggtacgtacggtaacgggtacgggtaggtag

SEQ ID NO: 369755 - DNA, 560 bp, Homo sapiens
  misc_feature: GZ8MTXP02HPKLM.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccggggggtccctgagactctcctgtgccgcctctggactcacctttagtagctattggatgagctgggtccgccaggctccgaggggaaggggctgggagtggggtggccaaacagtaaaaggaagatgggaaagtcaagaaaacactatgtggactctgtagaaggggccgattccaccatcctccaagagaacaacgccaaagaattcagtgtatctgacaaatgaaacagcctgagagccggaggacgacggccgtgtacttacgtgtgtgagagacagtaagaacgaaacggtgaacgtaaccggggtaggggtttagagg

SEQ ID NO: 369756 - DNA, 538 bp, Homo sapiens
  misc_feature: GZ8MTXP02I5JJ2.15.23.C01.1.454.CMB.2.raw
  modified_base (343)..(343): a, c, t, g, unknown or other
  modified_base (407)..(407): a, c, t, g, unknown or other
  modified_base (458)..(458): a, c, t, g, unknown or other
  modified_base (502)..(502): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttctgtagctatttagaaggtgtccagtgcgaggagcagctggtggagtcgtgggggaggcctgggtccaggccgggggggtccctgagactctcctgtgcccgcctctggactcacctttagtagctattggatgagctgggtccgccaggctccgaggggaggggctggagtgggtgccaaanataaaggaagatggaaagtcaagaaacactatgtggactctgtgaagggccgattcaccatccnccagagacaaacgccaaagtacttcagtgtatctgacaaatgacagaccgngagagacgaggacgacggccgtcgtagtactgtgtagagagaanagaagacgaacgtacgacgtacggtagggtaggtag

SEQ ID NO: 369757 - DNA, 584 bp, Homo sapiens
  misc_feature: GZ8MTXP02GINU4.15.23.C01.1.454.CMB.2.raw
  modified_base (377)..(377): a, c, t, g, unknown or other
  modified_base (403)..(403): a, c, t, g, unknown or other
  modified_base (407)..(407): a, c, t, g, unknown or other
  modified_base (459)..(459): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccgggggggtccctggagactctcctgtgccgcctctggactcacctttagtagctattggatgagctgggtccgccaggctccgaggggaggggctggagtgggtgcaacataaaggagatggaagtcagaaacactatgnggactctgtagaagggcgattcaccntccncagacgacaacgccaaagtaacttcagtgtaatctagacaaaagtcgaaacngacctaggagacggtccgaaggaccgacggggtcctaggtactttagtggttaggagaggaacgacaagtaacggaaacgtaacggggtagaacggtaaaaccgggggtgggggtttagtaaggg

SEQ ID NO: 369758 - DNA, 703 bp, Homo sapiens
  misc_feature: GZ8MTXP02JOKZ1.15.23.C01.1.454.CMB.2.raw
  modified_base (667)..(667): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctgagactctcctgtgccgcctctggactcacctttagtagctattggatgagcgtgggtccgccaggctccgaggggaaggggctgggagtggggtgaccaaacgaagtaaaaggaaagatagggaaagtacaagaaaacactaagtggtggactcgtggtaggaaaggggcccgtagttcccaaccctataccctacccgaaggaacgaacccgaaaccggacccaaaaggtaaactttccgaaagttggtaaatccgttaggaacctaaaaagttcggaaaaccgtagaaccccgttgggaaacggacggacccggaaagggtaaccgaccggggaccccgttacggttaaagtttaccgtggttaggtaacggacggtaaaggaaccaagtaacggaaaaccgtaaacgggggttanaaaacggtaacccgggggtaaggggtttacggaagg

SEQ ID NO: 369759 - DNA, 544 bp, Homo sapiens
  misc_feature: GZ8MTXP02JWIJT.15.23.C01.1.454.CMB.2.raw
  modified_base (273)..(273): a, c, t, g, unknown or other
  modified_base (376)..(376): a, c, t, g, unknown or other
  modified_base (384)..(384): a, c, t, g, unknown or other
  modified_base (443)..(443): a, c, t, g, unknown or other
  modified_base (446)..(446): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttcgtgtaggctattttagaaggtgtcagtgcgaggagcagctggtggagtcgtgggggaggcctggtccaggccgggggggtccctgagctctcctgtgccgcctctggactcncctttagagctattggatgagctgggtccgccaggctccgaggggaaggggctgggaggtgggtggcgaacataaaggaagagtaggagtacagaaacactangtggactntgtgaggcggatacacactctcacgagacaacgaccaacgaattacagtagtatctganaanagacgacgcgagagacgacggacgacgacgacgtacgtagtagtcgtgtagagacgagagtaacgacgaacggtacgacgtaacggtacgggtaggtg

SEQ ID NO: 369760 - DNA, 616 bp, Homo sapiens
  misc_feature: GZ8MTXP02J1SIW.15.23.C01.1.454.CMB.2.raw
  modified_base (549)..(549): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggcccgggggggtccctgagactctcctgtgccgcctctggactcacctttagtagctattggatgagctgggtccgccaggctccgaggggaggggctgggagtgggtggccaacagtaaaaggagatggaagtcaagaaaacactatggtgggactctgtgaaggggccgaatttccaaccctaatcctacccgaagacggaaccaaacggcccaaaaggaaactttcgaggttgtaatctgaccaaaatggaaaccaggccctaggaacgacggacccggaaggtaccgaaccggggccgttagtaaacgttacnggtgtaggaacgagaaccgagtcgaacgaaccgggtgaaacggtaaccggggtaggggtttacgagg

SEQ ID NO: 369761 - DNA, 609 bp, Homo sapiens
  misc_feature: GZ8MTXP02JRS6I.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctgagactctcctgtgccgcctctggactcacctttagtagctattggatgagcgtgggtccgccaggcctccgaggggaacggggctggggaggtggggtcggaccaaacgaagtaaaaggaagatagggaaagtcaagaaaactacgtatgtgggaccttgtaggtaggaacggggcccgtagttccacccaatcctacccgaagacgaacaaaccgccaaagaattcagtagtatctagacaaatagaacagacctaggacgacggaccgaacggaccgacgggtccgttagtacgttacgtggtagtagagacgtacagtgaacgaacgggtagaacgtaaccgggtaggggtagtagg

SEQ ID NO: 369762 - DNA, 574 bp, Homo sapiens
  misc_feature: GZ8MTXP02IZXW2.15.23.C01.1.454.CMB.2.raw
  modified_base (438)..(438): a, c, t, g, unknown or other
  modified_base (457)..(457): a, c, t, g, unknown or other
  modified_base (571)..(571): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctggggttttccttgttgctattttagaaggtgtccagtgcgaggagcagctggtggagtctggggggaggcctggtccaggccgggggggtccctgagactctcctgtgccgcctctggactcacctttagtagctattggatgagctgggtccgcaggctccaggggaggggctggagtgggtgccaacataaaggaagatggaagtcaagaaaacactatgtggactcgtgtgaaggggccgaattcaaccatctccagagacaacgcccaaagattcagttntatctagacaaatgaaacngccgtagagacgaccggaggaccgtacggccgtagtacttacgtggtagtagacggaacgacaagtaacgaaaccgtaagggtacgaacggttaaaccgggggtaggggtttanagg

SEQ ID NO: 369763 - DNA, 559 bp, Homo sapiens
  misc_feature: GZ8MTXP02H0GLH.15.23.C01.1.454.CMB.2.raw
  modified_base (459)..(459): a, c, t, g, unknown or other
  modified_base (481)..(481): a, c, t, g, unknown or other
  modified_base (513)..(513): a, c, t, g, unknown or other
  modified_base (527)..(527): a, c, t, g, unknown or other
tcagtctacgtagccacgaccggtgctcgatttagtacacgtgattagggattgggaggtctcagagaggagcccttagccctggactccaaggcctttccacttggtgatcagcactgagcacagaggactcaccatggagttggggctgagcgtgggttttcctgttgctattttagaaggtgtccagtgcgaggagcagctggtggagtcgtgggggaggcctggtccaggccgggggggtccctgagactctcctgtgccgcctctggactcacctttagtagctattggatgagctgggtccgcaggctccgaggggagggctggaggtgggtgccaaacataaaggagataggaagtcaagaaacatagtgtgggacttcgtaggtaggaacggggccctattaccaccctattcccaccaggacgaaccaaacgccctaaagaacttcagtntaattcagacaaaatcgaaacngcagagcgacgagacgacggtctagtattagngtagagacgacganagaagacgaacgacgagtacggtaggtagtag

SEQ ID NO: 369764 - DNA, 589 bp, Homo sapiens
  misc_feature: GZ8MTXP02GAV5O.15.23.C01.1.454.CMB.2.raw
  modified_base (526)..(526): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctgagactctcctgtcgccgcctctggactcacctttagtagctattggatgagctgggtccgcaggctccgaggggaggggctgggagtggggtggccaaacgagtaaaaggaagatagggaaagtcaagaaaacacgtatggtggactcgtgtaggaaggggccgaattccaacccattcctacccaagacgaaccaaacgcccaaagtaacttcaagttgtaatctagacaaatgaaacagcctagagagccgaggacacggccgtagtacttacgngtagtagagaacgcaagtggaaacgaacggggtgaacgttaaaccggggagggggttataagg

SEQ ID NO: 369765 - DNA, 580 bp, Homo sapiens
  misc_feature: GZ8MTXP02HF865.15.23.C01.1.454.CMB.2.raw
  modified_base (530)..(530): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctcctgtgcccgcctctggactcacctttagtagctattggatgagcgtgggtccgccaggcctccgaggggaaggggctgggaggtggggtggccaaacaagtaaaagggaagagtagggaaagtcgaagaaaacactaagtggtggacttcgtggtaggaaaggggcccgaattcccaacctatccctaccagacgaaccaacgccaaagattcagtgtatctgactaaaatgaacagcctagagacgccgaggaccacgggccgtagtaattcngtgtgagtacgacatgaacgaacggtgaaagtaccggggagggttagtag

SEQ ID NO: 369766 - DNA, 617 bp, Homo sapiens
  misc_feature: GZ8MTXP02G5HLU.15.23.C01.1.454.CMB.2.raw
  modified_base (347)..(347): a, c, t, g, unknown or other
  modified_base (376)..(376): a, c, t, g, unknown or other
  modified_base (572)..(572): a, c, t, g, unknown or other
  modified_base (613)..(613): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggcccggggggtccctgagactctcctgtcgccgcctctggactcacctttagtagctattggatgagctgggtccgccaggctccgaggggagggctggagtgggtggccaaanagtaaaggaagatgggaatcaagaaaacnctaatggtgggactcgtggtaggaacgggggcccgtaaatttcccaaaccctattccctacccgaaggaacgaacccaaaccggcccaaaagtaactttcgagttgtaatcgtagacaaaagtcgaaacagccctaggaacgacgaccggaaggtaccgacgggtccgttaggtaacttcgtggttgagagacganagtgaacgtaaacgggtgaacgtaaaccggggtggggttanaagg

SEQ ID NO: 369767 - DNA, 687 bp, Homo sapiens
  misc_feature: GZ8MTXP02F812Y.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgccgcctctggactcacctttagtagctattggatgagctgggtccgccaggctccgaggggaaggggctgggaggtggggtggccaaacgagtaaaaggaagagtaggaagtcaagaaacactatgtgggactcgtggtagaacggggcccgattccaaccctattccctacccgaaggacgaaccgaaaccgcccaaaaggaaactttaccgaaggttagttaaacttccgtaggaacctaaaaacgttaggaaaaccgagaccccgtagggaacggacggacccggaaagggacccgaacggggtcccgttaggttaactttaccgttggttacggttaggaacgaaacgaccgtaagtaacggaaaccgaaaacggggttaggaaaccggtttaaaacccgggggagggggtttacgtaagggg

SEQ ID NO: 369768 - DNA, 570 bp, Homo sapiens
  misc_feature: GZ8MTXP02GLS9Q.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgccgcctctggactcacctttagtagctattggatgagcgtgggtccgccaggctccgaggggaaggggctgggaggtggggtcggccaaacaagtaaaaggaagatggaagtcaagaaaacactatgtggactcgtgtagaaggggccgattccaccatcctccagacgacaacgccaaagaacttcagtgtatctagacaaagtgaaacagcctagacgacgaccgaggaccgacggcgtagtacttacgtgtgtagagagactaagtgaaacgtaacgggtgaaacgtaaccgggaggggtttagagg

SEQ ID NO: 369769 - DNA, 544 bp, Homo sapiens
  misc_feature: GZ8MTXP02HVP7X.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccagccgggggggtccctgagactctcctgtgccgcctctggactcacctttagtagctattggatgagctgggtccgccaggctccgaggggaaggggctgggagtggggtggccaaacataaaaggagatggaagtcaagaaaacactatgtggactctgtgaaggggccattcacatctcagagacacgccaaagaattcagtgtatctgacaaatgaaacagcctagagacgccggaggaccacgggccgtagtattacgtgtgtagagagacagtgaacaacgggtgaacgtaaccgggaggggtttagagg

SEQ ID NO: 369770 - DNA, 555 bp, Homo sapiens
  misc_feature: GZ8MTXP02IBL5S.15.23.C01.1.454.CMB.2.raw
  modified_base (449)..(449): a, c, t, g, unknown or other
  modified_base (475)..(475): a, c, t, g, unknown or other
  modified_base (501)..(501): a, c, t, g, unknown or other
  modified_base (506)..(506): a, c, t, g, unknown or other
  modified_base (516)..(516): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggttttcgtgttaggctattttagaaggtgtccagtgcgaggagcagctggtggagtctgggggaggcctggtccaggccgggggggtccctgagactctcctgtgccgcctctggactcacctttagtagctattggatgagctgggtccgccaggctccgaggggaaggggctgggagtggggtggccaaacaagtaaaagggaagagtggaagtcagaaaacactatgtggacttctaggtgaagggccgaattcacccatcctccagagacaacgccaaagaattcagtntatctgacaaatgaacagcctagagngccgaggacacgggcgtgtacttagngttgngacgacgaanagaagacgaacggtacgacggtacggtacgggtaggtag

SEQ ID NO: 369771 - DNA, 600 bp, Homo sapiens
  misc_feature: GZ8MTXP02IW6QY.15.23.C01.1.454.CMB.2.raw
  modified_base (492)..(492): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggcccgggggggtccctgagactctcctgtgccgcctctggactcacctttagtagctattggatgagctgggtccgccaggctccgaggggaaggggctggagtggggtggccaaacataaaggaagatgggaaagtcaagaaaacactaagtgtgggacttctggtagaaacgggggcccaatttccgaaaccctattccctacccgagaacggaaccaaacggcccaaaagaacttcagtgtaaatctagactaaanagaacacgccagacgacgccggaaggaccgacggccgtagtacttcgtgtagtacgagacgacagtaagaacgtaacggtacgaacgtaaccggggtaggggttacag

SEQ ID NO: 369772 - DNA, 552 bp, Homo sapiens
  misc_feature: GZ8MTXP02HB1U3.15.23.C01.1.454.CMB.2.raw
  modified_base (424)..(424): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgccgcctctggactcacctttagtagctattggatgagctgggtccgccaggctccgaggggaggggctgggagtggggtcggccaacagtaaaggaagatggaagtcaagaaacactaagtgtgggactctggtgaaggggccgattccaccatcctaccaganacaacgccaagaattcagtgtatctgacaaatgaacagcctgacgagccgaggacacgggccgtagtacttacgtgtagtgagagacagtgaacgaacggtagaacgtaaccgggaggggtttagagg

SEQ ID NO: 369773 - DNA, 557 bp, Homo sapiens
  misc_feature: GZ8MTXP02HU530.15.23.C01.1.454.CMB.2.raw
  modified_base (418)..(418): a, c, t, g, unknown or other
  modified_base (554)..(554): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctatttttagaaggtgtccagtgcgaggagcagctggtggagtcgtgggggaggcctggtccaggccgggggggtccctgagactctcctgtgccgcctctggactcacctttagtagctattggatgagctgggtccgccaggctccaggggaaggggctgggagtggggtggccaaacaagtaaaaggaagataggaaagtcaagaaaacactaatgtggactctgtgaagggccgattcaccatcnccagagaacaacgccaaagaattcagtgtatctgacaaaatgaaacagcctagagacgccgaggacacggccgtagtattactgtgtgagagaacataagacaaacgggtgaaacgttaaccgggagggggtttanagg

SEQ ID NO: 369774 - DNA, 560 bp, Homo sapiens
  misc_feature: GZ8MTXP02F3E3X.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctggagactctcctgtgcccgcctctggactcacctttagtagctattggatgagctgggtccgccaggctccgaggggaaggggctgggagtggggtggccaaacagtaaaaggaagagtgggaaagtcaagaaaacactaatgtggactctagtagaagggccgattcaacccatctaccagagacaacgccaaagaattcagtgtatctgacaaatgaaacagcctagagagaccggagaccgacgggcctagtacttacgtgtagtgagagacataagacgaacggagagtaacggtacgggtaggtagg

SEQ ID NO: 369775 - DNA, 614 bp, Homo sapiens
  misc_feature: GZ8MTXP02HQBK9.15.23.C01.1.454.CMB.2.raw
  modified_base (306)..(306): a, c, t, g, unknown or other
  modified_base (512)..(512): a, c, t, g, unknown or other
  modified_base (558)..(558): a, c, t, g, unknown or other
  modified_base (603)..(603): a, c, t, g, unknown or other
  modified_base (612)..(612): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgccgcctctggactcacctttagtagctattggatgagctgggtccnccgaggctccgaggggaaggggctgggaggtggggtcggaccaaacgaagtaaaagggaagagtagggaaagtcaagaaaacactaagtgtgggaacttcgtggtagaaaggggccctaagtttcccaccctatccctacccgaggaagaccaaaccggcccaaaagtaacttcaggttcgtaattctagacaaaagtcgaaaacngacctggaagacggaccgagggaaccacgggccttagtatttacgngtcgtgagacgacagtaacgacaaacggtgaacggttaaccgggnggggtttangg

SEQ ID NO: 369776 - DNA, 755 bp, Homo sapiens
  misc_feature: GZ8MTXP02F7EYZ.15.23.C01.1.454.CMB.2.raw
  modified_base (546)..(546): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgtgaggagcagctggtggagtcgtgggggaggcctgggtccaggccggggggtccctgagactctcctgtgccgcctctggactcacctttagagctattggatgagcgtgggtccgccaggctccgaggggaaggggctgggaggtggggtggaccaaacaagtaaaaggaagagtagggaaagtcaagaaaaccactaagtggtgggactcgtaggtaggaaacggggcccgtaattcccaaaccctaagttccctacccgaaaggacgaaacccgtaaaaccggccctaaaaaggtaaactttccgaaagttggttaaacttccgtaggaacctaaaagttcgaaaaacccgnggtacccctagggaaacggacgggaccccggaaggggaacccgtaccgggggtacccgtttagggttaacctttttaaccgggtgggtttacgggtaacgggaaacggtaaacggaaccgtaaggttaaccgggaaaacccggtaaaacgggggttaacggtaaaaccggggttaaaacccggggggttagggggtttaacggtaacgg

SEQ ID NO: 369777 - DNA, 616 bp, Homo sapiens
  misc_feature: GZ8MTXP02H2X3B.15.23.C01.1.454.CMB.2.raw
  modified_base (614)..(614): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgccgcctctggactcacctttagtagctattggatgagcgtgggtccgccaggctccgaggggaaggggcgtgggaggtggggtcggaccaacaagtaaaggaagagtaggaagtcaagaaacactagtgtggacttcgtggtagaacgggggccgtattcccacctatccctacccgaagacgaacctaaaccgccaaagtaacttcgaagttgtaatcgtagaactaaaagtgaaaacgcgaccgtaggaacggacggaccggaaggtaccgacgggtccgtagttactttagtgtgtagagacgacagtcggaaacgtaacgggtgaaacggtaaccggggtgggtttaagngg

SEQ ID NO: 369778 - DNA, 637 bp, Homo sapiens
  misc_feature: GZ8MTXP02H3RKK.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccgggggggtccctggagactctcctgtgccgcctctggactctaccttagtagctagttggatgagcgtcggggtccgccgaggcctccgaggggaaggggctggggaggtggggtcggaccaaacgaaagtaaaagggaagaagtagggaaagtacaaggaaacactatggtgactctggtagaaaggggtcccgtaattccaaccctatcctacccgaagaacgaaccaaacgacccaaagtaacttcagttagatctagactaaagtagaaacacgcctaggacgacggccggaacggtacgacccgggaccgttagtaaactttcgtgtaggtacgaagacgactagtaacgaacgtaacgggtagaacgttaacccgggggaggggtttacgaagg

SEQ ID NO: 369779 - DNA, 541 bp, Homo sapiens
  misc_feature: GZ8MTXP02GAM6R.15.23.C01.1.454.CMB.2.raw
  modified_base (422)..(422): a, c, t, g, unknown or other
  modified_base (501)..(501): a, c, t, g, unknown or other
  modified_base (532)..(532): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgccgcctctggactcacctttagtagctattggatgagctgggtccgcaggctccgaggggaaggggctgggagtggggtggccaaacagtaaaaggaagatgggaaagtcaagaaaacactaatgtggactctgtagaagggccgattccacatcctcaganacacgccaaagaatcagtgtatctgacaaatgaaacagcctagagagccggaggacacgggccgtagtatacgtgtgtnagacgacatcgacaacggtgacgtaacgggngggttgagg

SEQ ID NO: 369780 - DNA, 567 bp, Homo sapiens
  misc_feature: GZ8MTXP02H0QW1.15.23.C01.1.454.CMB.2.raw
  modified_base (349)..(349): a, c, t, g, unknown or other
  modified_base (557)..(557): a, c, t, g, unknown or other
  modified_base (564)..(564): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagtagctattggatgagctgggtccgccaggctccgaggggaaggggctgggaggtgggtggccaaanagtaaaaggaagatggaaagtcaataaaacactaatgtgggacttctgtaggaaagggccgaattccaaccatcctccaagacgacaaacgccaaagaattcagttgtatctgactaaagtgaaacagcctaggagacgcccggaaggacacgggccgtaggtacttactgtgtgagacgacagtgacaacggtgaacgtaaccgggngggttanagg

SEQ ID NO: 369781 - DNA, 573 bp, Homo sapiens
  misc_feature: GZ8MTXP02JK2VV.15.23.C01.1.454.CMB.2.raw
  modified_base (429)..(429): a, c, t, g, unknown or other
  modified_base (477)..(477): a, c, t, g, unknown or other
  modified_base (513)..(513): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtgggtccgaggcccgggggggtccctggagactctcctgtcgccgcctctggactcacctttagtagctattggatgagctgggtccgccaggctccgaggggaaggggctgggaggtggggtggaccaaacaagtaaaggaaagagtagggaaagtcaagaaaacactaatgtggactctggtagaagggccattcaccatcncagacaacaacgccaaagaacttcagtgtatctagactaaatgaaacngccctgagacgccgagacacgaccgtgtacttctgngtagagagtacagtaacgaacgaaacggttgaaacgtaaccggggtaggggttagtaagg

SEQ ID NO: 369782 - DNA, 543 bp, Homo sapiens
  misc_feature: GZ8MTXP02I2V58.15.23.C01.1.454.CMB.2.raw
  modified_base (410)..(410): a, c, t, g, unknown or other
  modified_base (416)..(416): a, c, t, g, unknown or other
  modified_base (515)..(515): a, c, t, g, unknown or other
  modified_base (531)..(531): a, c, t, g, unknown or other
  modified_base (540)..(540): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctgggtccaggccgggggggtccctgagactctcctgtgccgcctctggactcacctttagtagctattggatgagctgggtccgccaggctccgaggggaaggggctgggagtggggtggccaaacagtaaaggagatggaagtcaagaaacactatgtggactctgtgaaggggccatcaccatcnccaganacaacgccaaagaattcagtgtatctgacaaatgaaacagcctgagacgccgaggacacggctagtatactggtagtgagacacatcgaacgtaacggngaacgtaaaccggggnggggtttanagg

SEQ ID NO: 369783 - DNA, 549 bp, Homo sapiens
  misc_feature: GZ8MTXP02IQWLY.15.23.C01.1.454.CMB.2.raw
  modified_base (546)..(546): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccaggccggggggtccctgagactctcctgtgcccgcctctggactcacctttagtagctattggatgagctgggtccgccaggctccgaggggaaggggctgggaggtggggtggccaaacagtaaaaggaagatagggaaagtcaagaaaacactaatgtgggacttctggtgaaggggccgattcaccatctcagagacaaacgccaaagaattcagtgtatctgacaaatgaacagcctgagagaccgaggaccgacggccgtagtacttacgtgtgtgagagacatgacaacggtgagtaaccgggagggttanagg

SEQ ID NO: 369784 - DNA, 587 bp, Homo sapiens
  misc_feature: GZ8MTXP02GS6O9.15.23.C01.1.454.CMB.2.raw
  modified_base (310)..(310): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggcccgggggggtccctggagactctcctgtgccgcctctggactcacctttagtagctattggatgagctgggtccnccaggctccgaggggaggggctggagtgggtggccaaacgataaaggaagatagggaagtcaagaaacactaatgtgggactcgtggtgaaggggccgaattccaaccatcctccaagagaccaaacgccaaagtaacttcagtgtaatcctagactaaaatcgaaacacgaccgtagaacggacggaacccggagggaaccgacgggcccggtagtaattacgtagtgtagagagacagtgacgaaacggtgaacgtaacgggaggggtttagagg

SEQ ID NO: 369785 - DNA, 558 bp, Homo sapiens
  misc_feature: GZ8MTXP02GRG2V.15.23.C01.1.454.CMB.2.raw
  modified_base (502)..(502): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccaggccgggggggtccctgagactctcctgtgccgcctctggactcacctttagagctattggatgagctgggtccgccagggctccgaggggaaggggctggagtggggtggccaaacagtaaaaggaagatagggaagtcagaaaacactaatgtggactctggtgaaaggggccattcaccatctccagagacaacgccaaagaattcagtgtaatctagacaaatcgaaacagccctagagagccgaaggtacacggcctagtacttacngtgtggagtagaacagtgaacgaacggtgaacgtaaccggggaggggtttacaagg

SEQ ID NO: 369786 - DNA, 564 bp, Homo sapiens
  misc_feature: GZ8MTXP02HP0BO.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccaggccgggggggtccctgagactctcctgtgccgcctctggactcacctttagtagctattggatgagctgggtccgccaggctccgaggggaaggggctgggagtggggtggccaaacaagtaaaaggaagatagggaaagtcaagaaaacactatgtggactctgtgaaaggggccattccacatctccaagagacaaacgaccaagaacttcagtgtatctgacaaatgaacagacctgaagagccgaggacgacggccgtagtacttacgtgtgtgagagtacgataaggaacgaaacgggtgaaacgtaaccgggagggggtttagaagg

SEQ ID NO: 369787 - DNA, 583 bp, Homo sapiens
  misc_feature: GZ8MTXP02F9KNW.15.23.C01.1.454.CMB.2.raw
  modified_base (311)..(311): a, c, t, g, unknown or other
  modified_base (479)..(479): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttccttgttgctattttagaaggtgtccagtgcgaggagcagctggtggagtcgtgggggaggcctgggtccaggcccggggggtccctggagactctcctgtcgccgcctctggactcacctttagtagctattggatgagctgggtccncaggctccgaggggaggctgggagtggggtgccaaacgagtaaaaggaagataggaaagtcaagaaaacactatgtgggactcgtgtaggaacgggccgattccacctatcctaccgagacgaacaacgccaaagtaattcaagtgtaatcgtagacaaatcgaaacngcctaggacgacgaccgaggaccgtcggccgttagtattactggtagtagaagtacgacagtaacgaacctaacggtagaacgtaaaccgggtaggggtatagg

SEQ ID NO: 369788 - DNA, 790 bp, Homo sapiens
  misc_feature: GZ8MTXP02FW7BN.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgccgcctctggactcaccttagagctattggatgagctgggtccgccaggctccgaggggaaggggctgggagtggggtcggaccaaacgaagtaaaaggaaagagtaggggaaagtccaaaggaaaacactaagtggtgggaactcgttaggtaggaaacgggggtcccgaaatttccaaaccctaattccctacccgaaaggaacgaaacccgaaaacccggaccctaaaaaggaaaacttttccgaaaaggttgttaaacttccgtaggaacctaaaaagttacgggaaaaacccaggaccccgttaggaaagggaacggaacccccggaaaggggaaacccgttaacccgggggccccggtttaagggtttaaaacgtttttaaacccgtggggttacgggttacggtaaaacgggaaaacggacttaaacggtaaacggtaaaaccggaaaaacccggggttaaacggggtaaaacgggttaaaacccgggggtaaaacggggggtttaacggggtttaaacgggg

SEQ ID NO: 369789 - DNA, 542 bp, Homo sapiens
  misc_feature: GZ8MTXP02HJ172.15.23.C01.1.454.CMB.2.raw
  modified_base (415)..(415): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagtagctattggatgagctggtccgccaggctccagggaaggggctggagtgggtggccaaacaataaaaggaagatggaaagtcaagaaacactatgtggactctgtgaagggccgattcaccatcctcaganacaacgcaaagattcagtgtatctgacaaatgaaacagcctgagagccgaggacacggcctagtattacgtgtgtagagacgacagtcgaacgtaacgggtgaacgtaaccggggagggtttcgaag

SEQ ID NO: 369790 - DNA, 535 bp, Homo sapiens
  misc_feature: GZ8MTXP02JZRMB.15.23.C01.1.454.CMB.2.raw
  modified_base (375)..(375): a, c, t, g, unknown or other
  modified_base (380)..(380): a, c, t, g, unknown or other
  modified_base (386)..(386): a, c, t, g, unknown or other
  modified_base (405)..(405): a, c, t, g, unknown or other
  modified_base (481)..(481): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagtagctattggatgagctgggtccgccaggctccgaggggaaggggctgggagtggggtggccaaagataaaaggagatggaagtcagaaacntatgnggactngtgaagggcatcaccatcncagacgacaacgccaaagaattcagtgtatctagacaaatgaaacagcctgagagccgagacacggctagtatacngtgagacgagacagtgaacgaacgggtgaacgtaaccggggaggggtttagagg

SEQ ID NO: 369791 - DNA, 579 bp, Homo sapiens
  misc_feature: GZ8MTXP02JPAW9.15.23.C01.1.454.CMB.2.raw
  modified_base (352)..(352): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggggggaggccgtggtccgaggcccgggggggtccctgagactctcctgtgccgcctctggactcacctttagtagctattggatgagctgggtccgcaggctccgaggggaaggggctgggagtggggtggccaaanagtaaaaggaagataggaagtcaagaaacatatgtggactcgtgtagaaggggccgaattccaaccgatcctacccaagacgaaccaaacgccaaaagtaacttcaagttgtaatctagacaaaatgaaaccagcctagagacgaccgaggacacgggccgtagtaacttgtggtgtagacgagacagtgaaccgaacgggtgaagtaaccggggagggtttgaagg

SEQ ID NO: 369792 - DNA, 604 bp, Homo sapiens
  misc_feature: GZ8MTXP02HWE0Z.15.23.C01.1.454.CMB.2.raw
  modified_base (269)..(269): a, c, t, g, unknown or other
  modified_base (351)..(351): a, c, t, g, unknown or other
  modified_base (383)..(383): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctcctgtgccgcctcnggactcacctttagtagctattggatgagctgggtcccgcgaggctccgaggggaaggggctgggaggtgggtggaccaaanaagtaaaaggaagataggaagtcaagaaaacntatgtggactctggtgaaggggccattccacatcaccagacgaacaacgaccaaagtaacttacagtagtaacttctagactaaaatcgaaacacgaccagaacggacgccggaaggaccgaaccgggccgttagtaacttacgtgttaggtagaacgaagacgaagtaagaaacgaacggggttagaaacggttaaaccgggggtaggggtttacgaagg

SEQ ID NO: 369793 - DNA, 560 bp, Homo sapiens
  misc_feature: GZ8MTXP02FPTA6.15.23.C01.1.454.CMB.2.raw
  modified_base (521)..(521): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagagctattggatgagctgggtccgccaggctccgaggggaagggctggagtggggtggccaaacgataaaggaagatggaagtcaagaaacactatgtgggactcgtgtagaaggggcccgaattcaacccatcctccaagagaacaaacgccaaagaattcaagtgtaatctagacaaaatgaaacagcctagacgagccgaggaccacggccgtagtattacgtgtgtagagacganataagacgaacggtacgtagtaacggacggggtaggtag

SEQ ID NO: 369794 - DNA, 590 bp, Homo sapiens
  misc_feature: GZ8MTXP02H30T2.15.23.C01.1.454.CMB.2.raw
  modified_base (354)..(354): a, c, t, g, unknown or other
  modified_base (562)..(562): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccgggggggtccctgagactctcctgtgccgcctctggactcacctttagtagctattggatgagctggggtccgccaggcctccgaggggaaggggctgggaggtggggtggaccaaanagtaaaaggaagatcgggaagtcaagaaacactaatggtggacttctgtagaaaggggcccgatttccaccatctccagagaccaacgaccaaagtaatcagtagtatctagactaaatagaaacgagacctaggagacggccgaaggaccgacggcccgttaaaagtcgtttacgtgtggtagacgagacagtaagaacgtaacggngtaacgtaacggggtaggggttagtagg

SEQ ID NO: 369795 - DNA, 655 bp, Homo sapiens
  misc_feature: GZ8MTXP02G87NF.15.23.C01.1.454.CMB.2.raw
  modified_base (288)..(288): a, c, t, g, unknown or other
  modified_base (311)..(311): a, c, t, g, unknown or other
  modified_base (646)..(646): a, c, t, g, unknown or other
  modified_base (653)..(653): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctcctgtcgccgcctcgtggactcacctttagtanctattggatgagcgtcgggtccnccgaggcctccggaaggggaacggggcgtgggaggtggggtcggaccaaacgaaagtaaaaggaagagtagggaaagtacgaaagaaaacacgttaagtggtacgggaccttacgttggtacgggaacgggggtcccgtaatttacccaaaccctattcccgtacccgaaggaaacgaaacccgaaacgtaccccgaaaaagtaactttccgaaagttgtaaactcgtagaactaaagtcgaaacagcctaggagacgaccggaaggtacccacgggccgttagtacttactggtgacgacgagacagaagacgaaaggtcgaaacgtaacgggngggttanag

SEQ ID NO: 369796 - DNA, 605 bp, Homo sapiens
  misc_feature: GZ8MTXP02G5SFW.15.23.C01.1.454.CMB.2.raw
  modified_base (446)..(446): a, c, t, g, unknown or other
  modified_base (488)..(488): a, c, t, g, unknown or other
  modified_base (500)..(500): a, c, t, g, unknown or other
  modified_base (507)..(507): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctgagactctcctgtcgccgcctctggactctacctttagtagctattggatgagcgtgggtcccgccaggcctaccgaaggggaaggggctgggaggtggggtcggacccaaacgaagtaaaagggaagagtagggaaagtcaaggaaaacacttaatggtcgggactcgtggtaggaacggggccgtattccaacctntccctaccgaagacgaacaaacgccaaagtaattcagtgtanctgaacaaagtnaaaccgngaccgagacgacggaccggagacgaccggtcgttagtactagtggtagagagacgacaagaacgaacgaaggtacgaacgtaacggggtaggtagtag

SEQ ID NO: 369797 - DNA, 574 bp, Homo sapiens
  misc_feature: GZ8MTXP02H3AEZ.15.23.C01.1.454.CMB.2.raw
  modified_base (383)..(383): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctgggtggagtcgtgggggaggcctggtccgaggcccgggggggtccctggagactctcctgtcgccgcctctggactcacctttagtagctattggatgagctgggtccgccaggctccgaggggaggggctgggagtggggtggccaaagagtaaaaggaagatggaagtcaagaaaacnctaagtgtgggactcgtggtagaacggggcccgattccacctatcgtcccaagacgacaaacgaccaagaattcagtgtatctagactaaatgaacagcctagagacgcgaaggacgacggccgtagtattacgtgtgtagagacgacagtaacgaacgaacgggtgaacgtaccggggagggtttagagg

SEQ ID NO: 369798 - DNA, 721 bp, Homo sapiens
  misc_feature: GZ8MTXP02F7AYX.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccggggggtccctgagactctcctgtgccgcctctggactcacctttagagctattggatgagctgggtcccgcaggctccgagggaggggctgggagtggggtgccaaacagtaaaaggaagagtagggaaagtacaagaaaactactaagtggtgggactcgtaggtaggaaacggggcccgaatttccgaaccctaattccctacccgaaaggaaacgaaacccgaaaacccggaccccgtaaaaaggtaaaactttcccgaaaggtttagttaaacttcccgttaaggaaacctaaaaaagttcgggaaaaaacccgacggtacccgtaagggaaacggacgggaacccggaagggaacccgtaccggggtccgttaagtttaacgtttacgtggttacggtacggaacgtaacgacgtaagtaacggaaaccggtaaacggggtacgaaacgggttaaaccgggggtagggggtttagtagg

SEQ ID NO: 369799 - DNA, 551 bp, Homo sapiens
  misc_feature: GZ8MTXP02J0UBK.15.23.C01.1.454.CMB.2.raw
  modified_base (347)..(347): a, c, t, g, unknown or other
  modified_base (379)..(379): a, c, t, g, unknown or other
  modified_base (549)..(549): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctgagactctcctgtgccgcctctggactcacctttagtagctattggatgagctgggtccgcaggctccgaggggaggggctgggagtgggtggccaaanagtaaaaggaagatagggaagtcaagaaaacnctatgtgggactctggtagaaaggggcccgtattccgaccctatcctacccaagacgacaaacgccaaagattcagtgtatctgacaaatgaacagcctgagagccgaggacacgggtcgtgtatacgtgtgtgagacgacagtgacaacgttgaacgtacggagggttnag

SEQ ID NO: 369800 - DNA, 593 bp, Homo sapiens
  misc_feature: GZ8MTXP02IDKU7.15.23.C01.1.454.CMB.2.raw
  modified_base (306)..(306): a, c, t, g, unknown or other
  modified_base (345)..(345): a, c, t, g, unknown or other
  modified_base (383)..(383): a, c, t, g, unknown or other
  modified_base (392)..(392): a, c, t, g, unknown or other
  modified_base (427)..(427): a, c, t, g, unknown or other
  modified_base (471)..(471): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggttttcgtgtagctattttagaaggtgtcagtgcgaggagcagctggtggagtcgtgggggaggcctggtccgaggccgggggggtccctgagactctcctgtgcccgcctctggactcacctttagtagctattggatgagctgggccncaggctacaggggaagggctgggagtggggtgaccaaanaagtaaaaggaagatgggaaagtcaagaaaacactaangtggacttntggtagaagggccgaattcaaccatcctacaaganaaccgaacgaccaaagaaacttcagtagtatactagaactaaanaagaacgacgacgtacgagacgacgaacggacgacgacgtacgttacgttacgttagtagtacggagacgaacgagtaacgaacgaacggtacggtaacggtaacgggtacggggtaggtag

SEQ ID NO: 369801 - DNA, 720 bp, Homo sapiens
  misc_feature: GZ8MTXP02IJFBD.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctgagactctcctgtgcccgcctctggactcacctttagtagctattggatgagctgggtccgccaggctccgaggggaggggctggagtgggtggccaacagtaaaggaagatggaaagtcaagaaacactagtgtgggactcgtggtagaagggggcccgtaatttcccgaccctatcccttacccgaaggaacgaacccaaaacggccccaaaaggtaaatttaccaaaggttgtaaattccgtagaccctaaaagttcggaaaacagggaccccttagggaaacggaacggacccccgggaaaggggtaacccgaaaccgggggtccccggtttagggtttaacgttttaaaccgtcggggtttacggttaacggacggtaaacggacctaaggttaacggaaaaccgtaaaccgggggttaggaaaacggtttaaaccccgggggtaaggggggttttacggaaacggg

SEQ ID NO: 369802 - DNA, 551 bp, Homo sapiens
  misc_feature: GZ8MTXP02I8MAY.15.23.C01.1.454.CMB.2.raw
  modified_base (459)..(459): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagtagctattggatgagctggggtccgccaggctccgaggggaaggggctgggagtggggtggccaaacataaaggaagatggaagtcaagaaacactatgtggactcgtgtgaaggggccgattcaccatcctccagagacaacgccaaagatcagtgtaatctgacaaatgaaacngacctgaagacgaccgaggacgacgggcgtgtacttactggtagtgacgagacatcgaacgaacggtgaacgtaccgggaggggttactagg

SEQ ID NO: 369803 - DNA, 565 bp, Homo sapiens
  misc_feature: GZ8MTXP02JAMBJ.15.23.C01.1.454.CMB.2.raw
  modified_base (507)..(507): a, c, t, g, unknown or other
  modified_base (552)..(552): a, c, t, g, unknown or other
  modified_base (562)..(562): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggccggggggtccctgagactctcctgtgccgcctctggactcaccttagtagctatggatgagctgggtccgccaggctccgaggggaaggggctgggagtggggtggaccaaacgaagtaaaaggaagatagggaaagtcaagaaaacactaatgtggactcgtgtagaagggccgattcaaccatcaccagagaacaacgccaaagaacttcagtgtaatctgacaaatgaaacagcctagagagcgaggtacacggccgtagtacttagnggtagtagagaagacatggaaccaaggtagaaggtaaaccggggnggggtttaanagg

SEQ ID NO: 369804 - DNA, 631 bp, Homo sapiens
  misc_feature: GZ8MTXP02IED68.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttcctgttgctattttagaaggtgtccagtgcgaggagcagctggtgggagtcgtgggggaggccgtgggtccaggcccgggggggtccctggagactctcctgtgcccgcctctggactcaccttagtagctattggatgagctgggtccgccaggctccgaggggaaggggcgtgggaggtggggtggaccaaacgaagtaaaagggaagaagtagggaaagtcgaagaaaacacttaagtgtggacttcgtggtagaaacggggcccgatttccgacctatctaccagagaaccaacgccaaagacttcgagtgtaatctagactaaatcgaaacagcctaggaacgaggcccggaaaggaccgtaacggggcccgttaggttaacgttactggtaggtacgaggacgaacaggtaacggaacgaacgggttaggaacggttaacccggggtagggggtttacgaaggg

SEQ ID NO: 369805 - DNA, 573 bp, Homo sapiens
  misc_feature: GZ8MTXP02FYS8S.15.23.C01.1.454.CMB.2.raw
  modified_base (375)..(375): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggccgggggggtccctggagactctcctgtgcccgcctctggactcacctttagagctattggatgagctgggtccgcaggctccgagggaggggctggagtgggtgccaaacagtaaaggaagataggaagtcaagaaacnctatgtggactctggtgaaggggccgattccaccatcctccaagagacaacgccaaagaattcagtgtaatctagacaaatgaaacacgaccccgagacggccgaaggaccacgggtccgtagtacttacgtgtagtagagtacgacagtagaaccgaacggtgaaacggtaaccggggaggggtttcgagttacggg

SEQ ID NO: 369806 - DNA, 549 bp, Homo sapiens
  misc_feature: GZ8MTXP02HAWKS.15.23.C01.1.454.CMB.2.raw
  modified_base (416)..(416): a, c, t, g, unknown or other
  modified_base (460)..(460): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccggggggggtccctgagactctcctgtgccgcctctggactcacctttagtagctattggatgagctgggtccgccaggctccgaggggaaggggctgggagtggggtggccaaacaagtaaagggaagatgggaagtcataaaacactatgtggactctgtgaagggccattcaccatcnccagagacaagccaaagaatcagtgtaatctgacaaatgaaacngcagagagcgagacgcggtcgtagtattgtgtagagagacgacagtaacgaacgaacgggtacgaaacggtaacggggtaggggtagag

SEQ ID NO: 369807 - DNA, 816 bp, Homo sapiens
  misc_feature: GZ8MTXP02HCVAZ.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctgggtccgaggccggggggtcctgagactctcctgtgccgcctctggactcaccttagtagctatggatgagcgtgggtccgccagggctccgaggggaaggggctgggaggtcggggtcggacccaaacgtaagtaaaacgggaagtagtacgggaaacgttaccgaagaaaacctacgttaagttacggtacgggggtaaccttacggtaggttagggtaaaaccgggggtcccgtaaagttttcccgaaacccgttaagttccccgttaacccgaaaggaaccgaaacccgtaaaccggtacccgaaaagttaacgtttaccgaaaggttcgttaaacgtccttacggggaaaccctaaaagttcggaaaaccggtacgtaaccccgttagggtaaacggaccggtaacccgggtaaagggtaacccgtaaaccgggggtccccgtttaaagggttaaaacctttacccggtggggtttaccggttaacgaaaggggtaaccgttaaccgtaaggttcgggaaaacccgtaaacggggtttacggaaaaccggtttaaacccggggggtaggggtttacgttaaacgggg

SEQ ID NO: 369808 - DNA, 655 bp, Homo sapiens
  misc_feature: GZ8MTXP02HV9VS.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgtccgaggccggggggtccctgagactctcctgtcgccgcctctggactcaccttagtagctattggatgagcgtgggtccgccaggctccggaggggaaggggctgggaggtggggtgaccaaacaagtaaaaggagataggaagtacaagaaaacactaagtggtggacttcgtaggtaggaaaggggccctaatttcccgaaccctatacccgtacccgaaggaacggaaccaaaaccgcccaaaaggtaaacttcgtaagttagtaacttccttagactaaaagtacgaaaccaggacccttagggaacggacggaccggaacggaccgtaaccggggtcgtagttaacgttacgtggtaggtagacgacgaacagtaacgaaacgaacgggtacgaacggtaaccggggtaggggtttagaacgg

SEQ ID NO: 369809 - DNA, 569 bp, Homo sapiens
  misc_feature: GZ8MTXP02HNLV5.15.23.C01.1.454.CMB.2.raw
  modified_base (401)..(401): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagtagctattggatgagctgggtccgccaggctccgaggggaaggggctgggagtggggtggaccaaacgaaagtaaaagggaagagtagggaaagtacaagaaaacactatgtggactntgtgaacgggcgattcacatctaccagagacaacgccaaagaattcagtgtatctagacaaaatgaacagcctagagacgccgagaccgacggccgtagtaactttctgtgtagagaacgtacaatcgaacgtaacggtgaaagtaaccggggagggggtttagaagg

SEQ ID NO: 369810 - DNA, 604 bp, Homo sapiens
  misc_feature: GZ8MTXP02IWX3M.15.23.C01.1.454.CMB.2.raw
  modified_base (306)..(306): a, c, t, g, unknown or other
  modified_base (420)..(420): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttcctgtgctattttagaaggtgtccagtgcgaggagcagctggtggagtcgtgggggaggcctggtccaggccgggggggtccctgagactctcctgtgccgcctctggactcacctttagtagctattggatgagctgggtccncaggctcgagggagggctgggagtgggtgccaaacagtaaaggaagatggaagtcgaagaaaacacgtaatgtgggaactcgtggtagaacggggccagttccaaccctatccncagagaacaacgcccaaagaacttcaagtgtatctgacaaagtgaaacagacctagacgaggacccgaggaaccgacgggtacccgttaggtactttaaccgtggttagtacggacggaaacgtaacgtagtaacgaacgtaaacgggtacggaacggttaaaccgggggtagggttacgtagg

SEQ ID NO: 369811 - DNA, 541 bp, Homo sapiens
  misc_feature: GZ8MTXP02GL10Q.15.23.C01.1.454.CMB.2.raw
  modified_base (297)..(297): a, c, t, g, unknown or other
  modified_base (324)..(324): a, c, t, g, unknown or other
  modified_base (436)..(436): a, c, t, g, unknown or other
  modified_base (444)..(444): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttcgtgtaggcgtatttagaaggtgtcagtgcgaggagcagctggtggagtcgtgggggaggcctggtccaggccgggggggtccctggagactctcctgtgccgctcgtggactcacctttagagctagttggatggngcgtcggccgcgcgcgcggagggaggngtggaggtgggcggacgaacgaagaaagaagagagagagagaacatagtagtgtctgtgtagacggacgactcacactcacagacgacgacgacaagtaatacagtagtatntagacaanagaacgacgacgagagacgacggacgacgacgacgtacgtagttagtgtgtagagacgagagaagacgaacgtacgacggtacggtacggtaggtag

SEQ ID NO: 369812 - DNA, 565 bp, Homo sapiens
  misc_feature: GZ8MTXP02HKNJR.15.23.C01.1.454.CMB.2.raw
  modified_base (307)..(307): a, c, t, g, unknown or other
  modified_base (414)..(414): a, c, t, g, unknown or other
  modified_base (562)..(562): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagtagctattggatgagctgggtccnccaggctccgaggggaagggctgggagtggggtggccaaacagtaaaggaagatggaaagtcaagaaaacactaatgtggactctgtgaagggccgattcaccatcnccagagacaacgccaaagaattcagtgtatctgactaaatggaaacagccctagagacgccggaaaggaccgacgggcccgttagtactttacgtgtggtagacgagacagtaagacaacgggtcgaacgtaaccgggaggggtttanagg

SEQ ID NO: 369813 - DNA, 660 bp, Homo sapiens
  misc_feature: GZ8MTXP02HSFDE.15.23.C01.1.454.CMB.2.raw
  modified_base (384)..(384): a, c, t, g, unknown or other
  modified_base (656)..(656): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttcttgttgctattttagaggtgtccagtgcgaggagcagctggtggagtcgtgggggaggcctggtccgaggccgggggggtccctggagactctcctgtcgccgcctctggactcacctttagtagctattggatgagctgggtccgccagggcctccgaggggaaggggctgggagtggggtggaccaaacaagtaaaggagatcggaagtcaaggaaaacnctaagtggtggactcgtggtaggaaacggggtcccgtaaatttccgaaaccctatccctacccgaaggaacggaacctaaaacccggacccaaaaggtaaactttccgaagttacgttaaattccgtaggaactaaaagtcggaaaacacgcctaggagaacggcccggaaggacctaccggggccgttagtaacgtttacggtggtagaggacgaacgacagtaacgaaacgtaacggggtacgtaaacggtaaccgggggtagggtttanacgg

SEQ ID NO: 369814 - DNA, 555 bp, Homo sapiens
  misc_feature: GZ8MTXP02JTSYG.15.23.C01.1.454.CMB.2.raw
  modified_base (502)..(502): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagtagctattggatgagctgggtccgccagggctccgaggggaaggggctgggagtggggtggccaaacagtaaaaggaagatagggaagtcaagaaacactaatgtggactactgtgaagggcgattcaccatctcccagacacaacgccaaagaattcagtgtatctgacaaatagaacagccctgaggacgccgagggacacggccgtagtattacgngtggtgagagacaagtgaacaacggtgaacgtaaccggggtaggggtagtagg

SEQ ID NO: 369815 - DNA, 644 bp, Homo sapiens
  misc_feature: GZ8MTXP02HE0VX.15.23.C01.1.454.CMB.2.raw
  modified_base (388)..(388): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaggtgtccagtgcgaggagcagctgggtggagtcgtgggggaggccgtgggtccgaggccgggggggtccctgagactctcctgtcgccgcctctggactcacctttagtagctattggatgagcgtgggtccgccaggctccgaggggaaggggctgggaggtggggtggccaaacgaagtaaaaggaagatagggaagtcaagaaacnctaagtgtggacttcgtaggtaggaaaggggtcccgatttcccaacctatcctcccaaggacgaacccaaacgcccaaagaactttcaagttgtaactctagactaaatcgaaacagaccctaggaacggacggacccgggaaggacccgaacggggccccgttaggtaaacttacgtggttaggtacggacgaaggacaagtggaaaccgaaacgggttggaaacgttaaaccgggggtagggggtttacgaagg

SEQ ID NO: 369816 - DNA, 537 bp, Homo sapiens
  misc_feature: GZ8MTXP02IW7UF.15.23.C01.1.454.CMB.2.raw
  modified_base (308)..(308): a, c, t, g, unknown or other
  modified_base (310)..(310): a, c, t, g, unknown or other
  modified_base (313)..(313): a, c, t, g, unknown or other
  modified_base (325)..(325): a, c, t, g, unknown or other
  modified_base (328)..(328): a, c, t, g, unknown or other
  modified_base (331)..(331): a, c, t, g, unknown or other
  modified_base (334)..(334): a, c, t, g, unknown or other
  modified_base (338)..(338): a, c, t, g, unknown or other
  modified_base (354)..(354): a, c, t, g, unknown or other
  modified_base (417)..(417): a, c, t, g, unknown or other
  modified_base (425)..(425): a, c, t, g, unknown or other
  modified_base (428)..(428): a, c, t, g, unknown or other
  modified_base (430)..(430): a, c, t, g, unknown or other
  modified_base (433)..(433): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggcgtgagctgggttttccttgttgctattttagaaggtgtccagtgcgaggagcagctggtggagtcgtgggggaggccctggccaggccgggggggtccctgagctctcctgtgccgcctcgtggctcaacctttgagctattggatgagcctggggcccncngcncgagggaggcgnggnggnggngcanagaagaagagagaganagaacatagtgtgtacgtcgtgaggacgggcgactcacactcacagagacaacgacaagatanagtatatntananaanagacgacgacgagagagacgacggacgacggacgtacgtagttagtgtggtagagacgacgagaagaacgaacggtacggacggtaacgggtaggggtaggtag

SEQ ID NO: 369817 - DNA, 629 bp, Homo sapiens
  misc_feature: GZ8MTXP02HUOZL.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctcctgtgccgcctctggactcacctttagtagctattggatgagctgggtccgccaggctccgaggggaaggggctgggaggtggggtcggaccaaacgaagtaaaagggaagaagtagggaagtacaagaaaaccacttaatggtgggacttcgtgtagggaaacggggccgaattcccaaccctatcctacccgaagaaccgaaccaaacgacccaaaagtacttcgagttgtaatctagactaaaatgaaaccagcctaggaagacggccgaagggaccacggggtcctaggtttaactttagtgtggtagacgtaagacagtaacgaaacgtaacgggtagaacggtaaaccgggggaggggttttacagg

SEQ ID NO: 369818 - DNA, 672 bp, Homo sapiens
  misc_feature: GZ8MTXP02IEZ1H.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctcctgtcgccgcctcgtggactctaccttagtagctattggatgagcgtgggtcccgccgaggcctaccgaggggaaggggcgtggggaggtggggtggtacaaacgaagtaaaagggaagagtacgggaaagtacaagaaaactacttagtaggtgggacttcgtggtaggaaacgggggtccgtaatttccgaaaccctagtccctacccgaaggaacgaaacccaaacggaccctaaaaggtaactttaccgaaggttactaacgttcgttagaactaaaagtacgaaacgacgtcccgtaggaacgacggaccggaaggaccgaacggtccgttagttactttacgtgtaggttagaggacgacagtaagaaccgaaggtacgaaacgttaaccggggtaggggtttacgaagg

SEQ ID NO: 369819 - DNA, 570 bp, Homo sapiens
  misc_feature: GZ8MTXP02JXI7U.15.23.C01.1.454.CMB.2.raw
  modified_base (504)..(504): a, c, t, g, unknown or other
  modified_base (566)..(566): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtcgccgcctctggactcaccttagtagctattggatgagctgggtccgcaggctccgaggggaaggggctgggagtggggtggccaaacaagtaaaggaagatgggaaagtcaagaaaacactatgtggactcgtgtgaaggggcccgattccaccatctccagagacaacgccaaagaattcagtgtatctagacaaatgaaacagcctaggagacgccggaaggacacgggcctagtattacnggtagtgaacgagaacagtaacgaacgtaacgggtgaaacggtaaccggggagggggtttanaagg

SEQ ID NO: 369820 - DNA, 558 bp, Homo sapiens
  misc_feature: GZ8MTXP02IHN5S.15.23.C01.1.454.CMB.2.raw
  modified_base (290)..(290): a, c, t, g, unknown or other
  modified_base (295)..(296): a, c, t, g, unknown or other
  modified_base (298)..(298): a, c, t, g, unknown or other
  modified_base (310)..(310): a, c, t, g, unknown or other
  modified_base (322)..(322): a, c, t, g, unknown or other
  modified_base (324)..(324): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
tcagtctacgtagccacgaccggtgctcgatttagtacacgtgatttagggattgggaggtctcagagaggagcccttagcccctggactccaaggccttttccacttggtgatcagcactgagcacagaggactcaccatggagttggggctgagcgtggttttcgtgtaggctattttagaaggtgtccagtgcgaggagcagctggtggagtgtgggggaggccgtggtccgaggccggggggtcccgtgagctctcctgtgccgcctcctggctcaccttagtatntatgnngngcgtcggcgcgngcgcgaggaggngnggnggnggngacaagaagaagaagagagaagacgaagaacaactatagtgtacgtcgtagtaggacggacgtactacacactctacagaacgaacaacgacaaagtaatacgagtagtatactagaacaaagtaagaacgacgacgagagacgacgacgacgacggacgtacgttattacgtgtgagagacgagagtaagaacgaacgtagaacggtaacgggtaggtaggtag

SEQ ID NO: 369821 - DNA, 587 bp, Homo sapiens
  misc_feature: GZ8MTXP02J0RVC.15.23.C01.1.454.CMB.2.raw
  modified_base (483)..(483): a, c, t, g, unknown or other
  modified_base (485)..(485): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttcgtgtaggcgtatttagtaaggtgtccagtgcgaggagcagctggtggagtctgggggaggcctggtccaggccgggggggtccctgagactctcctgtgccgcctcgtggactcacctttagtagctattggatgagctgggtccgccagggctccgaggggaaggggctgggagtggggtggccaaacagtaaaagggagagtcgggaagtcaagaaaacactaagtgtgggactctggtggaaggggcccaatttccaaccctattccctacccgaagagaaccaacgccctaaagaactttcagtgtaatctgaacaananacgagacgagagacgacgacggacgacgacgtacgtatacgtcgtgtagacgacgacgagtaacgacgaacggtacggtacggtacgggtacgggtaggtag

SEQ ID NO: 369822 - DNA, 543 bp, Homo sapiens
  misc_feature: GZ8MTXP02GJC7F.15.23.C01.1.454.CMB.2.raw
  modified_base (442)..(442): a, c, t, g, unknown or other
  modified_base (497)..(497): a, c, t, g, unknown or other
  modified_base (540)..(540): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtcgccgcctctggactcacctttagtagctattggatgagctgggtccgccaggctccgaggggaggggctgggagtggggtgccaaacagtaaaaggaagatgggaagtcaagaaacactaatgtggactctgtgaaggggccgattcaccatcctcagagaccaacgccaagaattcagtntatctgacaaatgaacagcctagagcgaccgaggacacgggcctagtacttacgngtgtgagacgacatgaacaacggtgaagtaaccgggagggttnaag

SEQ ID NO: 369823 - DNA, 560 bp, Homo sapiens
  misc_feature: GZ8MTXP02IB8KV.15.23.C01.1.454.CMB.2.raw
  modified_base (556)..(556): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctgggtggagtctgggggaggcctgggtccaggccggggggtccctgagactctcctgtgccgcctctggactcacctttagtagctattggatgagctgggtccgccaggctccgaggggaaggggctgggagtggggtggccaaacaagtaaaagggaagatgggaaagtcaagaaaacactaatgtgggacttctggtagaaggggccgattccacccatctccagagacaacgccaaagaattcagtgtatctgacaaatgaaacagcctagagagccgaggaccacgggccgtagtattactgtgtagagagacagtgaacaacggtgaacgtaaccggggaggggtttnaagg

SEQ ID NO: 369824 - DNA, 584 bp, Homo sapiens
  misc_feature: GZ8MTXP02FYL40.15.23.C01.1.454.CMB.2.raw
  modified_base (306)..(306): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctgagactctcctgtgccgctctggactcacctttagagctattggatgagctgggtccncaggctccgagggagggctggagtgggtgccaaacagtaaaggagatagggaagtcaagaaacactaagtgtggactctggtagaaagggggcccgaatttcccgaacccagttccctacccaaggaacgaacaaaccggcccaaaggaaatttcaaagtgtaatctgacaaatgaaacagccctagagacgaccaaagggactaacgggccgtagtaattactagtgtagagagacagtcgaacaacggtagaacgtaaccgggaggggtttagaag

SEQ ID NO: 369825 - DNA, 568 bp, Homo sapiens
  misc_feature: GZ8MTXP02JTEX0.15.23.C01.1.454.CMB.2.raw
  modified_base (371)..(371): a, c, t, g, unknown or other
  modified_base (564)..(564): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagtagctattggatgagctgggtccgccaggctccgagggaggggctgggagtgggtgccaacagtaaaggagatggaagtcaagaaacnctagtgtggactcgtgtagaaggggccgattcaccatcctaccagacgacaacgccaaagtacttcgagtgtactctagacaaagtgaaacagccctaggaacgacggccgaggtaccacggggtcccgtaggttactaccgtgtggtgagacacgagtcgaacgaacggtagaacgtaaccggggagggttnaagg

SEQ ID NO: 369826 - DNA, 568 bp, Homo sapiens
  misc_feature: GZ8MTXP02GT8RP.15.23.C01.1.454.CMB.2.raw
  modified_base (430)..(430): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgccgcctctggactcacctttagtagctattggatgagctgggtcccgccaggctccgaggggaaggggctgggagtggggtggccaaacgaagtaaaagggaagatagggaagtcaagaaacactatgtggactcgtgtagaaggggccgaattccaccatcctccaganacaacgccaaagaattcagtgtatctagacaaatgaacagcctagagagccgaaggacgacggccgtagtacttacgtgtgtagacgagacagtaacgaacgaaacggtgaacgtaaccggggtaggggttagtaagg

SEQ ID NO: 369827 - DNA, 563 bp, Homo sapiens
  misc_feature: GZ8MTXP02F3BIF.15.23.C01.1.454.CMB.2.raw
  modified_base (307)..(307): a, c, t, g, unknown or other
  modified_base (347)..(347): a, c, t, g, unknown or other
  modified_base (420)..(420): a, c, t, g, unknown or other
  modified_base (551)..(551): a, c, t, g, unknown or other
  modified_base (559)..(559): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctcctgtcgccgcctctggactcacctttagagctagttggatgagctgggccnccaggctccgaggggaagggctgggagtggggtgccaaanagtaaaaggaagagtggaaagtcaaagaaaacatatgtggactgtgtagaacgggccattcacatcctcaganaacaacgccaaaagattcagtgtatctagacaaatcgaaacagcctagacgagccgaggaccgtacggccgtagtacgttactgtgtagagacgactagtaagaaacgaacggtagaacgtaaaccggggnggggttanaagg

SEQ ID NO: 369828 - DNA, 610 bp, Homo sapiens
  misc_feature: GZ8MTXP02JC13T.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctggagactctcctgtcgccgcctctggactcaccctttagtagctattggatgagctgggtccgccaggctccgaggggaaggggctgggaggtggggtcggaccaaacaagtaaaggaaagatagggaaagtcaagaaaacactaatgtgggactcgtaggtaggaacggggccgaattccgaacccagtccctccaagagaaccaacgacccaaagaacttcagtgtatctagacaaatgaactagaccgtagaacgaggccgaaggaccgaacggcccgttaggtacttacctggttagtacggagaacgacagtaagaaccgaaacgggtagaacggtaaccgggtaagggggttcgaagg

SEQ ID NO: 369829 - DNA, 683 bp, Homo sapiens
  misc_feature: GZ8MTXP02HFCWG.15.23.C01.1.454.CMB.2.raw
  modified_base (306)..(306): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggaggcctggtccaggccggggggtccctgagactctcctgtcgccgcctctggactcactttagagctattggatgagctgggtccncaggctccgaggggagggctgggagtggggtcggaccaaagaagtaaaagggaaagtagtagggaaagtacgaaagaaaacctactaaagtggtcggggaacttcgtaggtagggaaaacgggggtcccgtaaatttcccaaaccctaatccctacccgaaggaacgaaacccgaaaccgaccccgaaaaggtaaactttccgaaaggttagttaaatccgttaagaacctaaaaagttcgaaaacacgaccctaggaaaggaccggaccggaaggaaccgaaccgggtcgttagtaactttacgtggttgtagacgaagacagtaacgaaacgaaaccggttggaaacgtaacccggggtagggggtttacgaagg

SEQ ID NO: 369830 - DNA, 576 bp, Homo sapiens
  misc_feature: GZ8MTXP02J29MD.15.23.C01.1.454.CMB.2.raw
  modified_base (305)..(305): a, c, t, g, unknown or other
  modified_base (341)..(341): a, c, t, g, unknown or other
  modified_base (368)..(368): a, c, t, g, unknown or other
  modified_base (375)..(375): a, c, t, g, unknown or other
  modified_base (385)..(385): a, c, t, g, unknown or other
  modified_base (509)..(509): a, c, t, g, unknown or other
  modified_base (545)..(545): a, c, t, g, unknown or other
  modified_base (572)..(572): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccggggggtccctgagctctcctgtgccgcctctggactcaccttagtagctattggatgagctgggtccncaggctccgagggagggctggagtgggtgaccaaanagtaaaaggagatggaatcaagaaacnctagtgnggactctggngaaggggccaattccacccatccaccagacgacacgccaaagaattcagtgtaatctagacaaatgaaactacgcctaggaacgagcccggaaggaccgaaccgggtccgttagtacgttacgnggtgtagagaacggacagtaacgaaacgtaacgggngtaaacgtaaccggggtaggggtttanaagg

SEQ ID NO: 369831 - DNA, 597 bp, Homo sapiens
  misc_feature: GZ8MTXP02HD2R2.15.23.C01.1.454.CMB.2.raw
  modified_base (595)..(595): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccgggggggtccctgagactctcctgtgccgcctctggactcacctttagtagctattggatgagctgggtccgccaggctccgaggggaaggggctgggaggtggggtggccaaacgagtaaaaggaagataggggaaagtcaaggaaaacactaatggtgggacttcgtggtggaaaggggccgagttccaacctatcctcccaggacgaccaaacgccaaagaacttcagtgtatctagactaaatgaaactagaccctaggacgagcccggaaggaccgacgggcccgtaggttacttacgtggtagtaggagagacatggaaccgaagggtcgaacgtaaccgggtagggggttanag

SEQ ID NO: 369832 - DNA, 653 bp, Homo sapiens
  misc_feature: GZ8MTXP02JPP62.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctgagactctcctgtgccgcctctggactctacctttagtagctattggatgagcgtgggtccgccgaggcctccgaggggaaggggctgggaggtggggtggccaaacgaagtaaaaggaaagagtagggaaagtacgaaagaaaacactatggtggaactcgtggtaggaacggggccgtattcccgaaccctatccctacccgaaggaacgaacccgtaaaacggtccaaaaggtaactttaccgaaaggttgttaaactccgtaggtaactaaaagttacgaaacacggacccgtaggaacgacggacccggaaggaaccgacgggccgttagttattacgtgtagtagacgagacagtaagaacgtaacggtaggaacgtaaccggggtaggggttactagg

SEQ ID NO: 369833 - DNA, 604 bp, Homo sapiens
  misc_feature: GZ8MTXP02HJAC7.15.23.C01.1.454.CMB.2.raw
  modified_base (601)..(601): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgccgcctctggactcacctttagtagctattggatgagctgggtccgccaggcctccgaggggaaggggctgggagtggggtggaccaaacgaagtaaaggaagatggaagtcaagaaacactatgtggactcgtggtagaaggggccgtaattccaacctatccctacccaaggaacgaaccaaaccgacccaaagtaacttcgagttgtaatcctagactaaaagtgaaacagcctagagacgccggaggaccgacgggccgttagtacttacgtgtgtacgaagacgaactagtaaggaaccgaaagggtacgaaacggtaaccggggtaggggtttanagg

SEQ ID NO: 369834 - DNA, 559 bp, Homo sapiens
  misc_feature: GZ8MTXP02FOX4N.15.23.C01.1.454.CMB.2.raw
  modified_base (554)..(554): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgctctggactcacctttagtagctattggatgagctgggtccgccaggctccgaggggaaggggctgggagtggggtggccaaacagtaaaaggaagatgggaaagtcaagaaacactaatgtgggactctggtagaagggccgattcaccatctccagagacaacgccaaagaattcagtgtatctagacaaatgaaacagccctaggacgagccgaggaccgacgggccgtgtattactggtgtagagagacagtaagaacgaacggtagagtaaaccgggaggggttntaagg

SEQ ID NO: 369835 - DNA, 620 bp, Homo sapiens
  misc_feature: GZ8MTXP02I2MBD.15.23.C01.1.454.CMB.2.raw
  modified_base (558)..(558): a, c, t, g, unknown or other
  modified_base (618)..(618): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtgggagtcgtgggggaggccgtgggtccgaggccgggggggtccctgagactctcctgtcgccgcctctggactcaccttagtagctattggatgagcgtggtccgccaggctccgaaggggaaggggctgggaggtggggtggaccaaacgaagtaaaaggaagatacggaaagtcaagaaaactctaatggtggactctggtagaaacggggccctaattcccaaccctattccgacccaaaggacgaaccaaacggccctaaaagattcgaagttgtaactctagactaaaatcgaaacagcctaggaagacggaccggaaggaccgtaccggccgttagtactttacgngtaggtgagaacgacaagtcggaaaccgaacgggtgaaacgttaccggggaggggtttanag

SEQ ID NO: 369836 - DNA, 619 bp, Homo sapiens
  misc_feature: GZ8MTXP02JJLBX.15.23.C01.1.454.CMB.2.raw
  modified_base (613)..(613): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccgggggggtccctgagactctcctgtgccgcctctggactcacctttagtagctattggatgagcgtgggtccgccaggctccgaggggaaggggctgggaggtggggtggccaaacgaagtaaaaggaagagtaggaagtcaagaaacactaatgtggactgtggtagaagggccgattccacccatcctaccgagacaaccaacgccaaagtaattcaagttgtaatctagactaaaagtcgaaaacagccctaggaacggacggaccggaaggtaaccgacgggcccgttagtacgtttacgtggtaggtacgagaacgactagtaacggaacgtaaacggggttgaaacggttaaaccgggggtaggggtttanaacggg

SEQ ID NO: 369837 - DNA, 621 bp, Homo sapiens
  misc_feature: GZ8MTXP02G2PZH.15.23.C01.1.454.CMB.2.raw
  modified_base (564)..(564): a, c, t, g, unknown or other
  modified_base (578)..(578): a, c, t, g, unknown or other
  modified_base (619)..(619): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggccggggggtccctggagactctcctgtcgccgcctctggactcacctttagtagctattggatgagcgtcggggtcccgccgaggcctcccgaaggggaacggggcgtgggaggtggggtggaccaaacgaagtaaaagggaagagtcggggaaagtcaagaaacactaagtgtggactcgtaggtagaaggggccgattccaacctatcctaccaagaacgaaccaaacgcccaaaaggtaacttacgagttagtaatctagaacaaaagtgaaaaccagaccctgaacgacgacccggtaaggaccgacggccgttagtacttacgngtagagagacgaanagaacgaacgtaacggtacgaacggtaacggggtagggtanag

SEQ ID NO: 369838 - DNA, 566 bp, Homo sapiens
  misc_feature: GZ8MTXP02FH4JK.15.23.C01.1.454.CMB.2.raw
  modified_base (563)..(563): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggggggaggcctgggtccaggccgggggggtccctgagactctcctgtgccgcctctggactcacctttagtagctattggatgagctgggtcccgccaggctccgaggggaaggggctgggaggtggggtggccaaacagtaaaagggaagatggaagtcaagaaacactatgtggactctggtagaagggccgattccaaccatcctccagacgaacaacgccaaagaacttcaagtgtaatctgacaaaatgaaacagccctaggagacgccggaaggaccacgggtccgtgtattacgtggtgtgagagacagtgaacaacggtgaacgtaacggggaggggttnagg

SEQ ID NO: 369839 - DNA, 617 bp, Homo sapiens
  misc_feature: GZ8MTXP02IR27Z.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtggagtcgtgggggaggcctggtccgaggccggggggtccctgagactctcctgtcgccgcctctggactcacctttagtagctattggatgagcgtgggtccgccgaggctccgaggggaacggggcgtgggaggtggggtggaccaacgaagtaaaaggaaagagtagggaaagtacgaagaaaactactaagtgtgggacttcgtaggtggaacggggcccgtaagtttcccaacccgtaatccctaccgaagaacgaaccaaaccggaccaaagtaacttacgagttagtaatcgtagactaaaatgaacagccagagaggccgaggacgtacgcgtagtattacgtggtgtagacgtagacagtaagacgaaaacggtgaacgtaaccggggaggggtttcgaagg

SEQ ID NO: 369840 - DNA, 554 bp, Homo sapiens
  misc_feature: GZ8MTXP02I174C.15.23.C01.1.454.CMB.2.raw
  modified_base (413)..(413): a, c, t, g, unknown or other
  modified_base (419)..(419): a, c, t, g, unknown or other
  modified_base (550)..(550): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgccgcctctggactcacctttagtagctattggatgagctgggtccgccaggctccgaggggaaggggctgggagtgggtggccaaacataaaaggagatggaagtcaagaaacactatgtggactcgtgtaggaagggccgaattcaccatcnccaganacaacgccaaagaattcagtgtatctagacaaatgaacagcctagagagaccgaggtaccacggtccgtagtaacttactggtgtgagacgacaagtgaacgaacgggtgaacgtaaaccgggaggggttntaag

SEQ ID NO: 369841 - DNA, 660 bp, Homo sapiens
  misc_feature: GZ8MTXP02H8EN5.15.23.C01.1.454.CMB.2.raw
  modified_base (656)..(656): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctgagactctcctgtcgccgcctctggactcaccttagtagctagttggatgagtcgtcggggtccgccagggctcccgaaggggaaggggcgtagggaggtggggtacggacccaaagaaagtaaaaggaagagtacgggaaagtacaaagaaaacacgtagttggtcgggaacttcgtaggttaggaaacggggtcccgtattccgaaccctagtcctacccgaaagaacgaccaaaacggccaaaggtaaattcgagttcgaaactctagaactaaaagtgaaaccagcccgaggaaccggacgccgggaacgtacggaccccgggtagttataacgtttggagttggacgaagactaactagaacgtaaaccggaggtaacgtaaccggtacgggggtaggtttanaggg

SEQ ID NO: 369842 - DNA, 651 bp, Homo sapiens
  misc_feature: GZ8MTXP02H4W81.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctggagactctcctgtgccgcctctggactcaccttagtagctattggatgagcgtgggtccgccaggctccgaggggaaggggcgtgggaggtggggtcggaccaaagaaagtaaaagggaagagtaggaagtcaaagaaacactagtgtgggactctggtagaacggggccgaattccgaaccctatcctacccaagacgaacaaaccgaccaaagtaacttcagtagtatactgaactaaagtacgaaacacgacctaggaacggacgaccggaacggaccgaccgggtcccggttagttaacgtttaccgtggtagggtaggaaggtacggacaagttaacggaaaacgaaacgggggttacgaaacggttaaaacccgggggaggggtttaacggaaggg

SEQ ID NO: 369843 - DNA, 561 bp, Homo sapiens
  misc_feature: GZ8MTXP02J3UE3.15.23.C01.1.454.CMB.2.raw
  modified_base (307)..(307): a, c, t, g, unknown or other
  modified_base (384)..(384): a, c, t, g, unknown or other
  modified_base (420)..(420): a, c, t, g, unknown or other
  modified_base (465)..(465): a, c, t, g, unknown or other
  modified_base (507)..(507): a, c, t, g, unknown or other
  modified_base (558)..(558): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccggggggtccctgagactctcctgtgccgcctctggactcacctttagtagctattggatgagctgggtccnccagggctccgaggggaaggggctgggagtggggtggaccaaacgaagtaaaaggaagataggaaagtcaagaaacnctagtgtggactctgtgaagggccattccaccatcncagacgacaacgcaaagattcagtgtatctgactaaagtgaaacngccgtagagacgccgggagacgtacgggccttagtacttacnggtgtagagagacagtgaacgtaacggtgaacgtaaccgggggagggtttnagg

SEQ ID NO: 369844 - DNA, 563 bp, Homo sapiens
  misc_feature: GZ8MTXP02FO9B7.15.23.C01.1.454.CMB.2.raw
  modified_base (473)..(473): a, c, t, g, unknown or other
  modified_base (558)..(558): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggcccgggggggtccctgagactctcctgtgccgcctctggactcacctttagagctattggatgagctgggtccgccaggctccgaggggaaggggctgggagtggggtggccaaacagtaaaaggagatgggaagtcaagaaacactatggtggactcgtggtagaaggggccgattccaccatcctaccagagacaacgccaaagaattcagtgtatctgacaaatgaaacagcctgngagcccgaaggaccacgggccgtagtattactggtgtgagagacagtcgaacgaacggtagaacgtaaaccggggtaggggtttnaacgg

SEQ ID NO: 369845 - DNA, 580 bp, Homo sapiens
  misc_feature: GZ8MTXP02HBQQ1.15.23.C01.1.454.CMB.2.raw
  modified_base (439)..(439): a, c, t, g, unknown or other
  modified_base (541)..(541): a, c, t, g, unknown or other
  modified_base (576)..(576): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctggagactctcctgtcgccgcctctggactcaccttagagctattggatgagctgggtccgccaggctccgaggggaaggggctggaggtgggtggccaaacaagtaaaaggaaagatgggaaagtacaagaaaacactaatgtggaactctagtaggaaaggggccgattccaacccaatcctcccaagganaaccaaacgcccaaaagaaatttccaagtgtaatctgacaaaatgaaacagcctagagacgccgaggaccacggcccgtgattacgtgtgtagacgagacanaaggaacaacggtgaaagtaccgggaaggggtttnaagg

SEQ ID NO: 369846 - DNA, 814 bp, Homo sapiens
  misc_feature: GZ8MTXP02F2FUS.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggtttccttgttgctattttagaggtgtccagtgcgaggagcagctggtggagtcgtgggggaggcctgggtccgagggccggggggtccctggagactctcctgtcgcccgcctctggactctacctttagagctagttggatgagcgtcgggtcccgccgagggcctaccggaaggggaacggggcgtggggaggttggggtacggaacccgaaaacgaagtaaaaggggaaagtagtaggggaaaagtaccgaaaaggaaaacctagttaagtgggtacgggtaaccttcggtagggtacgggaaaccgggggtccctaatttacccaacctattacccgaccgaaaggaaccgtaaacccgaaacccggacccgaaaaaggttaactttaccgaaaggggtttagtaaactttaccgtaaggaaacctaaaaagttaccgggaaaaacccgacggtacccgtaaaggggaaaccggaaccgggaacccgggaaaccgggtaaacccggtacccggggttaccgtttaaggtttaacgtttacggttcggtaagggtaaacgaaacggtaacgtaacgtaacgtaaacgggaaaccggtaaaacggggttacgggtaaaaccgggttaaaccgggggtaggggtttacgtaaacgg

SEQ ID NO: 369847 - DNA, 603 bp, Homo sapiens
  misc_feature: GZ8MTXP02H16GH.15.23.C01.1.454.CMB.2.raw
  modified_base (355)..(355): a, c, t, g, unknown or other
  modified_base (599)..(599): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggcccgggggggtccctggagactctcctgtgccgcctctggactcaccttagtagctattggatgagctggggtccgccaggctccgaggggaaggggctgggaggtggggtggaccaaanaagtaaaaggagatacgggaaagtcaagaaaacactaagtggtggactctggtaggaaaggggcccgaattccaaccctatcctacccgaagaacgaccaaacgaccaaagaaacttcgagtagtatctagacaaatagaacagctagagacgaccggaaggacgacggccgtgtaaacttacgtgtggtagacgagaacagtaagaaccgaaacgggtgaacgtaaaccgggagggggtttanaagg

SEQ ID NO: 369848 - DNA, 549 bp, Homo sapiens
  misc_feature: GZ8MTXP02FUCKI.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctgggtccaggccgggggggtccctgagactctcctgtgccgcctctggactcacctttagtagctattggatgagctgggtccgccagggctccgaggggaaggggctgggagtggggtggccaaacataaaaggaagatgggaaagtcagaaaacactatgtggactctgtgaagggccgattcaccatctccagagacaacgccaaagaattcagtgtatctgacaaatgaaacagcctagagagcccggaaggacctacgggccgtagtacttacgtgtgtgagagacatgaacaacggtgaagtaaccggggagggttgaag

SEQ ID NO: 369849 - DNA, 706 bp, Homo sapiens
  misc_feature: GZ8MTXP02JL7OD.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctggagactctcctgtcgccgcctctggactcacctttagtagctagttggatggagcgtgggtccgccaggcctccgaggggaaggggcgtgggaggtggggtggacccaaacgaagtaaaaggaagtagtagggaagtacaagaaaacacgttaagtgtgggtaaccttcgtggtacggaacggggcctaattacccgaacctattacccgtacccgaaggaacgaaacccgaaaccgacccaaaaggtaactttaccgaaaggttacgttacgttacctaggaacctaaaagttacggaaaccgacgtaccctagggaaacggacggtacccggaaggacccgaaaccggggcccgtttagtaacgtttacggtggttggtacggaacggaacgactaagtaacggaaaccgaaacgggtaggtaaacgtaaacccgggggtaggggtttacgtaagg

SEQ ID NO: 369850 - DNA, 601 bp, Homo sapiens
  misc_feature: GZ8MTXP02JGN6N.15.23.C01.1.454.CMB.2.raw
  modified_base (419)..(419): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctgggtggagtcgtgggggaggcctggtccaggccgggggggtccctgagactctcctgtgccgcctctggactcacctttagagctattggatgagctgggtccgccaggctccgaggggaaggggctggagtggggtggccaaacagtaaaaggaagatagggaaagtcaagaaaacactatgtgggactctgtagaaggggccaattcaaccctntccacgaagacgaacaacgtaccaaagtaactcgagtgtatcgtagaacaaagtcgaaacacgccgtagaacgacggaccgaggacgtacggcttagtacttacgtggtagtacggaagacgacaagtaacggaaacgtaaacgggtagaaaacggttaaccgggggtaggggttacgtaag

SEQ ID NO: 369851 - DNA, 695 bp, Homo sapiens
  misc_feature: GZ8MTXP02FLXYD.15.23.C01.1.454.CMB.2.raw
  modified_base (526)..(526): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggaggccgtggtccgagggcccggggggtccctggacgactcctccgtgtcgcccgcctctcggactcacctttagagctagttggatgagcgtcgggtcccgccgaggcctaccggaaggggaaggggctggggaggtggggtcggacccaaaagaaagtaaaaggggaaagagtacgggaaagtcaaagaaacactagtggtcggactgtaggtaggaacggggccctaattcccaaaccctattccctaccgaaagacgtaaacccaaaccggaccctaaaagtaaactttccgaaaaggtttnttaacgtacgtaagaaactaaaagtacgaaaacgacgtaccgtaggaacggacggaccggaaggtaccgacggtaccgttagttacgttacgtggtaggagaacgaacgactaagtaacggaaacgtaacgggtacgaaaacgggttaacggggtagggttacgtaagg

SEQ ID NO: 369852 - DNA, 668 bp, Homo sapiens
  misc_feature: GZ8MTXP02H3RUA.15.23.C01.1.454.CMB.2.raw
  modified_base (310)..(310): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggcccggggggtccctggagactctcctgtgccgcctctggactctaccttagtagctattggatgagcgtgggtccnccaggctccgaaggggaaggggctgggaggtgggtcggaccaaagaaagtaaaagggaagatagggaaagtacaagaaacactagtgtggtactcgtgtaggaacgggcccgtattaccgaaccctatcccgtacccaaggacgaaaccaaaccgacccaaaagtaaactttccgagttacgtattaccgttagaactaaaagtacgaaacagccctaaggaacggacgaccggtaaggaacccgacggggcccgtttaggtaactttaccggtgtacggttacgaaaggaacgacaagttaacggaaacgtaaaaccggggtgaaacggtaaacccggggtagggggtttacgtagg

SEQ ID NO: 369853 - DNA, 803 bp, Homo sapiens
  misc_feature: GZ8MTXP02HHC8H.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttccttgttgctattttagaaggtgtccagtgcgaggagcagctggtggagtcgtgggggaggcctggtccgaggccggggggtcctgagactctcctgtcgccgcctctggactcaccttagtagctattggatgagcgtgggtcccgccgaggcctccgaaggggaaggggctggggacggtggggtcggacccaaacaagtaaaaagggaagtaagtacggggaaaagttaccaaaggaaaaaccaacgttaagtgggttacggggaaacctttcgttagggttaacggggaaaacgggggtcccccgtaaagttttaccccgaaaccccgtaacgttaccccttaacccccgaaaggaaacggaaaaccccgtaaaaccccggaaccccgaaaaaaggttaaaactttaacccgtaaaggttacggttaaacttaccgttacggaaacctaaaaagttaagaaaaccccccgaagccccgttaaggaacggaacggacccggaaacggggaaccgaaccggggtacccggttaggttaaaacgtttacgttacggtaggttaacgaggaacgaaccgtaagtaacgaaacgaaacggggttagaaaacggtaacccggggtaagggggtttacgaaggg

SEQ ID NO: 369854 - DNA, 596 bp, Homo sapiens
  misc_feature: GZ8MTXP02JELS5.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccaggccgggggggtccctgagactctcctgtgccgcctctggactcaccttagtagctattggatgagctgggtccgccaggctccgaggggaaggggctgggaggtggggtggccaaacgagtaaaagggaaagagtagggaaagtacgaagaaaaccacttaagtggtgggacttcgtggtaggaaagggggcccgtattccacccatcctccacgagaacaacgaccaaagaatacagtgtatctagacaaatagaacacgaccgtagaggagaccggacggacgacggccgtacgtacttcgtaaaaggtgtagagagacgagtaagacgaacggtagacgtaaccgggtacggggtaggtagg

SEQ ID NO: 369855 - DNA, 533 bp, Homo sapiens
  misc_feature: GZ8MTXP02HVFJ0.15.23.C01.1.454.CMB.2.raw
  modified_base (266)..(266): a, c, t, g, unknown or other
  modified_base (296)..(296): a, c, t, g, unknown or other
  modified_base (298)..(298): a, c, t, g, unknown or other
  modified_base (307)..(307): a, c, t, g, unknown or other
  modified_base (320)..(320): a, c, t, g, unknown or other
  modified_base (322)..(322): a, c, t, g, unknown or other
  modified_base (325)..(325): a, c, t, g, unknown or other
  modified_base (332)..(332): a, c, t, g, unknown or other
  modified_base (340)..(340): a, c, t, g, unknown or other
  modified_base (364)..(364): a, c, t, g, unknown or other
  modified_base (370)..(370): a, c, t, g, unknown or other
  modified_base (375)..(375): a, c, t, g, unknown or other
  modified_base (396)..(396): a, c, t, g, unknown or other
  modified_base (419)..(419): a, c, t, g, unknown or other
  modified_base (431)..(431): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctatttttagaaggtgtccagtgcgaggagcagctggtggagtctgggggagcctggtccagccgggggggtccctgagctctcctgtgccgccctntggactcacctttagtagctattggatggngngtggcgcgngcgcgagggaggngnggnggtgggnggacgaanaagaaaggaagagagagagagaanatatgngactntgtagaggcgatacacactcncagagaacaacgaccaagaatanagtagtatatanacaatagaacagacgagagacgacggacgacgacgacgtacgtagttacgtcgtgtagagacgagagaagacgaacgtacgaaggtaacggtagggtaggtg

SEQ ID NO: 369856 - DNA, 546 bp, Homo sapiens
  misc_feature: GZ8MTXP02HXUNT.15.23.C01.1.454.CMB.2.raw
  modified_base (379)..(379): a, c, t, g, unknown or other
  modified_base (497)..(497): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccaggccgggggggtccctgagactctcctgtgccgcctctggactcacctttagtagctattggatgagctgggtccgccagggctccgaggggaaggggctgggagtggggtggccaaacgataaaaggagatgggaaagtcagaaaacnctaatgtgggactctgtgaagggccattcaccatctccagagacaaacgccaaagaattcagtgtatctgacaaatgaacagcctgagacgccgaaggacacggccgtgtatttacgngtgtagagagacagtaagacaacggtgaagtaaccgggaggggttagag

SEQ ID NO: 369857 - DNA, 745 bp, Homo sapiens
  misc_feature: GZ8MTXP02HPWUB.15.23.C01.1.454.CMB.2.raw
  modified_base (309)..(309): a, c, t, g, unknown or other
  modified_base (728)..(728): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcgtgggggagcctggtccgaggccgggggtccctgagactctcctgtcgccgcctcgtggactcacctttagagctattggatgagcgtgggtccnccgaggctccgaggggaagggcgtgggaggtggggtcggaccaaacgaagtaaaagggaagagtagggaaagtaccaaagaaaactacttaagtgggtcgggtaaccttcgtaggttacgggaaaacgggggtcccctaaatttcccgaaacccttaacttccctacccgaaaggacgaaacccgaaaacccggacccaaaaggtaaactttccgaaagggttcgttaaacttccctaggaaaccctaaaaagttacggaaaaccgacggtcccgtaagggaacggaacggtcccgggaaaggtacccgaccgggtaccggtttagtaacgttttaacctgggttaggttacgaaacgggagtaacctaaggtaacggaaacccgaaaacggggttagaaaacggttaaaaccgggggngggggttttaataacgg

SEQ ID NO: 369858 - DNA, 677 bp, Homo sapiens
  misc_feature: GZ8MTXP02JG0X9.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtggagtcgtgggggaggccgtggtccgacgggcccggggggtccctggagacctctccgtgtcgcccgtcctcgtcggactcctacctttagtagctagttggatgagctcgggtccgccaggcctccggaaggggacggggctaggggaggtggggtcgaccaaacgtaaagtaaaagggaagagtacgggaaagtacaacgaaaactctaagtggtggtactcgtggtagggaacggggtcctaagttcccaaccgtatccctacccgaaagacgaaaccaaaaccgcccaaaaggtaacttcgaagttgtaaactccgtaaggaacaaagtccgaaacacggtccgtagaacggacggaccggaaacgggaccgtaccgggcgtttagtaaacgttcgtggtagtacgaaggaccgaacagaaggtaaaccgaagggtacgaaacggtaacgggggtaggtacgtagg

SEQ ID NO: 369859 - DNA, 566 bp, Homo sapiens
  misc_feature: GZ8MTXP02JNPA5.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggcccgggggggtccctgagactctcctgtgccgcctctggactcacctttagtagctattggatgagctgggtccgccaggcctccgaggggaaggggctgggagtggggtgccaacagtaaaggaagataggaagtacaagaaaacactaatgtgggactcgtggtagaaggggccgattccgaacccatcctaccagagaacaacgcccaaagaacttcagttgtaatcgtagacaaaatgaaacagcctagagagccgaggacacgggctagtatacgtgtgtgagacgacagtgaacaacgggtgaacgtaaccggggtagggttagagg

SEQ ID NO: 369860 - DNA, 570 bp, Homo sapiens
  misc_feature: GZ8MTXP02FZU42.15.23.C01.1.454.CMB.2.raw
  modified_base (376)..(376): a, c, t, g, unknown or other
  modified_base (380)..(380): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgccgcctctggactcacctttagtagctattggatgagctgggtccgcaggctccgaggggaaggggctgggagtggggtggccaaacagtaaaggaagatgggaagtcaagaaacnctangtggactcgtgtgaaggggccgattccaccatcctcccaagacgacaacgccaaagtaattcaagtgtatcagacaaatgaaacagcctagagacgacgaggacacgggccgtagtacttacgtggtgtagagacgaatagtcggaacgaaacgggttagaacggttaaaccggggaggggtttgtaagg

SEQ ID NO: 369861 - DNA, 562 bp, Homo sapiens
  misc_feature: GZ8MTXP02F0TRH.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctggggggaggcctgggtccaggccgggggggtccctgagactctcctgtgccgcctctggactcacctttagtagctattggatgagctgggtccgccaggctccgaggggaaggggctgggagtggggtggccaaacagtaaaaggagatggaagtcaagaaacactatgtggactcgtgtgaagggccgaattcaaccatcctaccagagaaccaacgaccaaagaacttcaagtgtaaatctagacaaatggaaacagccctggaacgagccgaggacgacggcgtgtattactgtgtgagacgacataagacctaaaggcgaacgtaaccggggaggggttgaagg

SEQ ID NO: 369862 - DNA, 634 bp, Homo sapiens
  misc_feature: GZ8MTXP02HVS0M.15.23.C01.1.454.CMB.2.raw
  modified_base (349)..(349): a, c, t, g, unknown or other
  modified_base (378)..(378): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctgggtggagtcgtgggggaggcctggtccgaggccggggggtccctgagactctcctgtcgccgcctctggactcacctttagtagctattggatgagctgggtccgccaggctccgaggggaggggctgggagtggggtgccaaanaagtaaaggagagtaggaatcaagaaacnctagtgtggacttcgtggtagaacggggtccgatttcccaacctactccctaccgaaggaacgaaccgaaacgacccaaagtaacttacgagttacgtatcctagaactaaaagtacgaaacacgtaccgtagaacggacggaccccggaagggaaccgaccgggaccggttagttaacgtttaccgtgttggtacgacgaagaactagaagaacgaacggtacggaaacgtaaccggggtaggggtttacgtagg

SEQ ID NO: 369863 - DNA, 570 bp, Homo sapiens
  misc_feature: GZ8MTXP02HWG9H.15.23.C01.1.454.CMB.2.raw
  modified_base (472)..(472): a, c, t, g, unknown or other
  modified_base (515)..(515): a, c, t, g, unknown or other
  modified_base (528)..(528): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgccgcctctggactcaccttagtagctattggatgagctgggtccgccaggctccgaggggaaggggctgggagtgggtggccaaacagtaaaggaagagtaggaagtccagaaacactatggtggactcgtgtagaagggccgattcacctatctacccagacgaaccaacgccaaagacttacagtcgtaatcttagactaaatagaaacncgacctgaaggacgccgaaggacgacggccgtagtacttacgngtggtagagacanagtaacgacgaacggtgaaacgtaaccggggagggtttgagg

SEQ ID NO: 369864 - DNA, 583 bp, Homo sapiens
  misc_feature: GZ8MTXP02HL1X3.15.23.C01.1.454.CMB.2.raw
  modified_base (556)..(556): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctgagactctcctgtgccgcctctggactcacctttagtggctattggatgagctgggtccgccaggctccgaggggaaggggctgggagtggggtggaccaaacagtaaaaggaaagagtagggaaagtcaaggaaaaccactaagtgtgggactcgtgtagaaagggggcccgattccaaccatcctccaagacgaacaaacgccaaagaattcagtgtatctagactaaaatgaacagcctagagacgccgaggacgacggccgtagtattacgtgtgtagagacgagataacggacaacggggtanaacggtaaccggggaggggttagtagg

SEQ ID NO: 369865 - DNA, 596 bp, Homo sapiens
  misc_feature: GZ8MTXP02FW330.15.23.C01.1.454.CMB.2.raw
  modified_base (528)..(528): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccggggggtccctgagactctcctgtgccgcctctggactcacctttagagctattggatgagctgggtccgccaggctccgaggggaaggggcgtggagtggggtggccaaacagtaaaaggaagagtgggaaagtcaagaaacactaatgtggactcgtggtagaacggggccgaattccaaccatcctacccaagacgaaccaaacggcccaaagaaacttcgaagttgtaatcgtagacaaaatgaaacagacctgagagccggaggacctacggccgtagtaacttcgngtggtagaagagaactagaacgaaccgtaaacgggtagaacgttaaaccgggggagggggttataagg

SEQ ID NO: 369866 - DNA, 702 bp, Homo sapiens
  misc_feature: GZ8MTXP02GQVG2.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcgttgggttttccttgttgcttattttagaaggtgtccagtgcgaggagcagcgtggtggagtcgtgggggaggccgtggtccgacgggcccggggggtcctggagactctcctgtcgccgcctctggactctacctttagtagctagttggatgagcgtcgggtcccgccgacggcctccggaaggggaaggggcggtggggaggtggggtcggaccgaaacgaaagtaaaaggaaagttttttaagaggaaagtacgaaagaaactactagtggtggtacttcgtggtaggaacgggaccgtacgttacccaacctacttaccctaccgaacgaacgaaaccgaaaccgaaccgaaagtaacttacgtagttagttatacgtagaactaaaagtacgaaacgacgaccgtaggaacggaacggaccggaacggaccgaccgggtaccgttacgttacgttacgttggtaggtacggaacggaacgaacgtaacgtaacgaaacgtaacgggtacggtaaacggtaaaccggggtacgggggttagtagg

SEQ ID NO: 369867 - DNA, 590 bp, Homo sapiens
  misc_feature: GZ8MTXP02IZKEN.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctgggtggagtcgtgggggaggcctgggtccaggccgggggggtccctgagactctcctgtgccgcctctggactcacctttagtagctattggatgagctgggtccgccagggctccgaggggaaggggctgggagtggggtggccaaacagtaaaggaagatggaaagtcaagaaaacactaatgtggactcgtgtgaacgggggccaattcaaccatcctccagacgaacaacgccaaagaattcagtgtatctagactaaaatgaaacagccctaggaagacggaccgaggtaccacgggccgtagtatttacgtggtagtaggagaagacgataacggaacgaaacggggttgaacggttaaaccggggagggggtttagaagg

SEQ ID NO: 369868 - DNA, 596 bp, Homo sapiens
  misc_feature: GZ8MTXP02GQB49.15.23.C01.1.454.CMB.2.raw
  modified_base (543)..(543): a, c, t, g, unknown or other
  modified_base (584)..(584): a, c, t, g, unknown or other
  modified_base (593)..(593): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggcccgggggggtccctggagactctcctgtcgccgcctctggactcacctttagagctattggatgagctgggtccgccaggctccgaggggaaggggctgggagtggggtcggccaaacgagtaaaaggaagagtagggaaagtcaagaaaacactaatgtgggaactcgtggtaggaaacggggccgaattccaacccatccctccaagacgaactaaacggcccaaaggaacttcgagtgtaatctgactaaaagtcgaaacagccctagacgagcccggaggtaccacgggccgtagtacttacngttgagagacgacagtgaacaacggtgaacgtaaccggggnggggtttanagg

SEQ ID NO: 369869 - DNA, 544 bp, Homo sapiens
  misc_feature: GZ8MTXP02F1TEX.15.23.C01.1.454.CMB.2.raw
  modified_base (409)..(409): a, c, t, g, unknown or other
  modified_base (433)..(433): a, c, t, g, unknown or other
  modified_base (448)..(448): a, c, t, g, unknown or other
tcagtctacgtagccacgaccggtgctcgatttagtacacgtgattagggattgggaggtctcagagatgagccttagccctggactccaaggcctttccacttggtgatcagcactgagcacagaggactcaccatggagttggggctgagctgggttttcctgttgctattttagaaggtgtccagtgcgaggagcagctggtggagtctgggggaggcctggtccaggcccgggggggtccctgagactctcctgtgccgcctctggactcacctttagtagctattggatgagcgtgggtccgccaggctccgaggggaaggggctggagtggggtggccaaacataaaaggagatagggaagtcaagaaacactatgtgactctgtgaagggccattcacatcncagagacacgcaagatcagtgtanctgacaaatgaaacngcctggagaggcccgaaggacccacgggccgtagtacttacgtgtgtagagagacaatacggaacaacgggtgaacgtaaccggggaggggtttag

SEQ ID NO: 369870 - DNA, 610 bp, Homo sapiens
  misc_feature: GZ8MTXP02GR77X.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctggagactctcctgtcgccgcctctggactcacctttagtagctattggatgagctgggtccgcagggctccgaggggaaggggctggaggtgggtggccaaacagtaaaggagatggaagtcaagaaacactatgtggactctggtgaacggggcgattccacatcctccagagaccaacgcccaaagaacttcgagtgtaatcctagactaaagtgaaacagcctaggacggacgacccggaggaaccgacggggacccgttagtactttacgtggttaggtacgaggtaacgacgaagtaacggtaaaccgaaacggggttagaaaccggtaaaaccgggggtgggggtttacggaaggg

SEQ ID NO: 369871 - DNA, 647 bp, Homo sapiens
  misc_feature: GZ8MTXP02GGMCK.15.23.C01.1.454.CMB.2.raw
  modified_base (385)..(385): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtgggtccgagggcccggggggtccctggacgactctcctgtcgccgcctctggactcacctttagagctattggatgagcgtgggtccgccaggctccgaggggaaggggctgggaggtgggtggccaaacagtaaaaggagataggaagtcaagaaacnctaatgtgggactcgtggtagaacggggccgtattccaaccctattccctaccaaggaacgaaccaaaaccgcccaaaaggtaacttccaaggttgttaaactccgttggaaacctaaaagttcgaaaaccacgccccgtaggaacgacggaccggaggaacccgacggggtcccgttaggttaactttcgtaggttgagaacgagaacagtaacggaactaaacggggtgaacgtaaaccgggggtaggggtttagaacgg

SEQ ID NO: 369872 - DNA, 660 bp, Homo sapiens
  misc_feature: GZ8MTXP02HBOQ3.15.23.C01.1.454.CMB.2.raw
  modified_base (268)..(268): a, c, t, g, unknown or other
  modified_base (618)..(618): a, c, t, g, unknown or other
  modified_base (657)..(657): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccgaggccggggggtcctgagactctcctgtgccgcctcgnggactcacctttagagctagttggatggagcgtgggtcccgcgagggcctccggaaggggaaggggctggggaggttggggtacggaccaaacgaaagtaaaaggggaagtacgtgggaaagtcgaaaggaaaacactaagttgggtcggacttcgtggtagggaacgggggccctaatttcccgaaacccattccctacgaaggacgaaaccgtaaaccgcccaaaagtaaactttcgagttagttaaattccgtagaacctaaaaagtcggaaaaccgacgtaccgtaggaacggacgaccggaaggtaccgaccggtcgttagttacttacgtgtagacggagacanagtcggaaacgaacggtagaacggtaacggggtggttanacg

SEQ ID NO: 369873 - DNA, 587 bp, Homo sapiens
  misc_feature: GZ8MTXP02GXONG.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggggggaggccgtgggtccagggcccgggggggtcccctggagactctcctgtgcccgcctctggactcacctttagtagctattggatgagcgtgggtccgccaggctccgaggggaagggctgggagtggggtggccaaacaagtaaaaggaagataggaagtcaagaaaacactaatgtggactctagtgaacgggccgaattccaaccatcctaccagagaccaacgccaaagaattcgagttgtatctagactaaaatgaaacagccctaggacgagacccggagaccgacgggccgtgtaattactggtagtgaagacgaacagtaacggaacgtaacggtagaacggtaacggggtagggttagag

SEQ ID NO: 369874 - DNA, 587 bp, Homo sapiens
  misc_feature: GZ8MTXP02I44XY.15.23.C01.1.454.CMB.2.raw
  modified_base (392)..(392): a, c, t, g, unknown or other
  modified_base (427)..(427): a, c, t, g, unknown or other
  modified_base (431)..(431): a, c, t, g, unknown or other
  modified_base (584)..(584): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgagggcccgggggggtccctgagactctcctgtcgccgcctctggactcacctttagtagctattggatgagcgtgggtccgccaggcctccgaggggaaggggctgggaggtggggtcggaccaaacgaagtaaaaggaagatagggaagtcaagaaacnctatgtggactcgtagtgaagggccgattcaaccntccnccagagacaacgccaaagacttcgagttgtatctagacaaaatcgaaacagccctaggacgacggacccgaagggaccgacgggcccgttagtactttacgtggtggtagagacgacagtgaacgaacggtgaacggtaacggggaggggttnagg

SEQ ID NO: 369875 - DNA, 607 bp, Homo sapiens
  misc_feature: GZ8MTXP02JR388.15.23.C01.1.454.CMB.2.raw
  modified_base (260)..(260): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttctgtgctatttagaaggtgtccagtgcgaggagcagctggtggagtctgggggaggcctggtccagccggggggtccctgagactctcctgtgccgcctngctctacttagagctagttggatgagcgtcgggtccgccgaggtcccacgggaaggggacgggtcgtaggggtgggtggggtaccggaaccaaagtaaaggtaaaaggaagtaggaagggtagacgaaacgaaactactagtgtcgtactggtgtagggacggtactactaccactactccgacgaagacgaaaccgaccaacgaaagtactgtagtattactgtagaactaagacgaacgacgacgagacggacggacggacggacgacggtacgtacgttacgttagtgtagagacgacgagagaacgaacgtaacgtacggtaacggtaacgggtacggtagtg

SEQ ID NO: 369876 - DNA, 593 bp, Homo sapiens
  misc_feature: GZ8MTXP02HQKZ9.15.23.C01.1.454.CMB.2.raw
  modified_base (538)..(538): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttccttgttgctattttagaaggtgtccagtgcgaggagcagctggtggagtcgtgggggaggcctggtccgaggccggggggtccctgagactctcctgtgccgcctctggactcaccttagagctattggatgagcgtgggtccgccaggctccgaggggaaggggctgggagtgggtggaccaaacgaagtaaaaggaagagtacggaaagtcaaagaaaacacgtaatgtggactcgtgtaggaaacggggccaattccaacctatcctacccaagaacgaaccaaacgccctaaaaggaacttacagttagtaatccgtagaactaaaatgaaacagccagagacgccgaagactacgggctagtacttacgngtgagacgacgacagaacgaacgaacggtacgaacggtaacgggtagggttagag

SEQ ID NO: 369877 - DNA, 600 bp, Homo sapiens
  misc_feature: GZ8MTXP02GEAKW.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggggggaggcctgggtccgaggccggggggggtccctggagactctcctgtgccgctctggactcacctttagagctattggatgagctgggtccgccaggctccgagggaggggctggagtggggtggccaaacagtaaaaggaagagtggaaagtcaagaaaacactaatgtggactcgtggtagaacgggggccgaatttccaacctaatcctacccgaagaacgaacaaacgacccaaaggaaattaccaagtgtaatcctagacaaatagaaacagaccctgaggagacccggaggaacacgggcccgtagtattacgtgtagtagagaacgacaagtgaacgaacgggtagaacgtaaaccgggagggggttacgtaagg

SEQ ID NO: 369878 - DNA, 609 bp, Homo sapiens
  misc_feature: GZ8MTXP02FVP7K.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggggggaggccgtgggtccgaggccgggggggtccctgagactctcctgtcgcccgcctctggactcacctttagtagctattggatgagcgtgggtccgccaggcctccgaggggaaggggcgtgggaggtggggtcggaccgaaacaagtaaaggaagagtaggaagtacaagaaacactagtgtgggactctggtagaacggggccgtattccaccatcctccaagacgaaccaacgaccaaagaattcagtgtatctagactaaatgaaacagccctaggacgacggacccggaggtaccgacgggtccgtagttatttactggttggtaggagaacgacgaatcggaaactaacgggtggaaacgtaaaccgggggaggggtttgtaagg

SEQ ID NO: 369879 - DNA, 651 bp, Homo sapiens
  misc_feature: GZ8MTXP02HXUZ5.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttccttgttgctattttagaaggtgtccagtgcgaggagcagctggtggagtcgtgggggaggcctggtccgaggccgggggggtccctggagactctcctgtgccgccctctggactcacctttagtagctattggatgagctgggtccgccaggctccgaggggaaggggctgggaggtggggtggacccaaacgaagtaaaagggaagagtagggaaagtcgaagaaaacactaagtgtggggacttcgtggtagaacgggggccgaatttccaaccctatcctcccgaagacgaacaaacgccaaagaaattcagtgtatctagactaaaatgaaacagaccctggaacgacggacccggaagggaacccgaaccggggtcccggttagttaacgttttaacgtgggttaggtacggaacgacggtaacagtaacggaacgaaacggggttagaacggtaaaccgggggtaggggtttacggtaagg

SEQ ID NO: 369880 - DNA, 555 bp, Homo sapiens
  misc_feature: GZ8MTXP02IT7WE.15.23.C01.1.454.CMB.2.raw
  modified_base (380)..(380): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtcctgagactctcctgtgccgcctctggactcacctttagtagctattggatgagctgggtccgcaggctccgaggggaaggggctgggagtggggtggccaaacagtaaaggaagatggaagtcagaaaacactatgnggactctgtagaaggggccgattccacatctcagagacaacgaccaagaatacagtagtatactgacaaatagaacacgaccgtttagagacgacggacggacgacggccgtagtattacgtgtgtagacgagacagtaagacgaacggtagaacgtaaccggtagggtagtagg

SEQ ID NO: 369881 - DNA, 627 bp, Homo sapiens
  misc_feature: GZ8MTXP02G2J0I.15.23.C01.1.454.CMB.2.raw
  modified_base (308)..(308): a, c, t, g, unknown or other
  modified_base (350)..(350): a, c, t, g, unknown or other
  modified_base (383)..(383): a, c, t, g, unknown or other
  modified_base (475)..(475): a, c, t, g, unknown or other
  modified_base (498)..(498): a, c, t, g, unknown or other
  modified_base (560)..(560): a, c, t, g, unknown or other
  modified_base (625)..(625): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtcctgagactctcctgtcgccgcctcgtggactcacctttagtagctattggatgagctgggtccncaggcctccgaggggaagggctgggagtggggtcgaccaaanaagtaaaaggaagatagggaatcaagaaaaccntaatggtacgggactcgtggtagaacggggcctattccaacccattcccaccgaagaacgaaccaaacgcccaaaagtactttacgaggttntaatctagactaaaatgaaaacngacctaggaacgacgggacccggtaaagggacccgaacgggtcccgtttagtaactttacgnggtaggtagagaacggaacagtgaaaccgaaacgggttgaaacgtaaaccgggggtggggtttanag

SEQ ID NO: 369882 - DNA, 635 bp, Homo sapiens
  misc_feature: GZ8MTXP02FX0FI.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctgagactctcctgtcgccgcctctggactcacctttagtagctattggatgagcgtgggtccgccaggctccgaggggaaggggctgggaggtgggtggccaaacagtaaaaggaagagtagggaaagtcaagaaaacactatggtggactcgtagtagaacggggtccagttccaccatcctacaagacgacaaacgccaaagaacttcagtgtatctgacaaatgaaacagacccgtaggaagacggaccggaagggaaccgaccggggtcccgttagggttactttaccggttggttaggttaggaacgaacgacgaagttaacggaaacgtaaaccggggttaggaaaccggtaaaaccgggggtagggggtttactaacgggg

SEQ ID NO: 369883 - DNA, 556 bp, Homo sapiens
  misc_feature: GZ8MTXP02GKIW5.15.23.C01.1.454.CMB.2.raw
  modified_base (419)..(419): a, c, t, g, unknown or other
  modified_base (463)..(463): a, c, t, g, unknown or other
  modified_base (466)..(466): a, c, t, g, unknown or other
  modified_base (518)..(518): a, c, t, g, unknown or other
  modified_base (520)..(520): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccaggccgggggggtccctgagactctcctgtgccgcctctggactcacctttagtagctattggatgagctgggccgccaggctccagggaaggggctgggagtggggtggccaaacataaaaggaaagatggaaagtcagaaaacactaatgtgggaactctaggtgaaaggggcccgattcacccatcnccaagagaaccaaacgccaaaagaaattcaagtgtaatctgaanaanagaacagacagagagacgagacgacgacgtacgtattactgtgtagagagananaagaacgaacgacgaagtaacggtacgggtaggtag

SEQ ID NO: 369884 - DNA, 639 bp, Homo sapiens
  misc_feature: GZ8MTXP02H43WH.15.23.C01.1.454.CMB.2.raw
  modified_base (308)..(308): a, c, t, g, unknown or other
  modified_base (348)..(348): a, c, t, g, unknown or other
  modified_base (632)..(632): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctcctgtcgccgcctctggacctcacctttagtagctattgatgagctgggtccnccaggctccgaggggaggggctgggagtgggtggccaaanagtaaaggagatggaagtcaagaaacactagtgtggactgtggtagaacgggccgattccacccatcctacccgagaacgacaacgtaccaaagtaacttcagtgttatacttgactaaatagaaacacgtacctaggaacggaccggacccggaagggaccgaccggggtacccggttagttaacgtttaccggtgtagggttacggaaggaacgaacgtaagtaacggaaaccggtaaaccgggtagggtaaaacgtaaccccgggggtaaggggggtttanaacgggg

SEQ ID NO: 369885 - DNA, 695 bp, Homo sapiens
  misc_feature: GZ8MTXP02IHXJ1.15.23.C01.1.454.CMB.2.raw
  modified_base (623)..(623): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctgggtggagtcgtgggggaggcctggtccgacgggccgggggggtccctgagactctcctgtcgcccgcctctggactcacctttagagctattggatgagcgtgggtcccgccagggcctcccgaaggggaaggggctgggaggtggggtcggaccaaacgaaagtaaaagggaaagagtaggggaaagtaccaaaggaaaaaccacttaagttggtggggtaaccttcgtgggtacggaaacgggggccctaaatttcccaaaccctatccctacccgaaggaaacgaaacccgaaaccggaccccaaaagtaactttaccgaaagtcgttaaacttccgtaggaacctaaaattacggaaacctacgcccgtagagacggacccggaagaccgaccgggtccgttaggtaatttacgngttaggagacgaagacagtaacggaaacgaacgggttagaaacggttaaccggggtagggggtttatacggg

SEQ ID NO: 369886 - DNA, 623 bp, Homo sapiens
  misc_feature: GZ8MTXP02GIVEL.15.23.C01.1.454.CMB.2.raw
  modified_base (355)..(355): a, c, t, g, unknown or other
  modified_base (464)..(464): a, c, t, g, unknown or other
  modified_base (501)..(501): a, c, t, g, unknown or other
  modified_base (509)..(509): a, c, t, g, unknown or other
  modified_base (515)..(515): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttcctgtgctattttagaaggtgtccagtgcgaggagcagctggtggagtcgtgggggaggccgtggtccaggccggggggtccctgagactctcctgtcgccgcctctggactcacctttagagctagttggatgagctcgggtccgccaggctccggaaggggaaggggcgtgggaggtggggtcggacccaaanaaagtaaaagggaaagagttaacggggaaagttaccgaaaggaaaacctacgtaagtcggttggggacttcgtggtaggaaacgggggccctattcccaacctattccncccgaaaggacaaacccgaacgcaaagtattacagtntaatcaanaacaanacgaacgacgacgagacgacgacgacgacgacgtacgtacgtagttagtgtagagacgacgagagaacgaacgaacggtacggtaacggtaacgggtacggtaggtag

SEQ ID NO: 369887 - DNA, 568 bp, Homo sapiens
  misc_feature: GZ8MTXP02GJPPZ.15.23.C01.1.454.CMB.2.raw
  modified_base (348)..(348): a, c, t, g, unknown or other
  modified_base (423)..(423): a, c, t, g, unknown or other
  modified_base (461)..(461): a, c, t, g, unknown or other
  modified_base (500)..(500): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtcgccgcctctggactcacctttagagctagttggatgagctgggtccgccaggcctccgaggggaaggggctggagtgggtggccaaanataaaggaagatagggaagtcaagaaacactagtgtggactctggtagaacggggccgtattccaaccgattccnccgaagacgacaaacgccaaagacttacgagttgtaancgtgacaaaagtcgaaacagcctagagagccgaggaccncggcgtagtacttcgagtgagacgagacatcgaacgaacggtgaacgtaaccggggtagggttacagg

SEQ ID NO: 369888 - DNA, 609 bp, Homo sapiens
  misc_feature: GZ8MTXP02HP6JN.15.23.C01.1.454.CMB.2.raw
  modified_base (392)..(392): a, c, t, g, unknown or other
  modified_base (429)..(429): a, c, t, g, unknown or other
  modified_base (492)..(492): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggcccgggggggtccctggagactctcctgtgccgcctcgtggactcacctttagtagctagttggatgagctgggtccgcaggctccgaggggaggggctggaggtgggtggccaaacgaagtaaaggaagagtagggaagtcaagaaactacttagnggtgggactcgtggtagaacggggccattcccaactntcctacccgaagacgaaccaacgacccaaagtaactttcagtacgtatcgttagacttaaaangaaactagaccgaggagacggccggaaggaccgacgggtcccgttagtactttaacggcgtagagaacgacacagtaacgaacggaacggtacgtaacggtacgggtaggttagtag

SEQ ID NO: 369889 - DNA, 578 bp, Homo sapiens
  misc_feature: GZ8MTXP02IY6YE.15.23.C01.1.454.CMB.2.raw
  modified_base (380)..(380): a, c, t, g, unknown or other
  modified_base (567)..(567): a, c, t, g, unknown or other
  modified_base (576)..(576): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccaggccgggggggtccctgagactctcctgtgccgcctctggactcaccttagtagctattggatgagctgggtccgccagggctccgaggggaaggggctgggagtggggtggccaaacagtaaaaggaagatgggaaagtcaagaaaacnctaatgtgggacttctggtagaaggggcccgaatttccaaccctatcctacccaagacgacaaacgccaaagaattcagtgtaatctagacaaaatcgaaacagaccctgaagacgaccgaggaacacgggccgtagtacttacgtgtagtgagagacagtcgaacgaacggtgaagtaaccggggnggggtttanag

SEQ ID NO: 369890 - DNA, 557 bp, Homo sapiens
  misc_feature: GZ8MTXP02JMCDU.15.23.C01.1.454.CMB.2.raw
  modified_base (377)..(377): a, c, t, g, unknown or other
  modified_base (505)..(505): a, c, t, g, unknown or other
  modified_base (532)..(532): a, c, t, g, unknown or other
  modified_base (554)..(554): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccaggccgggggggtccctggagactctcctgtgccgcctctggactcacctttagtagctattggatgagctgggtccgccaggctccgagggaggggctggagtggggtggccaaacgataaaaggagagtacggaagtcagaaaacnctaatgtcggactctgtgaaagggccattcaccatctccagacgacaacgccaaagaacttcagtgtatctgacaaaatcgaaacagaccctagagacgaccgaggacacgggccgttagtacttacngtgtgacgagacaagtgacctaacggngaacgtaaccgggaggggttanagg

SEQ ID NO: 369891 - DNA, 580 bp, Homo sapiens
  misc_feature: GZ8MTXP02FKY52.15.23.C01.1.454.CMB.2.raw
  modified_base (499)..(499): a, c, t, g, unknown or other
  modified_base (542)..(542): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtcgccgcctctggactcacctttagagctattggatgagctgggtccgccaggctccgaggggaaggggctgggagtggggtggaccaaacaagtaaaaggaaagatcgggaaagtcaagaaaacactaatggtgggactcgtagtggaaagggggcccgaattccaacctatcctcccaagagacaaaccgccaaagaattcagtgtaatctagacaaaatgaaacagcccgtgaacgngaccgaaggacaacggccgtagtacttatgtggtcgagacganagaagacgaacgacgaagtaacgggtacgggtaggtag

SEQ ID NO: 369892 - DNA, 606 bp, Homo sapiens
  misc_feature: GZ8MTXP02HG6I6.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccgaggccggggggtccctgagactctcctgtcgccgcctctggactcacctttagtagctattggatgagctgggtccgccaggctccgaggggaaggggctgggagtggggtggaccaaacgaagtaaaaggaagagtagggaaagtcaagaaaaccatagtggtgggacttcgtaggtacggaaggggcccgaattccaaccctatcccgtaccaagacgaccaaacgacccaaagtaacttcagttgtatctagacaaaatgaaacagccctaggacgagacccggaggaccgtacggcccgttaggactttacgtgtaggtagagtacgacataaggaacaacgggtgaacgtaaccggggaggggtttagagg

SEQ ID NO: 369893 - DNA, 588 bp, Homo sapiens
  misc_feature: GZ8MTXP02I24W1.15.23.C01.1.454.CMB.2.raw
  modified_base (414)..(414): a, c, t, g, unknown or other
  modified_base (438)..(438): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccaggccgggggggtccctgagactctcctgtgccgcctctggactcacctttagtagctattggatgagctgggtccgccaggctccgaggggaaggggctgggagtgggtggccaaacagtaaaggaagatgggaagtcagaaacactatgtggactctgtgaagggcattcaccatctccaganacaacgccaaagaattcagtgtanctgacaaatgaaacagcctagagacggaccgaggtaacgacggacccgtaggtaactttaccgtaggttcgttacgaaggaacgacgtaagtcggaaacgtaaaaccggggttgaaacggttaaacccgggggagggggtttactaaggg

SEQ ID NO: 369894 - DNA, 721 bp, Homo sapiens
  misc_feature: GZ8MTXP02H2PQG.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggcccggggggtccctggacgactctcctgtcgcccgcctctggacctcaccttagtagctagttggatgagcgtgggtcccgccgagggcctacccggaaggggaaggggcgtaggggaggtggggtacggacccaaagaaagtaaaagggaagagtagggaaagtacgaaggaaaacacgtagtggtggtaccttcgtaggttagggaaacggggtacccgtaatttacccgaaaccctagtacccgttacccgaagggaaacgaaacccgaaacccggaccctaaaaggtaaactttaccgagttagtacttaccgttagaacctaaaagtacgaaaaccgcgacctaaggagaacggacccgggaaggaccgtaccgggtccgttagtaaacgttttcggagttcggtaggaagtacgaactagtaacggaaacgtaaacggggtagaaaacggtttaacccgggggaaggggttttagaaggg

SEQ ID NO: 369895 - DNA, 543 bp, Homo sapiens
  misc_feature: GZ8MTXP02J0V6B.15.23.C01.1.454.CMB.2.raw
  modified_base (374)..(374): a, c, t, g, unknown or other
  modified_base (377)..(377): a, c, t, g, unknown or other
  modified_base (384)..(384): a, c, t, g, unknown or other
  modified_base (397)..(398): a, c, t, g, unknown or other
  modified_base (441)..(441): a, c, t, g, unknown or other
  modified_base (481)..(481): a, c, t, g, unknown or other
  modified_base (532)..(532): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctggagactctcctgtcgccgcctctggactcacctttagtagctattggatgagctgggtccgccaggctccgagggaggggctggagtgggtgccaaagagtaaaaggagatcggaatcagaaacntangtgatcngtgaggcatcacnnctccagacacacgacaagatcagtgtatctagacaaagtgaanagcctaggacgcgacgaggacacgggcgtcgtaattacgnggtagtagacgaggactagtcgaacggtaacgtgaaacggtaaaccggggnggggttatagg

SEQ ID NO: 369896 - DNA, 566 bp, Homo sapiens
  misc_feature: GZ8MTXP02F9PIQ.15.23.C01.1.454.CMB.2.raw
  modified_base (505)..(505): a, c, t, g, unknown or other
  modified_base (511)..(511): a, c, t, g, unknown or other
  modified_base (560)..(560): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgagggccggggggtccctggacgaccctcctgtcgccgcctctggactcaccttagtagctatggatgagcgtgggtccgccaggctccgaggggaaggggcgtggaggtggggtggaccaaacgaagtaaaggaagataggaagtacagaaacactatgtggactcgtgtggaaggccgtatccaccatctacccagaacgacaacgccaaagtaatcagtgtatctgacaaatgaacagcctgagcgcgaggtacacggcgtagtactacgngttagngagacgacatagaacgtacggtagacgtaaaaccggggtggggtttaanacgtgg

SEQ ID NO: 369897 - DNA, 557 bp, Homo sapiens
  misc_feature: GZ8MTXP02FRV29.15.23.C01.1.454.CMB.2.raw
  modified_base (553)..(553): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggcccgggggggtccctgagactctcctgtgccgcctctggactcacctttagagctattggatgagctgggtccgccaggctccgaggggaaggggctgggaggtggggtggccaaacagtaaaaggaagatggaagtcaagaaacactatgtggactctgtgaagggcgattcaccatcctcagacgacaacgccaaagaacttcagtgtatctagacaaaatgaaacagccctagaagagacccgaaggaccgcggaccggtgtattacgtggtgtagagagacagtggaacaaggtagaagtaaccggggagggttnaagg

SEQ ID NO: 369898 - DNA, 558 bp, Homo sapiens
  misc_feature: GZ8MTXP02HYWCV.15.23.C01.1.454.CMB.2.raw
  modified_base (311)..(311): a, c, t, g, unknown or other
  modified_base (346)..(346): a, c, t, g, unknown or other
  modified_base (356)..(356): a, c, t, g, unknown or other
  modified_base (370)..(370): a, c, t, g, unknown or other
  modified_base (373)..(373): a, c, t, g, unknown or other
  modified_base (458)..(458): a, c, t, g, unknown or other
  modified_base (463)..(463): a, c, t, g, unknown or other
  modified_base (504)..(504): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccgaggcccgggggggtccctgagactctcctgtcgccgcctctggactcacctttagtagctattggatgagcgtgggtccncaggctccgaggggagggctggagtgggtgccaanagtaaagganatggatcagaaacntangtggactgtgtagaacgggcattccacctatcctacagacgacaaacgccaaagtaattcagtgtatctgactaaaagcgaaacngccgngaacggacgaccggaaggacctacgggccttagtattacgngtaggtagagagacataagacgaacggtacgagtaaccggtacgggtaggtagg

SEQ ID NO: 369899 - DNA, 702 bp, Homo sapiens
  misc_feature: GZ8MTXP02H4VHN.15.23.C01.1.454.CMB.2.raw
  modified_base (270)..(270): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggcccggggggtccctgagactctcctgtcgccgcctntggactcaccttagtagctattggatgagcgtcgggtccgccgagggcctccgagggggaacggggctggggaggtggggtcggacctaaacaagtaaaaaggggaagagtaggaaaagtcaaagaaaacactaagtgtgggactcgtggtacggaacggggccctaattcccaaaccctagtaccctacccgaaaggacgaaaccctaaaccgaccgtaaaagaaactttcgagttgtaaacttcctaggaaactaaaagtacgaaacacggtaccaggaacgacggaccggtaacgggaccccgaacggggtcccgtttaggttaaactttaccgttggtacgggttagaaggtacggaactaaggtaacggaaaccgtaaaaggggtacggtaaaccgggttaaaccgggggtaggggtttaacgtagg

SEQ ID NO: 369900 - DNA, 564 bp, Homo sapiens
  misc_feature: GZ8MTXP02JCKRH.15.23.C01.1.454.CMB.2.raw
  modified_base (511)..(511): a, c, t, g, unknown or other
  modified_base (562)..(562): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggggggaggcctgggtccaggcccgggggggtccctggagactctcctgtcgccgcctctggactcacctttagtagctattggatgagctgggtccgcaggctccgaggggaaggggctgggaggtggggtggccaaacagtaaaaggaagatggaagtcaagaaacactatgtgggactcgtgtggaagggccgattccaccatctccaagacgaacaacgcccaaagaattcagtgtaatcgtagactaaatgaaacagcctagagagaccgaggacacggccgtagtattacngtagtgagagacagtgacgaaacgggtgaaagtaccggggagggggtttanag

SEQ ID NO: 369901 - DNA, 566 bp, Homo sapiens
  misc_feature: GZ8MTXP02FMIG7.15.23.C01.1.454.CMB.2.raw
  modified_base (520)..(520): a, c, t, g, unknown or other
  modified_base (541)..(541): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgtgaggagcagctggtggagtctggggggaggcctgggtccaggccggggggtccctgagactctcctgtgccgcctctggactcacctttagtagctattggatgagctgggtccgccagggctccgaggggaaggggctgggagtggggtggccaaacataaaagggaagatgggaaagtcaagaaaacactaatggtggactctaggtgaaagggggcccgaattccaacccatcctacccagacgaacaacgcccaaagaattcagtgtatctgacaaatgaaacagcctgaagagccgaggacacgggccgtagtattactgtgngagagacatgaaccaacggtnaacgtaaaccggggaggggttgaag

SEQ ID NO: 369902 - DNA, 646 bp, Homo sapiens
  misc_feature: GZ8MTXP02G2PX3.15.23.C01.1.454.CMB.2.raw
  modified_base (584)..(584): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgagggccggggggtccctgagactctcctgtcgccgcctctggactctaccttagtagctattggatgagcgtcgggtcccgccgaggcctccggaggggaaggggctggggaggtggggtcggaccaaagaaagtaaaaggaagagtagggaaagtacaaagaaaactactagtggtggactcgtagtagggaacggggccgtattccaaccctattccctacccgaagaacgaaacccaaaccggacccaaaagtaactttacgagttacgtaatccgtagaactaaaagtcgaaaacacgccgtaggaacggaacggccggaaggaccgacgggccgttagtacttacgnggtgtagagacacgagtcgaaacgtaaggtacgaaacggtaaccggggaggggtttacgtag

SEQ ID NO: 369903 - DNA, 610 bp, Homo sapiens
  misc_feature: GZ8MTXP02IJ416.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgccgcctctggactcacctttagtagctattggatgagcgtgggtccgccgaggcctcccgaaggggaaggggctggggaggtggggtcggacccaaacgaagtaaaaggaaagagtagggaaagtcgaagaaaacactatgtgggactcgtggtagaacggggccgattcaccctatcctaccagacgaacaacgaccaaagaattcagtgtatctagacaaatgaaacagcctagaagacgaccggaggaaccgtacgggccgttagtaacgtttactaggttgagacgagaacgataacggaaccgaaacgggttcggaaacgtaaccggggtagggggttagtaagg

SEQ ID NO: 369904 - DNA, 750 bp, Homo sapiens
  misc_feature: GZ8MTXP02H92HQ.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccgggggggtccctgagactctcctgtcgccgcctctggactcacctttagtagctattggatgagctgggtccgccaggctccgaggggaaggggcgtgggagtggggtcggccaaacgaagtaaaaggaagagtagggaaagtcaagaaaacactaagtgtgggaacttcgtaggttaggaaacggggcccgtaatttcccaaaccctaactcccgtacccgaaggacgaaaccgaaacccgacccgaaaaggtaaactttccgaagtttaggtaaacttccgttaggaacctaaaaagttcggaaaaccacggaccccgttaggaaacgggacgggaccccgggtaaacggggaacccgtaacccgggggaccccggtttaggttaaacggtttttaccgtcgggttagggttaggaaacgggtaaagaacccgtaaagtaaccggaaaaccgtaaaccggggttaggaaaaccggttaaaacccgggggtagggggtttaacggtaacggg

SEQ ID NO: 369905 - DNA, 689 bp, Homo sapiens
  misc_feature: GZ8MTXP02GLLDU.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttccttgtgctatttagaggtgtccagtgcgaggagcagcgtgggtggaggtcgtgggggaggccgtgggtccgagggcccgggggggtccctggagactctcctgtgcccgcctctggactcacctttagtagctattggatggagcgtgggtcccgccagggcctccggaaggggaaggggctgggaggtggggtcggaccaaacgaagtaaaagggaaagagtaggggaaagtccgaaagaaaacactaagtgggtgggaacctgtggtaggaacggggccgtaatttccaaccattccctacccgaagaacgaaaccaaaccggacccaaaaggtaaacttcgaaagtgttaaatctagaacaaaagtgaaactaggaccctagaacggacggacccggaagggtaaccgaccggggtccgttagggttaaactttaccgtaggttaggtagaacggaagtaaccagtaacggaaccgtaaaacgggtaggaaacggtaaaacccgggggtagggggttacgtaagg

SEQ ID NO: 369906 - DNA, 550 bp, Homo sapiens
  misc_feature: GZ8MTXP02I9RXP.15.23.C01.1.454.CMB.2.raw
  modified_base (305)..(305): a, c, t, g, unknown or other
  modified_base (373)..(373): a, c, t, g, unknown or other
  modified_base (376)..(376): a, c, t, g, unknown or other
  modified_base (407)..(407): a, c, t, g, unknown or other
  modified_base (462)..(462): a, c, t, g, unknown or other
  modified_base (521)..(521): a, c, t, g, unknown or other
  modified_base (537)..(537): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccggggggtccctgagactctcctgtgccgcctctggactcacctttagtagctatggatgagctgggccncaggctccgaggggaggggctggagtggggtggccaaacgataaagggaagatggaagtcagaaaacntangtggactcgtgtagaagggcattcacatccncagacgacaacgccaaagtacttcagtgtatctgacaaatgaaacagcctagagngaccgaggacacggccgtagtacttacgtgtgtagagacgacagtaagacgaacgggtnaacggtaaaccggggnggggttactaagg

SEQ ID NO: 369907 - DNA, 558 bp, Homo sapiens
  misc_feature: GZ8MTXP02G3XE8.15.23.C01.1.454.CMB.2.raw
  modified_base (397)..(397): a, c, t, g, unknown or other
  modified_base (527)..(527): a, c, t, g, unknown or other
  modified_base (529)..(529): a, c, t, g, unknown or other
  modified_base (531)..(531): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggtttccttgttgctattttagaaggtgtccagtgcgaggagcagctggtggagtcgtgggggaggcctggtccaggccgggggggtccctgagactctcctgtgccgcctctggactcacctttagtagctatggatgagctgggtccgccaggctccgaggggaaggggctgggagtggggtggaccaaacaagtaaaaggaaagagtagggaaagtacaagaaaacactatgtggactntgtgaagggccattcaaccatcctccagagaacgaacgccaaagaattcaagtgtaatctagacaaaagtgaaaccagcctaggacgagcccgaaggaccgacggccgtagtattacgtgtgtgaggaanananaagacgaacgagagaacggaggtagag

SEQ ID NO: 369908 - DNA, 658 bp, Homo sapiens
  misc_feature: GZ8MTXP02H1UP6.15.23.C01.1.454.CMB.2.raw
  modified_base (590)..(590): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctgagactctcctgtcgccgcctctggactctacctttagtagctattggatgagcgtcgggtcccgccgaggtcctacccggaagggggaaggggcgttggggacggttggggtcggaccaaacgaagtaaaaagggagatagggaaagtccaagaaaaccataagtggtgggaccttcgtggtagaacgggggccctattacccgaccctatccctaccgaagaacgaaccgtaaacgcccaaaagtaacttccgaagttgtaaattcgagaacaaaatcgaaacacgccgtaggaacgacgccggaaggacccgtacgggtaccgttagttaactttacgnggttaggagacgaagacagttaacggaaaccgtaacggtgaaacggtaaccggggtaggggtttcagg

SEQ ID NO: 369909 - DNA, 892 bp, Homo sapiens
  misc_feature: GZ8MTXP02F2F8W.15.23.C01.1.454.CMB.2.raw
  modified_base (204)..(204): a, c, t, g, unknown or other
  modified_base (210)..(210): a, c, t, g, unknown or other
tcagtctacgtagccacgaccggtgctcgatttagtacacgtgattagggattggggaggtctcagagaggagccttagccctggactccaaggcctttccacttggtgatcagcactgagcacagaggactcaccatggagttggggctgagcgtgggttttcgtgtaggctattttagaaggtgtcagtgcgaggagcgagngtgggnggtcgtgggtgggggcgtcgtcggcgcgggggtcccgggggtccagacgtctcctcgtgcgcccgtctcgtacgtacctaccttaaccgtttaggaccgtattaggttaggtaagtacggacgtcggttccgggtccccgaaccggacggtcccgtaccggggaaaggggggaaccggtgggtagggtaggggttggggtcggaaccgaaaccgtaaaaggtaaaagggaaaaggaaggtaacggttaaacggtaacgaaaaggaaaaccgtaaacttaagttacgggtagggtaccgttcggttacgggttaaaggggtaaccggggaaccgggttacgttaacccgaaaccgtaaaccgttccctaccgaaacgggaaacgaaaccgaaacccgaaacccgaaaacgttaaacgttaacgttaacggttacgttacgtttaaacgtaacgtaaacgtaaacgtaaacgaaacgtaaccgtaaccgtaacggaacggaaccgggaaccgggaaccggtaaccgggtaaccgggttaccggttaacggtttaacgtttaacggttacggttacggtaacggtaacggtaaacgtaacgtaaacggtaaacggtaaaacgggtaaacgggtaaacgggtaaaaccggggttaaacggggttaacggggttaacggttaacggg

SEQ ID NO: 369910 - DNA, 551 bp, Homo sapiens
  misc_feature: GZ8MTXP02I851H.15.23.C01.1.454.CMB.2.raw
  modified_base (375)..(375): a, c, t, g, unknown or other
  modified_base (448)..(448): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtcgccgcctctggactcacctttagtagctattggatgagctgggtccgccaggctccgaggggaaggggctgggagtggggtgccaaacgagtaaaggagatggaagtcagaaacnctaatgtgggactcgtgtagaaggggccattccaccatcctccagagacaacgccaaagacttcagtgtatcngacaaatgaacagcctagagagccgagacacgggcgttagtattacgtggtgtagacgagacataaggaacaaacggtgaacgtaaccgggaggggttgtaag

SEQ ID NO: 369911 - DNA, 693 bp, Homo sapiens
  misc_feature: GZ8MTXP02JOXZ5.15.23.C01.1.454.CMB.2.raw
  modified_base (439)..(439): a, c, t, g, unknown or other
  modified_base (447)..(447): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctgagactctcctgtcgccgcctctggactcacctttagtagctattggatgagcgtcgggtccgccaggcctccgaggggaaggggcgtgggaggtggggtggaccaaacgaaagtaaaggaaagagtaggaagtacaaagaaaacactaagtgtggtactcgtgtaggaacggggcctacgttccaacccngttacccncccgagaacgaacccgaaaccgcccaaaagtaactttccgaaggttacgttaaattccgttaggaaaccctaaaagtacggaaacacggcccttaagggaacggaccggaccggtacgggaaacccgaccggggacccgttagttaaccttttacggtacgggtagtaggaacggacgaccaagttaaccgaaacggttaaacgggaggtaaaccggtaaaccgggggtaggggtttacgtaaggg

SEQ ID NO: 369912 - DNA, 667 bp, Homo sapiens
  misc_feature: GZ8MTXP02H89K2.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtggagtcgtgggggaggccgtggtccgaggccggggggtccctggacgactctcctgtcgcccgcctctgactctacctttagtagctattggatgagcgtcgggtcccgccgaggcctccgaggggaaggggcgtgggaggtggggtcggaccaaagaaagtaaaaggaagagtgggaaagtcaagaaacactagtgtgggacttgaggtagaacggggcctaattccaccctatcctaccgagacgaacaacgaccaaaagtacttacagtagtaatctagactaaagtagaacgtacgacctaggaacggacggacccggaagggaacccgtaaccggggtcccgtttaaggttaccgtttaacgtcgggttaggtaacgacggaaagaacgtaagtaacggaaaacgtaaccggggtagtaaaacggtacccgggggttaagggggttagttaacgg

SEQ ID NO: 369913 - DNA, 584 bp, Homo sapiens
  misc_feature: GZ8MTXP02GE3XD.15.23.C01.1.454.CMB.2.raw
  modified_base (489)..(489): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccgggggggtccctggagactctcctgtcgccgcctctggactcacctttagagctattggatgagcgtggtccgccaggctccgaggggagggctgggagtggggtgaccaaagaagtaaaaggaagagtaggaaagtcaaagaaaacactaagtgtgggactcgtaggtagaagggcccgatttccgacctatcctaccaagacgaacaaacggccaaagaaattcgagtcgtaatctagacaaaatgaaacngacctaggaagacgaccgaggacgcggtccgtagttacttactggtgtagacgagacatgaaccaacggtagaacgaaccgggtgggggtatagg

SEQ ID NO: 369914 - DNA, 649 bp, Homo sapiens
  misc_feature: GZ8MTXP02FLM5M.15.23.C01.1.454.CMB.2.raw
  modified_base (481)..(481): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtgggtccgaggccgggggggtccctggagactctcctgtgccgcctctggactcacctttagtagctattggatgagctgggtccgccaggcctccgaggggaaggggctgggaggtggggtggaccaaacgaagtaaaaggaagaagtaggaaagtcaagaaacactaatggtggactcgtaggtagaaacggggtccgaagttcaacccatcctaccagaacgaaccaaacgacccaaaagtaacttcaaggtntaaatacctaaacgaaaatcggaaacagggtaccctaggaaggacggacccggaaagggaccacggggtaccgtagttaacttacgtggtgtagaaggaccgaacgatacggaaacgtaaacgggtagaaaacggttaaaccgggggaggggtttacgaagtttcggg

SEQ ID NO: 369915 - DNA, 583 bp, Homo sapiens
  misc_feature: GZ8MTXP02HH9MH.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcggctggtggagtcgtgggggaggcctggtccaggccgggggtccctggagactctcctgtcgcccgcctctggactctaccttagtagctatggatgagctgggtcccgcaggctccgaggggagggctggagtgggtgccaacgataaaaggagatgggaacgtcaagaaaacactaatggtaggacctctggtaggaaaggggcccgtaattccgaaccatcctacccagaacgaaccaacgaccaaagtaaacttcaagtgtaatcgtagactaaatgaaactagcctagagacggaccgaaggacacgggccgtagtacgttactgtgtagagagacagtagaacgacggtagaaacgtaaccgggaggggttgagttgg

SEQ ID NO: 369916 - DNA, 702 bp, Homo sapiens
  misc_feature: GZ8MTXP02HCZS4.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctgagactctctgtcgccgcctctggactctacctttagtagctattggatgagcgtgggtccgcaggcctccgaggggaaggggctgggaggtggggtcggaccaaacgaaagtaaaagggaagtaagtggggaaacgtcaaaggaaaacacttaagtaggtgggacttcgtaggtacgaacgggggccaatttccaaacctacttccctacccgaaggaacgaaccgaaaccgacccaaagtaaacttccaagttgtaactctagaactaaagtgaaaccgagaccgtaggacggaacgtacccggaggaaacccgcgggtacccgttaggttaacgtttaaccgtggtttacggacggaaaggtacgaaccgtaaacgttaagggaaaacccgtaaaccggggtaagtaaaacgggtaaaccccgggggttaagggggtttacgttaaacggg

SEQ ID NO: 369917 - DNA, 561 bp, Homo sapiens
  misc_feature: GZ8MTXP02IUN55.15.23.C01.1.454.CMB.2.raw
  modified_base (413)..(413): a, c, t, g, unknown or other
  modified_base (422)..(422): a, c, t, g, unknown or other
  modified_base (469)..(469): a, c, t, g, unknown or other
  modified_base (500)..(500): a, c, t, g, unknown or other
  modified_base (512)..(512): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccgggggggtccctggagactctcctgtgccgcctctggactcacctttagtagctattggatgagctgggtccgcaggctccgaggggaaggggctgggagtgggtggccaaacgagtaaaaggaagagtggaagtcaagaaacactatgtggactctggtgaaggggccattcaccntctccaganaacaacgccaaagattcagtgtatctgacaaatgaacagcctggagngaccggaggaccacgggccgtagtattacgngtgtagacgganacaagtgaacgtaacgggtagaacgtaaccggggaggggtttgtaacgg

SEQ ID NO: 369918 - DNA, 726 bp, Homo sapiens
  misc_feature: GZ8MTXP02HNX6B.15.23.C01.1.454.CMB.2.raw
  modified_base (307)..(307): a, c, t, g, unknown or other
  modified_base (317)..(317): a, c, t, g, unknown or other
  modified_base (353)..(353): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggttttcctgttagctattttagaaggtgtccagtgcgaggagcagctggtggagtcgtgggggagcctggtccgaggccgggggggtccctgagactctcctgtgccgcctcgtggactcaccttagtagctattggatgagcgtgggccnccgaggtccnccgaggggaagggctgggagtggggtcggaccaaanaagtaaaagggaagagtagggaaacgtccaaggaaaacacttaaagtggtcgggtaacctcgtaggttagggaaaacgggggcccgtaaatttcccgaaaccctaagtttcccgtacccaaaggaacggaaaacccaaaacccgggacccaaaaaggtttaaatttcccggaagggtttagttaaacccttacgttaacgtaacgtaaaacgtaaacgaaacgaacgtaccgtacggaacggaacggaccggaacggaaccggaaccgggtaccggttacgttacgttacgttacggtaggtaggacgaacgaacgaagtaacgaacggaaacggtaacggtaacggtaacggggtaacggggttacggtagg

SEQ ID NO: 369919 - DNA, 669 bp, Homo sapiens
  misc_feature: GZ8MTXP02IBHE6.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggcccggggggtccctggagactctctgtgccgcctctggactcaccttagtagctattggatgagcgtgggtccgccgaggcctccgaaggggaaggggcgtgggaggtggggtcggaccaaacgaagtaaaaggaagagtaggaaagtacaagaaaacactaagtgtggaacttcgtggtaggaaacggggtcccgaatttcccgaaacctactcctacccgaagaacgaacaaaaccgacctaaaagtaacttcgaagttagtaactcgtagactaaaatcgaaacagacctaggaacggacggcccggaaaggacccgtaaccgggcccgttagttaacgtttacgtaggttgttacgaagacggtaaccagtaacggaacccgtaaaaggggtacgaaacggtttaaaccggggtaggggtttacgaacgg

SEQ ID NO: 369920 - DNA, 690 bp, Homo sapiens
  misc_feature: GZ8MTXP02JF2ZE.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggccgggggggtccctggagactctcctgtgccgcctctggactcacctttagtagctattggatgagcgtgggtcccgccagggctccgaggggaaggggctgggaggtggggtggaccaaacgagtaaaagggaagagtagggaaagtcaagaaaacactaagtgtgggactcgtaggtagaacgggggcctaaatttcccaaacctatccctacccgaagacgaaacccaaaccgacccaaaagtaacttcaggttgttaatcgtaggactaaaagtcgaaacagcccgtaggaacgacgggaccccggaagggaaccgacccggggtaccgttaggttaaccgtttacgttgggttacgggtaggaggaaacggacctaaggtcggaaaacccggtaaacgggggttacggtaaacggttaaaacccgggggtagggggtttacgtaaacggg

SEQ ID NO: 369921 - DNA, 610 bp, Homo sapiens
  misc_feature: GZ8MTXP02IDH2U.15.23.C01.1.454.CMB.2.raw
  modified_base (307)..(307): a, c, t, g, unknown or other
  modified_base (553)..(553): a, c, t, g, unknown or other
  modified_base (607)..(607): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgccgcctctggactcaccttagtagcttattggatgagcgtgggtccnccaggctaccgaggggaaggggctgggagtggggtggcaaacgaagtaaaaggaagataggaaagtcaagaaacagtaagtgtggacttcgtgtaggaaggggtcccgaatttccgaacctatcctacccaaggaacgaaccaaacgacccgaaaagtaaatttccgagttagtattcgtagtactaaaaatgaaacaggcctagaagacgtccggaaaggtccgaacggccgtgttaacttacgngttggagtagagtacagtaacgacaaaggttcgaaagtaccgggaggggtttanagg

SEQ ID NO: 369922 - DNA, 659 bp, Homo sapiens
  misc_feature: GZ8MTXP02JW87G.15.23.C01.1.454.CMB.2.raw
  modified_base (405)..(405): a, c, t, g, unknown or other
  modified_base (492)..(492): a, c, t, g, unknown or other
  modified_base (627)..(627): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcggtgggggaggccgtgggtccgacgggcccggggggtccctggacgacctctccgtgtcgccgtcctcgtggactctacctttagtacgctagttgatgagcgtcggtccgccaggctccggaggggagggcgtgggaggtgggtacgaccaaacgaagtaaaaggaagagtagggaatacaagaaaacnctaagtggtcggactcgtaggtagacggggtcctacttccaacctattccacccgagacgaaccaacgaccaaagtaactcgagttntactctagaacaaagtacgaaacgcggacctagggaacggaccgggaccggaacgggttaccgaaaccggggtccttaaggttaacctttagtcggttaggacgaagacgaactagaacggaaacgtaaccgggnggtaaacggtacggggtaggggtttactaggg

SEQ ID NO: 369923 - DNA, 567 bp, Homo sapiens
  misc_feature: GZ8MTXP02J4V7K.15.23.C01.1.454.CMB.2.raw
  modified_base (200)..(200): a, c, t, g, unknown or other
  modified_base (340)..(340): a, c, t, g, unknown or other
  modified_base (383)..(383): a, c, t, g, unknown or other
  modified_base (484)..(484): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggtttttccttgttgctattttagaaggtgtccagtgcgaggancagctgggtggagtcgtggggggagcctgggtcccagggcccggggggttccctgagcctctcctgtgcccgcctctggactctacctttagtagctattggatgagctgggccgccaggctccgaggggaggggctggngtgggtggaccaaacagtaaaaggagatggaagtcagaaaacnctagttggtggactctggtgaaggggccctaattccacccatcctccgagagacaaacggcctaagaatttcagtgtatctagacaaatgaaccagtccgngagacgaccggagtacgacggtcgttgtattagtgtgtacgagacgacatgaacgaacggtgaacgtacgggtagggttagtg

SEQ ID NO: 369924 - DNA, 542 bp, Homo sapiens
  misc_feature: GZ8MTXP02FR1VA.15.23.C01.1.454.CMB.2.raw
  modified_base (409)..(409): a, c, t, g, unknown or other
  modified_base (451)..(451): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagagctattggatgagctgggtccgccaggctccgaggggaaggggctgggagtggggtggccaaacagtaaaggaagatggaagtcagaaaacactatgtggactctgtgaagggcgattcacatcncagagacaacgccaaagatcagtgtatctgacaaatgaaacngcctgacgagaccggaggacacggcgtagtattacgtgtgtgacgagacagtgaacaacgggttgaacgtaacggggaggggttagtaagg

SEQ ID NO: 369925 - DNA, 550 bp, Homo sapiens
  misc_feature: GZ8MTXP02JNW8D.15.23.C01.1.454.CMB.2.raw
  modified_base (382)..(382): a, c, t, g, unknown or other
  modified_base (495)..(495): a, c, t, g, unknown or other
  modified_base (547)..(547): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtgggtccgaggccgggggggtccctgacgactctcctgtgccgcctctggactcacctttagtagctattggatgagctgggtccgccaggctccgaggggaaggggctgggagtggggtggccaaacgataaaaggaagatggaagtcagaaaacnctatgtggactcgtgtgaagggccgattcaccatctccagacgacaacgccaaagaattcagtgtatctagacaaatgaacagcctgagagccgaggacacggctagtatacngtagtgagagacagtcgaacgaacgggtgaaacgtaaccggggaggggttanagg

SEQ ID NO: 369926 - DNA, 628 bp, Homo sapiens
  misc_feature: GZ8MTXP02HC0UF.15.23.C01.1.454.CMB.2.raw
  modified_base (576)..(576): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccgggggggtccctgagactctcctgtgccgcctctggactcaccttagtagctatggatgagctgggtccgccaggctccgaggggaaggggctgggaggtggggtggaccaaacgaagtaaaagggaagagtacggggaaagtcaaggaaaaccactaagtggtgggaacttcgtggtagaacggggcccgtattccaacctatccctacccaaggaacgaaccgaaacggtacccaaaaggtaactttacgaagttcgtaaatccgttaggactaaaatcggaaacacgcctaggacgacgaccggagtaacgccggcgttagtacttacgtggttagnggaacgaggacagtaagacgaacggtgaacgtaaccggggtggggttacagg

SEQ ID NO: 369927 - DNA, 696 bp, Homo sapiens
  misc_feature: GZ8MTXP02H0JNG.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgagggccggggggtccctggagactctcctgtcgccgcctcgtggactctacctttagtagctagttggatggagcgtcggggtccccgccgagggcctaccggaaggggaacggggcgtggggaggttggggtcggacccaaacgaaagtaaaagggaagtagtagggaaagtacaaagaaaacctacttaagttggtgggtaccttcgttagggtacggaaacgggggtccctaaatttcccgaaccctatccctaccgaagaacgaaccaaacggacccaaaagtaacttacagttagtaacttcgtagaactaaaagtcgaaacaggtaccctaggaaacggacggacccggaagggaacccgaccgggtccgttaagtacgtttacgtggttaggacgagacgaacagtaacggaacgtaaacgggtacgaaacggtaaccgggggtagggttagtacgg

SEQ ID NO: 369928 - DNA, 626 bp, Homo sapiens
  misc_feature: GZ8MTXP02JPWGD.15.23.C01.1.454.CMB.2.raw
  modified_base (309)..(309): a, c, t, g, unknown or other
  modified_base (379)..(379): a, c, t, g, unknown or other
  modified_base (505)..(505): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctggagactctcctgtcgccgcctctggactcacctttagtagctattggatgagctgggtccnccaggcctccgaggggaggggctgggagtgggtgccaaagagtaaaaggagagtggaaagtcaagaaacnctagtgtgactctgtagaagggcgattccactatctaccagacgaacaacgacccaaagtaacttcgagttgtatcgtgaacaaatggaaacacgccgtagaacggacggtaccgaagggtaaccncggggtacccgttagttaacgttacgtgggtacggtaggtaacgaacgtacctaagtaaccggaaacgaaaaccggggttcgaaaacggttaaacccgggggtagggggtttacgtaaggg

SEQ ID NO: 369929 - DNA, 773 bp, Homo sapiens
  misc_feature: GZ8MTXP02JLKZF.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctcctgtgccgcctctggactcaccttagtagctattggatgagctgggtccgccaggctccgaggggaaggggcgtgggaggtggggtggccaaacgaagtaaaagggaaagagtaggaaagtacgaagaaaacactaatgtggaacttcgtaggtaggaaacggggcccgtattccgaaccctattccctacccgaaggaacggaaacccaaaacccggacccgaaaaaggtaaacttttaccgaaaggtttaggtttaaactcccgttaagggaaaccctaaaaaaggttagggaaaaccctaacggaccccgttaaggggaaacggaacggggacccccgggtaaaaggggaaccccggaaacccgggggtccccgtttaagggtttaaacctttaaccggtggggtttacggttacgggaaagggtaacggtaaccaagttaacgggaaacccgtaaaaccgggggttagaaaaccggttaaaacccggggggtagggggttttacgtaaacggg

SEQ ID NO: 369930 - DNA, 574 bp, Homo sapiens
  misc_feature: GZ8MTXP02I728M.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctaattttagaaggtgtccagtgcgaggagcagctggtggagtcgtgggggaggcctggtccgaggccgggggggtccctgagactctcctgtgccgcctctggactcacctttagtagctattggatgagctgggtccgccaggctccgaggggaaggggctgggagtggggtggaccaaacaagtaaaaggaagatgggaaagtcaagaaacacgtaatggtggactctggtagaaggggccattcaccatctcagagacaacgaccaagattacagtgtaactctagactaaatagaacagcctgagacgacgaggacgacgggcgtagtattactggtagagtacgaagacagtaacgaacgtaaacgggtgaaacggtaaccgggaggggtttacgtagg

SEQ ID NO: 369931 - DNA, 709 bp, Homo sapiens
  misc_feature: GZ8MTXP02JLVS9.15.23.C01.1.454.CMB.2.raw
  modified_base (654)..(654): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggttttccttgttgctattttagaaggtgtccagtgcgaggagcagctggtgggagtcgtgggggaggccgtggtccgaggccgggggggtccctgagactctcctgtcgccgcctctggactctacctttagtagctagttggatgagcgtgggtccgccaggcctaccgaaggggaggggctgggaggtggggtggaccaaacgaagtaaaaggaagtagtagggaaagtaccaagaaaaccacgttaagtggtcgggaaccttcgtaggtacgggaaacgggggtaccctaatttcccaaaccctagtttccctaccccgaaagggaccggaaaacccaaaaccggaccccaaaaaggtaacttccgaaggttaccgttaattccgtagaaccctaaaaagtcggaaaacaacgtccctaggaacgacgggcccggaagggtaccaccggggtcctagttaacgttacgtggtaggttacgggaacgaacggtaanagtaacggaaacggtaacggggtacgaaacgggttacgggggtaggggttacagg

SEQ ID NO: 369932 - DNA, 660 bp, Homo sapiens
  misc_feature: GZ8MTXP02JJH1O.15.23.C01.1.454.CMB.2.raw
  modified_base (658)..(658): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccaggccggggggtccctgagactctctgtcgccgcctctggactctacctttagagctattggatgagcgtgggtccgccaggcctccgaggggaaggggctgggacgtggggtggaccaaacgaagtaaagggaagagtagggaatcgaagaaaacactagtgtgggtaaccttcgtaggttacgaacggggtaccgtatttacccgaaccctatcccgtacccgaaggaccgaaccgaaaaccgcccaaaaggtaatttccgaaggttcttaaacgtccgtagaactaaaactagaaaccgaagtccctaaggaaacgacggtacccggaagggtaccaccggggtaccgttagttaacgttaccgtggtagtagaagtacgactaagtcgaaacgtacggtagaacggtaaccggggtagggtttanag

SEQ ID NO: 369933 - DNA, 561 bp, Homo sapiens
  misc_feature: GZ8MTXP02I0310.15.23.C01.1.454.CMB.2.raw
  modified_base (423)..(423): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagtagctattggatgagctgggtccgccaggctccgaggggaaggggctgggagtggggtggccaaacagtaaaggaagataggaaagtcaagaaaacactatgtggacttctggtagaagggccgattccaccatctacanagggggacaacgaccaagaatacagtagtagtctagacaatagaacacgacctagagagacgacggacgacgcgtacgtagtactgtgtagagagacagtaagacgaacggtacgaacgtaacggtacgggtagtagg

SEQ ID NO: 369934 - DNA, 685 bp, Homo sapiens
  misc_feature: GZ8MTXP02HGWTI.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccgggggggtccctgagactctcctgtcgccgcctctggactcacctttagtagctattggatgagcgtgggtcccgccgaggcctaccgaggggaaggggctggggaggttggggtcggacccaaacaagtaaaagggaagagtacgggaaagtacaagaaaacactaagtgtgggacttcgtggtaggaaacggggcccgtaattcccgaaccctattccctacccgaaggacgaaacccaaacggacccaaagtaacttcgaagttacgtaatcgttacgactaaaagtcggaaaacacggaccctaggaacggacggtacccggaagggaacccgacggggacccgttaggtaactttacgtggttaggtacggaagaacgacgtaagtaacggaaacgaaacggggttgaaacggttaaaccgggggagggggtttacgtaaggg

SEQ ID NO: 369935 - DNA, 604 bp, Homo sapiens
  misc_feature: GZ8MTXP02I3P6B.15.23.C01.1.454.CMB.2.raw
  modified_base (413)..(413): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggccgggggggtccctgagactctcctgtcgccgcctctggactcacctttagtagctattggatgagctgggtccgccaggctccgaggggaacgggctggagtggggtcgccaaacataaaggaagatggaagtcaagaaacactatgtggactcgtgtagaaggggtccattcaccntcctaccagagacaaaccgccaaagaacttcagtgtatctgactaaagtcgaaacagtaccctggaaggacggacccggaaggtaaccgaaccggggtcccgttaaggttacgttaaaccgttggtaggttagaagaacggactagtaacgaacggaaacggtaggaacgtaaacggggtggggttatagg

SEQ ID NO: 369936 - DNA, 661 bp, Homo sapiens
  misc_feature: GZ8MTXP02GOU9A.15.23.C01.1.454.CMB.2.raw
  modified_base (470)..(470): a, c, t, g, unknown or other
  modified_base (649)..(649): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggcccggggggtccctgagactctcctgtcgccgcctctggacctctaccttagtagctagtgatgagtcgtcggtccgcgaggcctaccggaagggggaacgggcgtggggaagggtggggtacgaccgaaacgtaaaggtaaaagggaagtagtaagggaaacgtacgaaaagaaaacctattagtagggtcggtacttcggtaggtagggaccggggacctacgttacccaactnttacccacgaaaggacaaaccgaccgaaccgaaagtactacgagttactaatctaagaacttaaagacaacgcgtaccgaggacgaccggaccgggtagaaccgcgggtacttacggtattaggtgtaggagaaagacgaactagaacgaaacggacggttaggaacggttaacggggngggttagtacgg

SEQ ID NO: 369937 - DNA, 637 bp, Homo sapiens
  misc_feature: GZ8MTXP02HOAFM.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggcccgggggggtccctggagactctcctgtcgccgcctctggactcacctttagagctattggatgagctgggtccgccaggcctccgaggggaagggcgtgggaggtgggtcggaccaaacgaaagtaaaaggaagagtggaaagtcaagaaacatagtgtggactcgtgtaggaagggcccgaattcccaaccctattccctaccgaaggacgaacccgaaaccgacccaaaaggtaaacttcgaagtcgttaactcgtagaacctaaaagtcggaaaccagtccctaggaacgacgggccgaaagggacccgacggggtccttaaggttactttacggtagtggtaggacgagaactgtaagaaacgtaacggtgaaacggtacggggaggggtttacagg

SEQ ID NO: 369938 - DNA, 558 bp, Homo sapiens
  misc_feature: GZ8MTXP02G0MYS.15.23.C01.1.454.CMB.2.raw
  modified_base (364)..(364): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggccggggggtccctgagactctcctgtgccgcctctggactcacctttagtagctattggatgagctgggtccgccaggctccgaggggaagggctgggagtggggtggccaaacgaagtaaaagggaanagtaggggaagtcaagaaacagtatgtggactcgtgagaaggggccgattccacatctccaagagacaacgccaaagattacagtagtatctgacaaatgaacagcctgagacgccgaggacgacgggcctaggtactacgtggtagtaggacgagacagtgaacaacggtgacgtaaccgggtaggggtagag

SEQ ID NO: 369939 - DNA, 638 bp, Homo sapiens
  misc_feature: GZ8MTXP02H8S6T.15.23.C01.1.454.CMB.2.raw
  modified_base (584)..(584): a, c, t, g, unknown or other
  modified_base (598)..(598): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttcctgttgctattttagaaggtgtccagtgcgaggagcagctggtggagtcgtgggggagccgtggtccgaggcccggggggtccctgagactctccgtgtcgccgcctctggactctaccttagtagctattggatgagcgtggtccgccaggctccgaggggaaggggctgggaggtggggtggaccaaacgaaagtaaaaggggaagagtaccggggaaagtaccgaaagaaaaccactaagttgttgggaaccttcgtaggttaggaaacggggcccgaaatttcccaaaccctatcccgtacccaaggaacaaacccaaacggacccaaaaggtaacttcgagttacgtattaccgtagaactaaaagtacggaaaccagccctagaggacgaccgaggacgtacggcctagtattangttgagacgacganagaacgacgaacggtagaaacggtacggggtaggttagag

SEQ ID NO: 369940 - DNA, 713 bp, Homo sapiens
  misc_feature: GZ8MTXP02IAFHG.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggaggccgtgggtccgaggcccggggggtccctggacgactctcctgtcgccgcctcgtggacctcaccttagtagcttattggatggagcgtcggggtcccgccgagggcctaccggaaggggaaggggctggggaggtggggtacgaaccaaagaagtaaaaggagaagtagggaaacgtacgaaagaaaactacgttaagtggtacggaacttcgtaggtacgggaaacggggtccctaatttcccaacccttatcctacccgaaggacgaaccaaacggtaccaaagtaaacttcgagttagtaatcgtagaactaaagtaagaacgaacgaccgtacgaaggaacggaccggaacggaaccggaccggtacccggttacggttacgtttacgttacggttaggttacggtaacggaacgtaacgtaacgtaaggtaacggaaacggtaacggaaacggtaaaccgggtaacggggttaacggtaacggg

SEQ ID NO: 369941 - DNA, 576 bp, Homo sapiens
  misc_feature: GZ8MTXP02JVEN6.15.23.C01.1.454.CMB.2.raw
  modified_base (342)..(342): a, c, t, g, unknown or other
  modified_base (511)..(511): a, c, t, g, unknown or other
tcagtctacgtagccacgaccggtgctcgatttagtacacgtgattagggattgggggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgccgcctctggactcacctttagagctattggatgagctgggtccgccaggctccgaggggagggctggagtggggtggccaanagtaaaaggagagtggaagtcaagaaacactatgtggactcgtggtggaaggggcccgaatttcgacccatcctaccagacgacaacgaccaagaattcagtgtaatctgactaaatgaaacagacctagacgacgcccggaaggaccacgggtccgtagtacttacgngtgtagacgagacagtacgaacgtaacgggtgaaacgtaaccggggaggggtttacgagtttcgg

SEQ ID NO: 369942 - DNA, 578 bp, Homo sapiens
  misc_feature: GZ8MTXP02HJQS6.15.23.C01.1.454.CMB.2.raw
  modified_base (457)..(457): a, c, t, g, unknown or other
  modified_base (462)..(462): a, c, t, g, unknown or other
  modified_base (576)..(576): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctcctgtgccgcctctggactcacctttagtagctattggatgagctgggtccgccaggctccgaggggaaggggctgggagtgggtggccaaagaataaagggaagagtaggaaagtacaagaaaacactatgtggaacttctgtagaacggggccattccacctatcctaccaagacgaaccaacgaccaaagaattcagtntatcngaacaaatgaacagtccgtagagacgaccggagaccgacggccttagtacttactggtagtgaagacgacagtaacgaaacgtaacgggtgaaaacgtacggggaggggtttanag

SEQ ID NO: 369943 - DNA, 572 bp, Homo sapiens
  misc_feature: GZ8MTXP02GE260.15.23.C01.1.454.CMB.2.raw
  modified_base (305)..(305): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccaggccgggggggtccctgagactctcctgtgccgctctggactcacctttagagctattggatgagctgggtccnccagggctccgaggggaaggggctgggagtgggtggccaaacgagtaaaaggaaagagtgggaaagtcaagaaaacactaatgtggactcgtggtagaaggggcccgaatttccaacccatcctaccgaagagaacaaacgccaaaagaacttcaagtgtatcgtgacaaaatgaaacagcctagacgagccgaggacacggccgtagtattactgtgtacgagaagacatgaacgaacggtgaacgtaaaccgggagggtttgaag

SEQ ID NO: 369944 - DNA, 571 bp, Homo sapiens
  misc_feature: GZ8MTXP02G89DR.15.23.C01.1.454.CMB.2.raw
  modified_base (343)..(343): a, c, t, g, unknown or other
  modified_base (389)..(389): a, c, t, g, unknown or other
  modified_base (521)..(521): a, c, t, g, unknown or other
  modified_base (527)..(527): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggggggaggcctggtccgaggccgggggggtccctggagactctcctgtgccgcctctggactcacctttagtagctattggatgagctgggtccgccaggctccgagggaaggggctgggaggtgggnggccaaacagtaaaggaagagtagggaagtacaaggaaaacactanggtggacttctaggtagaaggggccgattccaccatcctaccagagaaccaacggacccaaagaattacgagtacgtatactgacaaatagaacagacctgagagaccgaggacacggccgtagtacttacngttagngagagacatgacaacggtagaagtaaccggagggggttagtagg

SEQ ID NO: 369945 - DNA, 630 bp, Homo sapiens
  misc_feature: GZ8MTXP02GL3DK.15.23.C01.1.454.CMB.2.raw
  modified_base (318)..(318): a, c, t, g, unknown or other
  modified_base (348)..(348): a, c, t, g, unknown or other
  modified_base (388)..(388): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcgtgggggagccgtggtccgacgggccggggggtccctgacgacctctcctgtcgcccgcctctggactctacctttagagctattggatgagcgtgggtcccnccaggctccgaggggagggctggagtgggngaccaaagaagtaaaaggagagtaggaaagtcaagaaacnctaatgtggactgtgtagaacgggccgtaattccaaccatcctacaagagaaccaaacgaccaaagtaacttcagttagtaactctagaactaaaatgaaactacgcctaggacgacggaccggaaggaccgacgggccgttaggtaactttacgtggtagtagaaggaacgactaagtaacggaaaccgtaaacggggttagaaacgggtaaaacccggggtagggggtttagtaaacggg

SEQ ID NO: 369946 - DNA, 635 bp, Homo sapiens
  misc_feature: GZ8MTXP02GIZKT.15.23.C01.1.454.CMB.2.raw
  modified_base (567)..(567): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccgggggggtccctgagactctcctgtcgccgcctctggactcacctttagtagctattggatgagcgtgggtccgccaggctccgaggggaggggctgggagtggggtgccaaacgaagtaaaggaagagtagggaagtcaagaaacactaagtgtggactcgtggtaggaacggggccgtattccaaccattccctaccgaaggaacgaaacccaaaccggacccaaaaggtaaactttcgaaggttgtaaacttccgtagaacctaaaatcggaaaacagaccctaggaagacggcccggaaggaccgacgggtccgttagtaacttagnggtgtagaacgtaagactaagcgaaacgtaacgggtgaaacggtaaccgggggtaggggtttagaagg

SEQ ID NO: 369947 - DNA, 689 bp, Homo sapiens
  misc_feature: GZ8MTXP02IVK9B.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctcctgtcgccgcctctggactcacctttagtagctattggatgagcgtcggtccgccaggcctccggaggggaaggggctgggaggtggggtcggacccaaacgaaagtaaaagggaagtaagtagggaaagtacgaaagaaaaccactaagtgtagggaccttcgtaggtaggaaacggggtcccgtaattcccgaacccacgttccctacccgaaaggaacgaaacccaaaccggacccctaaaagtaaactttaccgaagttacgttaaacgtccgtaggaaaccttaaaagtacggaaaacacggacctagggaacggacgacccggaagggaaccgaccgggtaccgttaggttaacttacgtggttagtggaagacggacagtaacgaaacgtaacgggtagaaacggtaccggggaggggttataagg

SEQ ID NO: 369948 - DNA, 563 bp, Homo sapiens
  misc_feature: GZ8MTXP02F4F2K.15.23.C01.1.454.CMB.2.raw
  modified_base (344)..(344): a, c, t, g, unknown or other
  modified_base (483)..(483): a, c, t, g, unknown or other
  modified_base (507)..(507): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccaggccggggggtccctgagactctcctgtgccgctctggactcacctttagagctattggatgagctgggtccgccaggctccgaggggaaggggctgggagtggggtgccaaanagtaaaagggaagagtggaaagtcaagaaaacactatgtggactcgtggtagaaggggcccgattccgaaccattccgtaccaagacgaacaaacgcccaaagaacttcaagtgtatctagacaaatgaacagcctganagcgaggacacggcgtgtattacngtgtagagacgacagtcgaacgaacggtggaagtaaaccgggaggggttacgtaag

SEQ ID NO: 369949 - DNA, 739 bp, Homo sapiens
  misc_feature: GZ8MTXP02HPL9J.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccaggccggggggtccctgagactctcctgtgccgcctctggacctcaccttagtagctattggatgagcgtgggtccgccaggctccgaaggggaaggggctgggaggtggggtcggaccaaacaagtaaaagggaagaatcggggaaaagtcaaggaaaacactaatggtggaaccttcgtggtaggaaacggggccccgaaatttcccgaaaccctattccctacccgaaggaacggtaaacccaaaaccgggaccccaaaagggtaaactttacccgaaggttacggttaaattcccgttagggaaccctaaaaaagttcgggaaaaacccgtacgtacccgtagggaaacggaaccgggacccggaaagggtaacccgaaccgggggtaccgttaggttaaacgtttaccggtgggttacggacgaaacggtacgtaacgaaggtaacggaaaccggtaaacggggtacggaaaacggttaaaccgggggtaggggtttacgaacgg

SEQ ID NO: 369950 - DNA, 585 bp, Homo sapiens
  misc_feature: GZ8MTXP02JW0F2.15.23.C01.1.454.CMB.2.raw
  modified_base (383)..(383): a, c, t, g, unknown or other
  modified_base (554)..(554): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctgagactctcctgtgccgcctctggactcacctttagtagctattggatgagctgggtccgccagggcctccgaggggaaggggctgggaggtggggtggccaaacagtaaaaggagatggaaacgtcaagaaacnctaatggtggacctgtggtaggaaggggcccgtaattccaacccattcctacccaagacgaaccaacggccctaaaaggaacttcgagttgtaactctagacaaaatagaacagacgacgagacggacgacggacgacggaccgtacgtacgttagtgtgtagagacgaanagaagacgacgagacgacggtacggtagtag

SEQ ID NO: 369951 - DNA, 587 bp, Homo sapiens
  misc_feature: GZ8MTXP02G0C4F.15.23.C01.1.454.CMB.2.raw
  modified_base (391)..(391): a, c, t, g, unknown or other
  modified_base (584)..(584): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggcccgggggggtccctggacgactctcctgtcgcccgcctctggactcacctttagtagctattggatgagctgggtccgccaggctccgaggggaaggggctgggaggtggggtggaccaaacgaagtaaaaggaagatgggaaagtcaagaaacnctaagtgtggactgtggtagaaggggccgaattccaaccatcctccaagagaacaacgccaaagaatcagtgtatctagactaaatggaaacagccctaggaagacgaccggaggacgaacggccgtagtacttacgtgtgtagagagacagtaacgaacgaaacgggtgaacgtaaaccgggaggggtttanagg

SEQ ID NO: 369952 - DNA, 636 bp, Homo sapiens
  misc_feature: GZ8MTXP02HJXMH.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccgggggggtccctgagactctcctgtcgccgcctctggactcacctttagtagctattggatgagcgtgggtcccgccaggctccgaggggaaggggctgggagtggggtggaccaaacaagtaaaaggaagagtacgggaaagtacgaaagaaaacactaagtggtgggtacttcgtaggtaggaaacgggggccattcccaacctatcctaccagacgaacaaacgccaaagaacttcagttgtaatcgtagactaaaatcgaaacacgcctaggaacggacggacccggaaggtaaccgaccggggtcccgttagttacgttacgtggtagtacggacgaagacagtaacggaaccgaaacgggtagaaacgtaaccgggggaggggtttacgaagg

SEQ ID NO: 369953 - DNA, 600 bp, Homo sapiens
  misc_feature: GZ8MTXP02IBIN1.15.23.C01.1.454.CMB.2.raw
  modified_base (314)..(314): a, c, t, g, unknown or other
  modified_base (538)..(538): a, c, t, g, unknown or other
  modified_base (552)..(552): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtgggtccgaggcccgggggggtccctgagactcctcctgtgcccgcctctggactcacctttagtagcttagttgatgagctgggtccnccaggctccgaggggaaggggctgggaggtggggtcgaccaacgaagtaaaaggaagagtggaaagtcaaagaaaccattagtgtggactctggtagaggggtcccgattccacctatcctaccagaacgacaaacgaccaaagtaactcgtagtagtatacgtagaactaaaagtcgaaacagcctaggagacggacgaggaccacgggccgtagtaattagngttagagaagacanagtaacgaaccgtaaacggtagaacggtaaccggggtagggttagagg

SEQ ID NO: 369954 - DNA, 549 bp, Homo sapiens
  misc_feature: GZ8MTXP02HXUAT.15.23.C01.1.454.CMB.2.raw
  modified_base (420)..(420): a, c, t, g, unknown or other
  modified_base (495)..(495): a, c, t, g, unknown or other
  modified_base (537)..(537): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggcccggggggtccctggagactctcctgtcgcccgcctctggactcacctttagtagctattggatgagctgggtccgccaggctccgaggggaaggggctggagtggggtggccaacataaaaggaagatggaagtcaagaaacactatgtgggactctgtgaagggccgattcaccatctccaganacaacgccaagaattcagtgtatctagcaaaatgaaacagcctgagacgccgaggacacgggcctagtacttacnggtcgtagaggacgacagtgacaacggtgaacgtaaccgggnggggtttagagg

SEQ ID NO: 369955 - DNA, 642 bp, Homo sapiens
  misc_feature: GZ8MTXP02F9THN.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctgggtccgaggccggggggtccctgagactctcctgtgccgcctctggactcacctttagagctattggatgagcgtggtccgccaggctccgaggggaaggggctgggagtggggtcggaccaaacaagtaaaaggaaagagtagggaaagtcaaagaaaacactaagtgtggactcgtagtaggaagggcccgattccaaccattcctacccgaagacgaacaaacgaccaaagtaattcagtgttaaactctagaacctaaagtcgaaaacacggtaccctaggaacggacggacccggaaggaaccgaccggggtcctaggttaacgtttaacgtggtagttacgacggaagtacaagttaagaaacgaaaccgggttagaacgtaaaaccgggggtacgggggttataacgggg

SEQ ID NO: 369956 - DNA, 693 bp, Homo sapiens
  misc_feature: GZ8MTXP02GQVI6.15.23.C01.1.454.CMB.2.raw
  modified_base (541)..(541): a, c, t, g, unknown or other
  modified_base (574)..(574): a, c, t, g, unknown or other
  modified_base (631)..(631): a, c, t, g, unknown or other
  modified_base (644)..(644): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggaggccgtggtccgagggccggggggtccctggacgactctcctgtcgccgcctctggactcacctttagagctattggatgagcgtgggtccccgcccgagggcctaccggaaggggaacggggcgttaggggagggttcggggtacggacccgaaaacgaaagtaaaaagggaaagtagtaggggaaagtacaaaggaaaaacacttaagtggtacggggtaccttcgtagggtacggaaacgggggtccctaagttacccaacctatccctaccgaagaacgaacccgaaacgacccaaaaggtaacttacgaaggttntaaagttccagaaactaaaagtacgaaaaccgngaccgaggaacggacggaccggaagaccgacgggtccgtaaggttacttagtggtanacggataaccganaagtaacgaaacgtaaggtacgaaaggtaaaccgggtagggttagtagg

SEQ ID NO: 369957 - DNA, 567 bp, Homo sapiens
  misc_feature: GZ8MTXP02IZ4BP.15.23.C01.1.454.CMB.2.raw
  modified_base (427)..(427): a, c, t, g, unknown or other
  modified_base (508)..(508): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgccgcctctggactcacctttagtagctattggatgagctgggtccgccaggctccgaggggaaggggctgggaggtggggtggccaaacgataaaagggaagatgggaaagtcaagaaaacactatgtgggactctggtagaaggggccattcaccatcctccaganacaacgccaaagattcagtgtaatctagactaaatggaaacagccctaggagagaccggaggacacgggcctggtattacnggtgtagagaagacataagaaccgaaacggtgaacgtaaccggggtaggggttagtagg

SEQ ID NO: 369958 - DNA, 551 bp, Homo sapiens
  misc_feature: GZ8MTXP02IKO5J.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctggggggaggcctgggtccgagccggggggggtccctggagactctcctgtgccgcctctggactcaccttagtagctattggatgagctgggtccgccaggctccgaggggaaggggctgggaggtggggtggaccaaacgaataaaggaaagatacggaaagtcagaaaacataatgtggactctgtagaagggccgaattcaacatctaccagaagactaaacgaccaaagaattacagtgaatctgacaaatgaacagcctgagagcgagacgacgcgtgtattactgtgtgacgagacatgaacaacggtagaagtaaccgggagggttacagg

SEQ ID NO: 369959 - DNA, 603 bp, Homo sapiens
  misc_feature: GZ8MTXP02HMYCF.15.23.C01.1.454.CMB.2.raw
  modified_base (500)..(500): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtcccgaggccggggggtccctgagactctcctgtgccgcctctggactcacctttagtagctattggatgagcgtgggtcccgccaggcctccgaggggaaggggctgggaggtggggtcggaccaaacgaagtaaaaggaagatagggaaagtcaagaaaacactagtgtgggacctgtggtaggaaggggccgtattccaacctatccctaccaagacgaaccaaacgaccaaagtaacttcaagttgtatcgtagactaaatgaaaccncgcgagagacgccgaggaccgacggtcgtagtacgttacgtgtagtagacgacgaacagtaagaacgaacgggtacgaacggtaaccggggtagggttacgag

SEQ ID NO: 369960 - DNA, 700 bp, Homo sapiens
  misc_feature: GZ8MTXP02H0LN7.15.23.C01.1.454.CMB.2.raw
  modified_base (309)..(309): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctggagactctctgtgccgcctctggactctacttagtagctagttggatgagcgtcgggtccnccgaggcctccggaagggggaaggggcgtaggggaggtggggtcggaccaaagaaagtaaaagggaagagtaggaaagtacaaagaaacacgtagtgtggtaacttcgtagttacgggaacgggtcccgtaatttcccgaaccctatccctacccgaaaggaaccgaaacccgaaacccggacccaaaaggtaaactttaccgaggttacgtacttaccgtaggaaacctaaaagtacggaaaccacggtacctaggaaggaccggacccggaagggtacccgacggggtacccgttagttaaactttcgagttagggtacgaacggagaaccgtagtaacggaaccgtaaacgggttgaaacgggtttaaccggggaggggtttacgagg

SEQ ID NO: 369961 - DNA, 601 bp, Homo sapiens
  misc_feature: GZ8MTXP02I761D.15.23.C01.1.454.CMB.2.raw
  modified_base (424)..(424): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagtagctattggatgagctgggtccgccaggctccgaggggaaggggctgggaggtggggtggaccaaacgagtaaaaggaaagagtagggaagtcaagaaaaccactaatgtggactcgtgtagaacggggccattcaaccntcctccagacgacaaacgcccaaagtaattcagtgtatctgactaaaatgaaacagccctaggacgacgaccggaggaccgacgggtcccgtaggtactttaacgtggtagtggagtaacgactaagtcgaacgaaacgggtcgaaacgtaaaccgggggtaggggttacgtaacgg

SEQ ID NO: 369962 - DNA, 586 bp, Homo sapiens
  misc_feature: GZ8MTXP02H9TTX.15.23.C01.1.454.CMB.2.raw
  modified_base (536)..(536): a, c, t, g, unknown or other
  modified_base (541)..(541): a, c, t, g, unknown or other
  modified_base (583)..(583): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgctattttagaaggtgtccagtgcgaggagcagctggtggagtcgtgggggaggccgtgggtccgaggccgggggggtccctggagactctctgtgccgcctctggactcacctttagtagctattggatgagcgtgggtccgccgaggctccgaggggaggggctgggaggtggggtggaccaaagaagtaaaagggagataggaagtacaataaaacgactatggtggactcgtgtagaaaggggcccgattccaccctatcctacccagaacgaaccaaacgaccaaagtaattcagttacgtatcgtagactaaaatgaaacagcctagagacgccggaaggacaccgggtccgtgtaatttcgngttgngaagagacagtgaacaaggtgaacgtaccggggagggtttanagg

SEQ ID NO: 369963 - DNA, 700 bp, Homo sapiens
  misc_feature: GZ8MTXP02G23BX.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggaggcctggtccgaggccggggggtccctggagactctcctgtcgccgcctctggactctaccttagagctagttggatgagcgtgggtccgccaggcctccggaaggggaacggggcgtgggaggtggggtcgaccgaaacgaagtaaaaggagagtaggaagtacaagaaacacgtagtgtggtacttcgtaggtacggaacggggcctagttcccaaaccgtacttcccgtacccaaggaaacgaacccgaaaacccggacccgtaaaagtaaactttaccgaaggttacgtaacttccgtaggaaacctaaaagttacggaaaccgtacgtacccgtaggaaaggaccggaaccgggacgggaaaccgtaaccggggtccgttaagttactttacggtggttaggtacgaagtaacgtacgtagtaacgaacgtaaacggggtagtaaacggtaaacggggtgggggttacgtacgg

SEQ ID NO: 369964 - DNA, 597 bp, Homo sapiens
  misc_feature: GZ8MTXP02J2BYB.15.23.C01.1.454.CMB.2.raw
  modified_base (410)..(410): a, c, t, g, unknown or other
  modified_base (458)..(458): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctggttttccttgttgctattttagaaggtgtccagtgcgaggagcagctggtggagtctggggggaggcctggtccagccgggggggtccctgagactctcctgtgccgcctctggctcacctttagtagctattggatgagctggtccgccaggctccgaggggaggggctggagtggggtggccaacataaggaagataggagtcagaaacactatgtggacttctggtgaagggccgattcaccatccaccaganaacaacgtccaaagaacttcaagttgtatcttagcaaaatgaaaaccngacctagaacggacgacccggaaggaccgacggtacccggttattaactttacgtggttaggtaggaacggacacagtaacgaaacgtaaaacggggttacgaaacggttaaacccgggggttaggggtttacggtaag

SEQ ID NO: 369965 - DNA, 658 bp, Homo sapiens
  misc_feature: GZ8MTXP02HQC27.15.23.C01.1.454.CMB.2.raw
  modified_base (600)..(600): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggaggccgtggtccgaggcccggggggtccctgagactctcctgtcgcccgcctctggactcacctttagtagctattggatgagcgtggtccgcaggctccggaggggaagggcgtagggaggtggggtacggaccaaacgaaagtaaaagggaagaagtaggggaaagtacaaaggaaaacctagtaagttggtcgggtaaccttcgtagtacgggaacggggacccgtattacccgaaaccctatccctacccaaaggaacgaaccgaaaaccggacccaaaaggtaacttaccgaaagttgtaaattccgtagaacctaaatacggaacagcctagacgaggccgaaggtaccgacggtcccgtgttaaactttcggngtagacgagacgacagtaacgaacgtaacggtacgaaacggtaacggggtggttagag

SEQ ID NO: 369966 - DNA, 650 bp, Homo sapiens
  misc_feature: GZ8MTXP02JRA1I.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctgagactctcctgtgccgcctctggactcacctttagtagctattggatgagctgggtccgcaggctccgaggggaagggcgtgggaggtggggtggaccaaacaagtaaaagggaagaagtagggaaatccgaaagaaaaccataagtgtggacttcgtagtaggaaacgggggccctaattaccaaccctaaattcccttacccgaaaggaacggaacctaaaccggcccaaaaagtaattccaaagttgtaaaatcctaggacctaaaaagtaagaaaacaacgacgtagaacggacggaccggaacggaacgacggtacggtacgttagttacgtacgtagtacgacgacgaacagtaagaacgaacggtacggaacggtaacgggtacgggtaggtag

SEQ ID NO: 369967 - DNA, 692 bp, Homo sapiens
  misc_feature: GZ8MTXP02JZQMK.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggaggccgtggtccgaggccggggggtccctgagactctcctgtgccgcctcgtggactcacctttagtagctattggatgagcgtgggtccgccaggcctccgaggggaaggggctgggaggtggggtcggacccaaagaagtaaaagggaagagtagggaaagtacaagtaaaaccactaagttgtgggacttcgtgtaggaaacgggggtcccgatttcccgaaaccctatccctacccgaaggacgaacccgaaccgacccaaagtaattcagttagtaatcgtagactaaaagtcgaaacgagtccgtaggaaggacggacccggaagggaacccgaacgggtcccgttaggttaacgtttaccgtcggttaggtacgaagggaacgaaccgaaggttaaggaaaacccgtaaacggggttacgaaacgggttaaaaacccgggggtagggggtttaacggttaaaggg

SEQ ID NO: 369968 - DNA, 570 bp, Homo sapiens
  misc_feature: GZ8MTXP02G1E5J.15.23.C01.1.454.CMB.2.raw
  modified_base (422)..(422): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggccgggggggtccctgagactctcctgtgccgcctctggactcacctttagtagctattggatgagctggtccgccaggctccgaggggaaggggctgggagtggggtggccaaacgagtaaaaggaagagtaggaagtcaagaaacactatgtggactcgtggtagaagggccgattccaccatccncaagagacaacgccaaagaattcgagtgtatctagacaaatgaacagcctagacgagaccgaggacgacggccgtagtacttacgtggtgtacggagagacagtcgaacgtaacgggtagaacggtaaccggggtaggggtttgaagg

SEQ ID NO: 369969 - DNA, 602 bp, Homo sapiens
  misc_feature: GZ8MTXP02FZWBH.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctggagactctcctgtgccgcctctggactcacctttagtagctattggatgagctggtccgcaggctccgaggggaaggggctgggagtggggtcggaccaaacagtaaaaggaagagtaggaagtcaagaaaacactatgtggactcgtagtagaaggggccgattcaaccatcctccaagacgaacaaacgccaaaagtaatcaagtgtaactcgtagaactaaaagtgaaacgtagaccctaggaagacgaccggaaggacgacggccgtagtacgttacgtgttggaggagaacgacgagtaacgaaacgtaaaccgggtagaaacggtaaccggggaaggggttgtaagg

SEQ ID NO: 369970 - DNA, 598 bp, Homo sapiens
  misc_feature: GZ8MTXP02F5EQP.15.23.C01.1.454.CMB.2.raw
  modified_base (535)..(535): a, c, t, g, unknown or other
  modified_base (594)..(594): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtgggtccgaggccgggggggtccctgagactctcctgtgcccgcctctggactcacctttagagctattggatgagctgggtccgccaggctccgaggggaggggctgggaggtgggtggaccaaacgaagtaaaagggaagagtaggaaagtcaagaaacatatgtgggactcgtgtggaagggccgtattcaccatcctccgaagacgaacaacgccaaaggaacttcgaagtgtaatctagaactaaaatcgaaaccagccctaggaacgacggaccgaaggaccacggggtccttagtaacttcgngttgagagacgacaagtcgaaccgtaaagggtcgaaacgtaaaccggggaggggtttanaagg

SEQ ID NO: 369971 - DNA, 571 bp, Homo sapiens
  misc_feature: GZ8MTXP02I14MR.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagtagctattggatgagctgggtccgccaggctccgaggggaaggggctgggagtggggtgccaaacagtaaaggagatggaagtcagaaacactaatggtgggactctggtgaaggggccgattccgaccatcctccaagacgaacaacgccaaagaattcagtgtaatctgacaaatcgaaacagcctgacgagccgaggacacgggtccgtagtattacgtggtgtaggagggacagtcgaacgaacgggtagtaacggtaaccgggtagggggttacgagttaggg

SEQ ID NO: 369972 - DNA, 719 bp, Homo sapiens
  misc_feature: GZ8MTXP02H03H3.15.23.C01.1.454.CMB.2.raw
  modified_base (555)..(555): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagtctgggttttccttgttgcttattttagaaggtgtccagtgcgaggagcagcgtggtggagtcgtgggggagccgtggtccgacgggcccggggggtccctgacgacttctccgtgtcgcccgcctcgtcggactctacctttagtagtctagttgatgacgtcgtcgggtcccgccgagggccgtaccggaaggggaggggtcgtggggaggtggggtcgaccaaacgaagtaaaaggagagtaggaagtacaaagaaacagttaagtggtggtactcgtaggtagggaaacgggtcctaattcccaaactagtccctacccaaaggaacccgaacaaaacccggaccaaaaggtaacttccgaaggttgtaaacttcctaagaactaaaagcgaaaaccgngtaccgaggaacggaccggacggaacggtacccgaccgggttacgttagttaacgttacggtggtaggtaacgaaagggtacgtaacgtaaggtaaaccggaaaccgggtaaacgggttacggtaaaaccggggttaaccgggggttaggggtttaacgaacgg

SEQ ID NO: 369973 - DNA, 578 bp, Homo sapiens
  misc_feature: GZ8MTXP02GMOAI.15.23.C01.1.454.CMB.2.raw
  modified_base (348)..(348): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtcgccgcctctggactcacctttagtagctattggatgagctgggtccgccaggctccgaggggaggggctgggagtggggtggaccaanataaaggagatggaatcaagaaaacactatgtggactctggtagaaggggcccaattccacctatcctcccaagacgaaccaaacgacccaaaagtaactttcgagttgtatctagacaaaatcgaaacagcctagagagccggaggacgacgggccgtagttacttacgtgtgtaggagacgacatcggaacaacgggtaggaacgtaaccggggaggggtttagtagg

SEQ ID NO: 369974 - DNA, 673 bp, Homo sapiens
  misc_feature: GZ8MTXP02IU5VR.15.23.C01.1.454.CMB.2.raw
  modified_base (311)..(311): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggacggccgtggtccgacgggccggggggtccctgagactctctgtcgccgcctctggactcacctttagagctattggatgagcgtggtcccncaggctcgaggggacggctgggagtgggtgaccaaacgaaagtaaagggaaagagtaggaaagtcaaaggaaaactactaagttggtcggggtaacctcgtagggtacgaaagggggcccctaaatttcccgaaaccctatacccgtacccgaagaaccggaaaccaaaccgaccaaaacgtaattcagttgtatccttagaactaaaatgaaaccagccctaggaacggacgaccggaaggacgaacgggtcccgttagtaacgtttacgtaggttagtacggaaggacggaaacctaggtaacggaaaccgaaacggggttaggaaaaccgggtaaccggggttagggggtttacgtagg

SEQ ID NO: 369975 - DNA, 644 bp, Homo sapiens
  misc_feature: GZ8MTXP02JR4XG.15.23.C01.1.454.CMB.2.raw
  modified_base (386)..(386): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggcccgggggggtccctgagactctcctgtgccgcctctggactcacctttagtagctattggatgagctgggtccgccaggctccgaggggaggggctgggagtggggtggccaaacgagtaaaagggaagatacgggaagtcaagaaaacncgtatgtggactctggtagaaggggccgattccgaccattccgtacccaaggacgacaacgacccaaagaactttcgagttgtaatctaggactaaagtacgaaacgaagcccgtagacggaacggcccggaaggaaccgacggggtacccgttaggttaaacgtttacgtcgggtaaggttcggaaggacggaactagttaacggaacgtaaaacgggtggtaaacgtacccgggggtaagggggtttacgtaaggg

SEQ ID NO: 369976 - DNA, 710 bp, Homo sapiens
  misc_feature: GZ8MTXP02HKQI9.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgagggcccggggggtccctgagactcctcctgtcgcccgcctctggactcacctttagtagctattggatgagcgtcgggtcccgccagggcctaccggaggggaaggggctggggaggtggggtcggacccaaaagaagtaaaaaggggaagagtagggaaagtcaaaggaaaacacttagtgtggaacttcgtggtaggaacgggggtcccaatttcccgaacccacttaccctacccgaaaggaaacgaaaccgaaaacccggaccctaaaaggaaacttttaccgaaggttaggttaaacttcccgttaggaaacctaaaagttacggaaaacctaacgacccgtaggaaacggacggaccggaacgggaccgaaccgggtccggttagtacgtttacgtaggttaggtacgaaggaacgacgagtaacggacgtaaacgggtagaaacggtaaccggggtaggggtttacgtagg

SEQ ID NO: 369977 - DNA, 584 bp, Homo sapiens
  misc_feature: GZ8MTXP02GC7OU.15.23.C01.1.454.CMB.2.raw
  modified_base (311)..(311): a, c, t, g, unknown or other
  modified_base (354)..(354): a, c, t, g, unknown or other
  modified_base (487)..(487): a, c, t, g, unknown or other
  modified_base (527)..(527): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttccttgttgctattttagaaggtgtccagtgcgaggagcagctggtggagtcgtgggggaggcctggtccgaggccgggggggtccctgagactctcctgtcgccgcctctggactcacctttagagctattggatgagtcgtgggtccnccagggctccgaaggggaggggctggaggtgggtggaccaaanaagtaaaaggaagataggaagtacaagaaaacactagtgtgggacctgtgtagaaggggccaattccaacattccacgagacgaacaacgtccaaaagtacttcgaagttgtaattcgagacaaatgaaaccngcgagacgacgacgagaccgtacggtctagttacttacgnggtagagacgagacagtaacgaacgtaacggtagaacggtacggggtagggttcgag

SEQ ID NO: 369978 - DNA, 630 bp, Homo sapiens
  misc_feature: GZ8MTXP02I06CY.15.23.C01.1.454.CMB.2.raw
  modified_base (485)..(485): a, c, t, g, unknown or other
  modified_base (583)..(583): a, c, t, g, unknown or other
  modified_base (620)..(620): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagtagctattggatgagcgtggtccgccaggctccgaggggaaggggcgtggaggtggggtcggaccaaacgaagtaaaagggaagtagtagggaagtaccaaaggaaaacactaagtggtcgggtacttcgtggtaggaacggggccgtagttccaacctatccctaccaaggaacgaacaaacgcccaaaagtacttcagtntagtctaggactaaagtcgaaacacgcctaggaacgacggacccgagggaaaccgcgggtaccgttagttactttacgtgtagtagaaggacacgtanaacggtaacgaacgggttagaacggttaaacgggggnggttatacgg

SEQ ID NO: 369979 - DNA, 676 bp, Homo sapiens
  misc_feature: GZ8MTXP02GGC31.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggaggttggggctgagctgggttttccttgttgctattttagaaggtgtccagtgcgaggagcagctggtggagtcgtgggggaggccgtggtccgagggcccggggggtccctggacgactctcctgtcgccgcctcgtggactctacctttagtagctagttggatgagcgtcgggtccgccgaggcctccggagggggaacggggcgtggggaggtggggtcgaccaaacgaagtaaaagggaagagtagggaagtacaagaaaactataatggtggactcgtggtaggaacggggcctaattcccaccgtatccctaccgaaggacgaaaccgaaccgaccaaagtaactttcgaagttgtactcgtagaactaaagtcgaaaacgcgtacccgtaggaacggacggaccggaaggggaaccctaccggggtcccgttaggttaaacttcgttaggtacggtacggaagtacggactaagtcgggaaacgtaacggggtacggaaacggttaaccgggggagggggtttacaggg

SEQ ID NO: 369980 - DNA, 605 bp, Homo sapiens
  misc_feature: GZ8MTXP02F93J4.15.23.C01.1.454.CMB.2.raw
  modified_base (338)..(338): a, c, t, g, unknown or other
  modified_base (415)..(415): a, c, t, g, unknown or other
  modified_base (420)..(420): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctgagactctcctgtgccgcctctggactcacctttagtagctatggatgagctgggtccgcaggctccgaggggagggctgggagtggggngccaaacagtaaaaggaagagtaggaaagtcaagaaaacactatgtggactctggtagaagggccattcaccatccncaganacacgccaaagattcagtgtatctagacaaatgaaactagaccgtaggacgacggacccgggaaggaaccgtaccggggtccttaagggttaactttacgtggttaggacgaaggaacgactaagtaacggaaaccgtaaacgggttagaacggttaaaaccgggggagggggtttacgaaaggg

SEQ ID NO: 369981 - DNA, 550 bp, Homo sapiens
  misc_feature: GZ8MTXP02GG7TG.15.23.C01.1.454.CMB.2.raw
  modified_base (418)..(418): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgccgcctctggactcacctttagagctattggatgagctgggtccgccaggctccgaggggaaggggctgggagtgggtggccaaacagtaaaaggagagtggaagtcaagaaaacactatgtggactcgtgtgaagggccgattccaccatctcaganacaacgccaaagatcagtgtaatctagacaaatgaacagcctagagacgaccgaggacacgggccgtagtacttacgtgtgtagagagacagtgaaccgaaggtacgaagtaaccgggaggggttagtaagg

SEQ ID NO: 369982 - DNA, 593 bp, Homo sapiens
  misc_feature: GZ8MTXP02IX1QM.15.23.C01.1.454.CMB.2.raw
  modified_base (465)..(465): a, c, t, g, unknown or other
  modified_base (535)..(535): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttccttgttgctattttagaaggtgtccagtgcgaggagcagctggtggagtcgtgggggaggccgtggtccaggccgggggggtccctgagactctcctgtgccgcctctggactcacctttagtagctattggatgagctgggtccgccaggctccgaggggaacggggctgggagtggggtggaccaaacaataaaggaagagtgggaaagtcaagaaaacactatgtgggacttctggtaggaacggggcccgaattcaacccatcctaccaagacgaacaacgcccaaaagacttcagtntaatctaggacaaagtagaaacagacctggaagacggaccgaaggacctaacggggcctaggtattacgngttagagacgacgaacagtaacgaacgaacggtagaacggtaacgggtgggttacgag

SEQ ID NO: 369983 - DNA, 542 bp, Homo sapiens
  misc_feature: GZ8MTXP02ID7TJ.15.23.C01.1.454.CMB.2.raw
  modified_base (270)..(270): a, c, t, g, unknown or other
  modified_base (286)..(287): a, c, t, g, unknown or other
  modified_base (322)..(322): a, c, t, g, unknown or other
  modified_base (365)..(365): a, c, t, g, unknown or other
  modified_base (505)..(505): a, c, t, g, unknown or other
tcagtctacgtagccacgaccggtgctcgatttagtacacgtgattagggattgggaggtctcagagaggagcccttagcccctggactccaaggccttttccacttggtgatcagcactgagcacagaggactcaccatggagttgggggctgagcgtggttttcgtgtaggcgtattttagaaggtgtccagtgcgaggagcagctggtggagtctgggggagcctggtccagccgggggggtccctgagactctcctgtgccgcctntggactcacctttagnntatgatgagcgtcggtcgcgacgcgcgagggaggngtggaggtgggtagacgaagaagaaagaagagagagagagaanatatgtgtatgtgtagaggacgactacacatcacgagacgaacaacgaacgaagtaatacgtagtagtatagtagaataaatagaacagacgagagacgacgagacgacgacgtacgtagtagtagtagtagagacgaanagtaagaacgaacgtacgaaggtaacggtaggtagtg

SEQ ID NO: 369984 - DNA, 678 bp, Homo sapiens
  misc_feature: GZ8MTXP02GEU4Y.15.23.C01.1.454.CMB.2.raw
  modified_base (354)..(354): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgacgactctcctgtcgccgcctctggactcacctttagtagctagttggatgagctgggtcccgccaggcctccgaggggaaggggctgggagtggggtggccaaanagtaaaaggaagatgggaaatcaagaaaacactaagtgtgggacttcgtaggtaggaaacgggggccgtaattccaaccctaattccctacccgaaggaacgaaccaaaacccggacccaaaaggtaaactttaccgaagtttgtaaacttccgttaggaacctaaaaagttacgaaaacgaacggtcccgttagggaaacggagggtaccccgggaagggaaccgtaacccggggtccgttagttaactttacgtggttgacggagaacggacaagtaaggaaccaagggtacgaacggtaaccggggtaaggggttgtaagg

SEQ ID NO: 369985 - DNA, 738 bp, Homo sapiens
  misc_feature: GZ8MTXP02JMFZP.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggttttccttgttgctatttagaaggtgtccagtgcgaggagcagctggtggagtcgtgggggaggccgtggtccgagggcccggggggtccctggagacctctccgtgtcgcccgtcctcgtggacctcctacctttagtagctagttggatgagtcgtcgggtcccgccgacggccgtaccggaaggggaacggggtcgtaggggacggttgggggtacggacccgaaaacgaaaggttaaaaagggaaaggtaagttaaggggaaaacgtacgaaaacggaaaaacctacgttaagtaggtacgggtaacttcgtgggtacgggaaaacgggggtcccgtaaattacccaaaccctattacccgacccgaaaggaacgaaacccgaaaccggtacccaaaaggttaacttccgaaggttcgttaactccgtagaaactaaagtcgaaaccgcgaccgtagggaacggacggcccggtaaggaccgaccggggtccttagttaacgttgtggtagttaggacgtaacgacagtaacgaaaccgtaagggtaggaaaccggtacggggtaggggttataggg

SEQ ID NO: 369986 - DNA, 590 bp, Homo sapiens
  misc_feature: GZ8MTXP02F7VEO.15.23.C01.1.454.CMB.2.raw
  modified_base (307)..(307): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccgggggggtccctgagactctcctgtgccgctctggactcacctttagtagctattggatgagctgggtccnccaggctccgaggggaaggggctgggagtggggtggaccaaacgaagtaaaaggaagagtaggaagtcaagaaacactaatgtggactcgtggtagaaggggtcccgatttccaaccctatcctacccgaagacgaaccaaacgccaaagaaattcagtgtatctagacaaatcgaaacagcccgtagacgaggaccggaggaaccacgggtccgtaggttacttacgtggtagtacgagaagacatgaacgaacggtgaacgtaaccgggaggggtataagg

SEQ ID NO: 369987 - DNA, 747 bp, Homo sapiens
  misc_feature: GZ8MTXP02H2IL1.15.23.C01.1.454.CMB.2.raw
  modified_base (304)..(304): a, c, t, g, unknown or other
  modified_base (653)..(653): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttcctgttgctattttagaggtgtccagtgcgaggagcagctggtggagtcgtgggggagcctggtccgaggccggggggtccctgagactctctgtcgccgcctctggactcaccttagagctagttggatgagcgtgggtccnccgaggctccgaaggggaaggggctgggagtggggtcggaccaaacgaagtaaaaggaagagtacgggaagtacgaagaaaacactaagtggtggaaccttcgtaggtacggaaacgggggccctaacgtttacccaaaccctaagttcccgtaccccgaaagggaaaccgtaaacccaaaaccggaccccgaaaaaggttaaactttacccgaaaggtttaccgtaattacccgttaaggaacctaaaaaagtcggaaaaccgacgacccgtaagggaaacggaaccggttacccggggaaacggacccgtaaccgggggtacccgtttaggttaaaacgtttaccgnggttacgggttacggaaggaaacgtaccgaaagttcggaaaaccggtaaacggggttgaaaacggttaaaccgggggagggggtttacgaacgg

SEQ ID NO: 369988 - DNA, 686 bp, Homo sapiens
  misc_feature: GZ8MTXP02F6Y5S.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctcctgtcgccgcctctggactctacctttagtagctagttggatgagcgtgggtcccgccaggcctaccgaggggaaggggcgtgggaggtggggtcggacccaaacgaagtaaaagggaagtagtagggaaagtcaaagaaaaccactaagtggtgggtacctcgtaggtaggaaacgggggtcccgtaatttcccgaaccctattccctacccgaaggaacgaaaccaaaaccggcccaaaaggtaaactttcgaaggttcgttaaactcctaggaacctaaaagtacggaaacacggccctaggaacggacggacccggagggaaccgaccgggtccgttaagttacgtttacgtggttaggtagaagaacgacaagtaacggaacgtaaacgggtagaacggtaaaccgggggtggggttacgtaagg

SEQ ID NO: 369989 - DNA, 595 bp, Homo sapiens
  misc_feature: GZ8MTXP02FJF09.15.23.C01.1.454.CMB.2.raw
  modified_base (498)..(498): a, c, t, g, unknown or other
  modified_base (585)..(585): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgccgcctctggactcacctttagagctattggatgagctgggtccgccaggcctccgaggggaggggctgggaggtggggtcggaccaaacgaagtaaaagggaagataggggaaagtcaataaaaccgactagtggtggaacctcgtggtaggaaacggggccgtattccaacccgtatcctacccagacgaacaacgccaaagaacttcgaagtgtaatctagactaaaatgaaacngcctggaacgagccggaggaccacgggccgtagttatacgtgtgtagagacgacataaggaccgtaagggtcgaaagtaaccggggngggttatagg

SEQ ID NO: 369990 - DNA, 597 bp, Homo sapiens
  misc_feature: GZ8MTXP02FOXY8.15.23.C01.1.454.CMB.2.raw
  modified_base (486)..(486): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgcccgctctggactcacctttagtagctattggatgagctggtccgcaggctcgagggaggggctggagtgggtggccaaacagtaaaaggaagagtaggaaagtcaagaaaacactaatggtggactcgttaggagtaacggggccgtattccgaaccctatccctacccgaagaagaaccaaacgacccaaagaattcaagtgtaatcctagacaaatgaaacngacctaggagacgacccgaggaaccgcgggcccgttgtaacgttactggtgtaggacgaagactagtaagaaccgaaacggttggaacgtaaccggggagggtttagaagg

SEQ ID NO: 369991 - DNA, 586 bp, Homo sapiens
  misc_feature: GZ8MTXP02G1X0U.15.23.C01.1.454.CMB.2.raw
  modified_base (542)..(542): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggccggggggtccctgagactctcctgtgccgcctctggactcacctttagtagctattggatgagctgggtccgccaggctaccgaggggaagggctgggagtggggtggccaaacaagtaaaggaagatggaagtacaagaaaacactaatgtggactcgtggtagaaggggccgattccacccgatcctaccagagacaacgccaaagaattcagtgtatctgactaaatcgaacagccctagacggaacgtccggaaggaccgaacgggcccgttaggtactttacctggtggtcgaagacgaanagtaacgaacgaacggtagaacggtaacgggtaggggttacgag

SEQ ID NO: 369992 - DNA, 578 bp, Homo sapiens
  misc_feature: GZ8MTXP02I87OS.15.23.C01.1.454.CMB.2.raw
  modified_base (507)..(507): a, c, t, g, unknown or other
  modified_base (573)..(573): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcactatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagtagctattggatgagctgggtccgccaggctccgagggaggggctggagtgggtgccaaacagtaaaaggagataggaagtcaagaaaacactatgtgggactcgtggtagaaggggccgattcaacccatcctccaagacgacaaacgccaaagacttcagtgtaatctagacaaatcgaacagcctagagacggacgaggacgacggccgtagtacttacgngtaggtagagaacgacaagtaacgaacgaaacgggttaggaaacgtaaaccgggggaggggtttanaaggg

SEQ ID NO: 369993 - DNA, 560 bp, Homo sapiens
  misc_feature: GZ8MTXP02J1PY0.15.23.C01.1.454.CMB.2.raw
  modified_base (461)..(461): a, c, t, g, unknown or other
  modified_base (476)..(476): a, c, t, g, unknown or other
  modified_base (504)..(504): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgttccgaggccgggggggtccctgagactctcctgtgccgcctctggactcacctttagtagctattggatgagctgggtccgccaggctccgaggggaaggggctgggaggtggggtggccaaacagtaaaaggagagtgggaagtcaagaaacactatgtggacttcgtgtagaaggggccgtaattccaccctatcctacccagacgacaacgccaaagattcgagtgtatcngacaatgaacagccnggagcgccgagacacgggctagtatacnggtgtagagacgacagtgaacgaacggtcgaagtaaccggggtaggggttataagg

SEQ ID NO: 369994 - DNA, 611 bp, Homo sapiens
  misc_feature: GZ8MTXP02JXM54.15.23.C01.1.454.CMB.2.raw
  modified_base (478)..(478): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctgagactctcctgtcgccgcctctggactcacctttagtagctattggatgagcgtgggtccgccaggcctccggaggggaaggggcgtggggaggtggggtcggaccaaacgaaagtaaaagggaagtagtagggaaagtacgaagaaacactagtgtggactgtggtagaagggccgtattccactatccaccagacgaaccaacgaccaaagtaacttcgagtgtaanctagacaaaatcgaaacagcctaggaggacgacggaacggaccgacgggccgttagtacttacggtgtggtacgaagacgtaacagtaagaacgtaacggtagaacggtaaccggggtaggggttacgtaagg

SEQ ID NO: 369995 - DNA, 726 bp, Homo sapiens
  misc_feature: GZ8MTXP02IXJOQ.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggagccgtggtccgaggccggggggtccctgacgactctcctgtcgccgcctctggaccttctacctttagtagctagttggatgagcgtcgggtcccgccgaggtcctccggaaggggaacggggtcgtaggggaggttcggggtcggaccccaaaacgaaagttaaaaaggggaaagtaagttaggggaaaacgttaccgaaaagaaaaacctacttaagttggtcggggaaccttcggtaggtacgggaaacgggggtcccgaaatttcccgaacccgtactccctaccgaaaggtacgaaaccgaaaccgacccaaaagtaaacttccgagttagtaacttctacgaactaaaagttagaaacgacgaccgtagacgacggaccggaacggaccgacgggtcccgtagttacgtttacgtagtacggtacggagaacggtacaggtaacgaacggtaaaccggtaggtaaacggtaaaccggggtagggggtttacgtaacggg

SEQ ID NO: 369996 - DNA, 709 bp, Homo sapiens
  misc_feature: GZ8MTXP02H0XXB.15.23.C01.1.454.CMB.2.raw
tcagtctacgtagccacgaccggtgctcgatttagtacacgtgattagggattgggaggtctcagagaggagccttagccctggactccaaggccctttcccacttggtgatcagcactgagcacagaggactcaccatggagttggggctgagcttgggttttccttgttgcttattttagaaggtgtccagtgcgaggagcagctggtggagtcgtgggggaggccgtggtccgaggccggggggtccctggacgactctcctgtcgccgccctctggactccaccttagtagctattggatgagcgtcgggtccgccgacggcctcccgaaggggaacggggcgtaggggaggttggggtcggacccaaaacgaaagttaaaaagggaaggaagtaggggaaagtaccaaaggaaaaccacttaagtggtcggaacttcgtggtaggaaacggggccgtaaatttcccaaccctatcccgttacccgaaggaacgaaacccgaaacgaacccaaaaggtaacttacgagttagtaatccgttaagaactaaaagtacgaaaccagacctaggaacgaacggacccggaacggaaccgacccggtccggttagttaaacctttacgtgttacgtaggaacgaacggactaaagtaagaaaccgtaaacgggtagaaacggtaacccggggtagggggtttacaaggg

SEQ ID NO: 369997 - DNA, 607 bp, Homo sapiens
  misc_feature: GZ8MTXP02HSKZR.15.23.C01.1.454.CMB.2.raw
  modified_base (604)..(604): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgtgaggagcagctggtggagtcgtgggggaggcctggtccaggccggggggtccctgagactctcctgtgccgcctctggactcacctttagtagctattggatgagcgtgggtccgccaggcctccgaggggaaggggctgggaggtggggtggaccaaacgaagtaaaagggaagagtagggaaagtcaagaaacactaatggtgggacttcgtgtggaagggccgtattccacccatccctaccaagacgaacaaccgaccaaagtaacttcgagttgtatctagactaaaatgaaacagcctaggacgacgccggaaggaccgacggggccgttgtaacttacgtggtgtacgagacgaacagtaaggaaacgtaacgggtagaaacggtaaccggggtagggggtttanagg

SEQ ID NO: 369998 - DNA, 597 bp, Homo sapiens
  misc_feature: GZ8MTXP02FLXTU.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagagctattggatgagctgggtccgccaggctccgaggggaaggggctgggagtggggtcggaccaaacgagtaaaagggaaagagtaggaaagtcaaaggaaaacactaatggtggactcgtggtagaaaggggccgaattccaaccctatcctaccaagacgaacaaaccgccaaaagaacttcaagtgtaatctagacaaaatcgaaacagccctagacgagcccggaaggaccacgggccgtagtacttacgtgtgtagagacgacagtaagaaccgaaagggtcgaagtaaaccggggaggggttagaagg

SEQ ID NO: 369999 - DNA, 616 bp, Homo sapiens
  misc_feature: GZ8MTXP02HVNVI.15.23.C01.1.454.CMB.2.raw
  modified_base (353)..(353): a, c, t, g, unknown or other
  modified_base (538)..(538): a, c, t, g, unknown or other
  modified_base (552)..(552): a, c, t, g, unknown or other
  modified_base (604)..(604): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttccttgttgctattttagaaggtgtccagtgcgaggagcagctggtggagtcgtgggggaggccgtggtccgaggcccgggggggtccctgagactctcctgtcgccgcctctggactcacctttagagctattggatgagctgggtccgccaggctccgaggggaaggggctgggaggtgggtgaccaaanagtaaaaggagatggaatcaagaaacactaatggtggactcgtgtagaacggggccattccaaccatccaccaagacgaacaaacgccaaagtaacttcagttgtaactctagaactaaaatcgaaacagcccgtaggaggacgcccggaaaggaccgtaccgggccgttagttaacgtttacgnggtaggtgaaacgngaaccagttaacggaaccgtaaaacggggttgaaacggttaaaaccgggggnggggtttcaagg

SEQ ID NO: 370000 - DNA, 607 bp, Homo sapiens
  misc_feature: GZ8MTXP02IXKU7.15.23.C01.1.454.CMB.2.raw
  modified_base (305)..(305): a, c, t, g, unknown or other
  modified_base (456)..(456): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgccgcctctggactcacctttagagctattggatgagctgggtccncaggctccgaggggaaggggctgggagtggggtcggaccaaacgaagtaaaaggaaagagtagggaagtcaaggaaaacactaatgtgggacttcgtgtagaaggggccattccaaccatcctccagacacaaacgcccaaagattcagtntaatctagacaaatcgaaacacgcctaggagacggacccggaggaccgaacgggtccttaggtaactttacgtggtagtacggagaacgactaagtcggaaacctaaacggggtgtaaacggtaaacccggggtagggggtttacgtaagg

SEQ ID NO: 370001 - DNA, 859 bp, Homo sapiens
  misc_feature: GZ8MTXP02IB8OX.15.23.C01.1.454.CMB.2.raw
  modified_base (309)..(309): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttcgtgtaggctattttagtaaggtgtccagtgcgaggagcagctggtggagtcgtgggggagcctggtccgagccggggggtcctggagctcgtcctgtcgccgcctctggactctaccttagtagctagttggatgagtctggggtccnccagggcctaccgaggggaaggggctggggaggttggggtggaccaaacgtaagtaaaaggggaagtaagtagggaaacgttaccgaaaggaaaacctacttaaagttgggtacgggtaaccgttcgtggggttaacggaaacggggggtaccccttagtttacccaaaccccttacgttaccctacccggaaagggaaacccggtaaacccgaaaaaccggtaaaccccgtaaaaagggttaaacctttaacggtaacgggttacgtttaaacgtttacccgtaaacggtaaaacttaaaagggttaccgaaaaccggtaaccggtaacccgtaacgggtaaacggggaaccgggaacccggggaaaccggggaacccgggtaacccgggttacccgggttaaccggtttaacggtttacggtttacgggttacgggttacggtaacggtaacggtaacgtaacggtaacggtaaaccgggtaaacggggtaaacgggttaaaaccggggtaaaccgggggttaacgggggtttaacggggttaacggg

SEQ ID NO: 370002 - DNA, 576 bp, Homo sapiens
  misc_feature: GZ8MTXP02JY14N.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccgggggggtccctgagactctcctgtgccgcctctggactcaccttagtagctattggatgagcgtgggtccgccaggctccgaggggaaggggcgtgggaggtggggtcggaccaaacgaagtaaaagggagaagtagggaagtcaagaaacactatgtggactcgtgtgaaggggccgattccaccatcctccagacgaacacgaccaagaattcagtgtatctgacaatgaacagcctaggacgacggccgaaggacacgggtccgtagtacttacgtggtgtacgaggacacgatcggaacgaacggtgaacggtaaccggggtaggggtttagagg

SEQ ID NO: 370003 - DNA, 683 bp, Homo sapiens
  misc_feature: GZ8MTXP02I60ML.15.23.C01.1.454.CMB.2.raw
  modified_base (313)..(313): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggccgggggggtccctgagactctcctgtcgccgcctctggactctacctttagtagctagttggatgagcgtgggtccnccaggctccgaggggagggctgggaggtgggtcgaccaaacgaagtaaaggaagagtaggaaagtcaaagaaacactagtggtggacctcgtgtagaacgggcgattccacctattccaccgaagacgaaccaaacgccaaagacttcgaagttgtaaacttctaagactaaaagtacgaaacacgtacccgtaggaaacggacggtaacccggagggaaacccgtaccggggtacccgtttaaggtttaacgtttaaaccgtggggttacggtaaacggacggtaaaaggacctaaaagggtcgaaaaccggtaaaccgggggttaggaaaaccggtttaaacccggggggagggggtttaagtaaggg

SEQ ID NO: 370004 - DNA, 685 bp, Homo sapiens
  misc_feature: GZ8MTXP02JCMSH.15.23.C01.1.454.CMB.2.raw
  modified_base (309)..(309): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctggagactctcctgtgccgcctctggactcaccttagtagctattggatgagcgtgggtccnccaggctccgaggggaaggggctgggaggtggggtcggaccaaacgaagtaaaaggaagagtagggaaagtcaagaaaaccactagtgtgggacttcgtggtagaaggggcctaattccgaaacccattcctacccaaggaacgaacccaaaccgacccaaaagtaacttacaagtagttatctagaacctaaaagtcgaaaaccgagacccgtaggaacggaacgacccggaaacgggacccgaaccggggtccctttaaggttaaactttaccggttagggtacgttacggaaggtaacggaacctaagtcggaaaaccgtaaacgggggttagaaaacgggttaaacccgggggtagggggtttacgtaacgg

SEQ ID NO: 370005 - DNA, 606 bp, Homo sapiens
  misc_feature: GZ8MTXP02HF9VV.15.23.C01.1.454.CMB.2.raw
  modified_base (579)..(579): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtgggtccgagggcccgggggggtccctggacgactctcctgtcgcccgcctcgtggactctacctttagtagctattggatgagcgtgggtccgccaggcctccgaggggaaggggctgggaggtggggtcggaccaaacgaagtaaaaggaaagagtagggaaagtcaagaaacactagtggtggactcgtggtagaagggccgattcaaccctatcctaccaagacgaacaacgaccaaagtaacttcaagtgtaaatctagacaaatgaaacagccgtagaggacgccgaaggacctacgggcccgttagtacttacgtgtagtagacgagacagtgaaccgaacgggttnaacggtaaccgggagggggttactagg

SEQ ID NO: 370006 - DNA, 541 bp, Homo sapiens
  misc_feature: GZ8MTXP02F539F.15.23.C01.1.454.CMB.2.raw
  modified_base (418)..(418): a, c, t, g, unknown or other
  modified_base (438)..(438): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccaggccgggggggtccctgagactctcctgtgccgcctctggctcacctttagtagctattggatgagctgggtccgccaggctccgaggggaaggggctgggagtggggtggccaaacataaaaggaagagtggaagtcaagaaacactaatgtggactctgtgaagggccgattcaccatctccaganacacgccaaagaattcagtntatctgacaaatgaacagcctgagagccgagacgacgggccgtagtacttactgtagtagagagacagtgaacgacggtagacgtaaccggaggggttgaagg

SEQ ID NO: 370007 - DNA, 692 bp, Homo sapiens
  misc_feature: GZ8MTXP02I0HSI.15.23.C01.1.454.CMB.2.raw
  modified_base (561)..(561): a, c, t, g, unknown or other
  modified_base (614)..(614): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctggagactctcctgtcgcccgcctctggacctcaccttagtagctattgatgagcgtcgggtccgcagggcctccggaaggggaaggggctgggaggtggggtggaccaaacgaaagtaaaagggaaagagtagggaaagtacgaaagtaaaacactaagttggtgggtaaccttcgttagggtacgggaaacggggtcccgtaatttacccaaaccgtattcccgtacccgaaggaaccgaaacccaaaccggacccaaaaggtaactttccgaagttacgtaaattcctaggaacctaaaagtcgaaaaccgngtacccgtaggaacgacggacccgaagggaccacgggccttagtactttacgnggtagtaggacgaacgataagtaaggaaacccgtaaacggggtagaaacggtaaaccgggggtaggggtttacaacgg

SEQ ID NO: 370008 - DNA, 601 bp, Homo sapiens
  misc_feature: GZ8MTXP02HG6U6.15.23.C01.1.454.CMB.2.raw
  modified_base (487)..(487): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccgggggggtccctgagactctcctgtgccgcctctggactcaccttagtagctattggatgagcgtgggtcccgccgaggcctccgaaggggaaggggctgggaggtggggtcggaccaaacgaagtaaaagggaagagtagggaaagtacaaggaaaacactaagtggtgggactcgtggtaggaaaggggtccgaatttccaacccgatcctacccaagacgaacaacgaccaaagaatcagtagtatcngacaaatgaacagcctagacgagcggagacgacggccgtatacgttactgtgtagagacgacagtaacggaacgaacgggttagaaacggtaaccgggtagggggtttacgagg

SEQ ID NO: 370009 - DNA, 601 bp, Homo sapiens
  misc_feature: GZ8MTXP02F849H.15.23.C01.1.454.CMB.2.raw
  modified_base (306)..(306): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgctctggactcacctttagtagctattggatgagctgggtccnccaggctcgaggggaggggctgggagtggggtggccaaacagtaaaggaagatagggaaagtcaagaaaacactaatgtgggactcgtaggtagaaggggccgtattccacccgatcctccaagacgaccaacgcccaaagaacttcaagtgtaatctagacaaatcgaaacagccctagacggacgcccggaaggaccgacggggtcctaggttacttacgtggtagtcgaaggaacgactaagtcggaaacctaacggggtagaacggtaaaccggggagggggtttacacgg

SEQ ID NO: 370010 - DNA, 762 bp, Homo sapiens
  misc_feature: GZ8MTXP02JJ164.15.23.C01.1.454.CMB.2.raw
  modified_base (388)..(388): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctgagactctcctgtgccgcctctggactcaccttagtagctattggatgagctgggtccgccagggctccgaggggaaggggctgggaggtggggtggccaaacgagtaaaagggaagagtaggggaagtcaaggaaaacncgtaagtcggttgggaacctcgtaggtcggaaagggggccccaatttccaaccctatttacccacccgaaggacgaaacccgaaaccgacccctaaaaggtaaactttaccgaagttggttaaactccgttaagggacctaaaaagttacgggaaaaccgtacggaccccgttaagggaaaacgggaaccgggaccccgggtaaacgggggaacccaaaacccgggggtcccggtttaaggttaaacgttttaccgtggggtttacggtaggaaaaccggtaggaacctaaggttaacgggaaacccggttaaaaccgggggacggtaaaacggtttaaaaccccggggggtaaggggggttttaacgaacggg

SEQ ID NO: 370011 - DNA, 551 bp, Homo sapiens
  misc_feature: GZ8MTXP02FM4MV.15.23.C01.1.454.CMB.2.raw
  modified_base (380)..(380): a, c, t, g, unknown or other
  modified_base (528)..(528): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccagccgggggggtccctgagactctcctgtgccgcctctggactcacctttagtagctattggatgagctgggtccgccagggctccgaggggaagggggctgggagtggggtggccaaacagtaaaaggaagatgggaaagtcagaaaacnctatgtggactctgtgaaaggggcccgaattcaccatcctccagagacaacgccaaagaattcagtgtaatcctgacaaatgaaacagcctgagcgccgagacacggcccgtagtatacgtgtgtagagagacagtgaacaacgggtnaagtaaccgggaggggttgaagg

SEQ ID NO: 370012 - DNA, 627 bp, Homo sapiens
  misc_feature: GZ8MTXP02JX6AE.15.23.C01.1.454.CMB.2.raw
  modified_base (392)..(392): a, c, t, g, unknown or other
  modified_base (565)..(565): a, c, t, g, unknown or other
  modified_base (572)..(572): a, c, t, g, unknown or other
  modified_base (621)..(621): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttccttgttgcttattttagaaggtgtccagtgcgaggagcagctggtggagtcgtgggggaggccgtggtccgagggcccggggggtccctggacgacctctcctgtcgcccgcctctggactcacctttagtagctattggatgagctggtccgcaggctccgaggggagggctggaggtggggtcggaccaaacgaagtaaaaggagagtagggaagtcaaagaaaacnctagtggtgactcgtggtagaaacggggtcctaattccgaacctattcccacccgaagaacgaaccaaacgtaccaaaagtaactttcgagttagtaactcgtagaccgaaaatcgaaacgagcccgtaggacgacggaccggaaggaccgacgggccttaaggtacttacgngttaggngaagacgactagaacgaacgtaaggtcgaaacggtaccgggtagggttntaacgg

SEQ ID NO: 370013 - DNA, 704 bp, Homo sapiens
  misc_feature: GZ8MTXP02I9S28.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgagggccggggggtccctggagactctcctgtcgccgcctctggactctaccttagtagctattggatgagcgtcgggtccgccaggcctaccgaaggggaaggggcgtggggaggtggggtcggaccaaacgaaagtaaaaggaaagagtagggaaagtcaaagaaaacactaagtggtgggaccttcgtaggtaggaaacgggggtcccgtaatttcccgaaaccctattccctacccgaaggaaacgaaacccgtaaaaccgaccccgaaaaaggtaaactttaccgaaaggttagttaaactcccggttaaggaaaccctaaaaagttacggaaaaccgtacgacccgtaaggaacggaccggaccggaacgggtaaccaacggggtcccgttagttaacgttaccgtggtagtagagaacgtacagtaagaccgtaaacggtgaaacgtacggggtaggggttacagg

SEQ ID NO: 370014 - DNA, 779 bp, Homo sapiens
  misc_feature: GZ8MTXP02HKG74.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggggggaggcctggtccaggcccgggggggtccctgagactctcctgtcgccgcctctggactcacctttagagctattggatgagctgggtcccgccaggctccgaggggaacggggctgggagtggggtggccaaacgagtaaaaggaagatagggaagtaccaagaaacactaagtggtggaccttcgtggtacggaaacgggggcccgtaatttcccaacccgattccctacccgaaaggaacgaaacccaaaacccggtacccgaaaagtaaactttaccgaaggttacgttaaactcccgttaggaacccttaaaaagttacgggaaaaccctaacggacccccgtaagggaaacgggaaaccggggacccggggaaaacggggtaacccggaaacccgggggtccccggtttaagggtttaaaccgttttaacccggtcgggtttagggttacgggaacgggtacggaaacccgtagtaaacgggaaccgtaaaaaccgggggttggaaaaaccggttaaaccccggggggttaaagggggttttccggtaaacgggg

SEQ ID NO: 370015 - DNA, 638 bp, Homo sapiens
  misc_feature: GZ8MTXP02ID5RC.15.23.C01.1.454.CMB.2.raw
  modified_base (580)..(580): a, c, t, g, unknown or other
  modified_base (610)..(610): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctatttttagaaggtgtccagtgcgaggagcagctggtggagtcgtgggggaggccgtggtccgaggccggggggtccctgagactctcctgtgccgcctctggactcacctttagtagctattggatgagcgtgggtccgccaggctccgaggggaaggggctgggaggtggggtcggaccaaacgaagtaaaagggaagagtacgggaaagtaccaagaaaaccacttaagtggtgggaaccttcgtgggttaggaaacgggggtcccgtaatttcccaaaccctatccctacccgaaggaacgaaccaaaccggcccaaaagtaattccgagtgtatctagaactaaatcggaaacacgccctagagacggccggtaaggaccgaccgggccgttagttatttaccgngtgtagagagacagtaagaacaacgggtanaacggtaaccggggtaggggtttagagg

SEQ ID NO: 370016 - DNA, 616 bp, Homo sapiens
  misc_feature: GZ8MTXP02G05U0.15.23.C01.1.454.CMB.2.raw
  modified_base (288)..(288): a, c, t, g, unknown or other
  modified_base (602)..(602): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctggagactctcctgtcgccgcctctggactcacctttagtanctattggatgagctgggtccgccagggctccgaggggaaggggctgggagtggggtggccaaacgagtaaaaggaagatacgggaaagtcaagaaacactatgtggactctggtgaaggggccgaatttccaaccattcccacccaaggacgaaccaaacgcccaaagaaactttccaagttgtaaactcgtaggactaaaagtcgaaacgagccctaggacgagcccgtaggaccagggcccgttagtaattacctggtagtaggacgaagaccaagtcggaaacgtaacgggttgaacgtaaaaccgggggnggggtttagaacgg

SEQ ID NO: 370017 - DNA, 738 bp, Homo sapiens
  misc_feature: GZ8MTXP02HIRCY.15.23.C01.1.454.CMB.2.raw
  modified_base (415)..(415): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggaggttggggctgagctgggttttccttgttgctattttagaaggtgtccagtgcgaggagcagctggtggagtcgtgggggaggcctggtccgaggccggggggtcctggagactctcctgtcgccgcctctggactcacctttagtagctattggatgagcgtgggtcccgccagggcctccgaggggaaggggctggggaggtggggtcggaccctaaacgaagtaaaagggaagagtgggaaagtcaaagaaacacgtatggttggacttcgnggtagaaacggggtcccgtaattccaccctaattccctacccaaggaacaaccgaaaccgacccaaaaggtaaactttcgaaggttagttaaactccgttaggaaacctaaaagtacgaaaaccgaggtaaccccgtagggaaaacgggaccggaaccccgggaaagggaacccggtaaaccggggtcccgggtttaagttaaacgtttaccggtggttaggttacggaaggtaaacggaacgttaagaacgggtaaaaccgtaaaacggggttaggtaaaacggttaaaacccggggggttagggggtttacggtaaagggg

SEQ ID NO: 370018 - DNA, 730 bp, Homo sapiens
  misc_feature: GZ8MTXP02GV0EU.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggcccgggggggtccctggagactctcctgtcgccgcctctggactctacctttagtagctattggatgagctgggtcccgccaggcctccgaggggaggggcgtgggaggtggggtcggaccaaacgtaaagtaaaagggaaagagtaggggaaagtaccgaaagaaaaccacgttaagtggtgggtaccttcgtaggttaggaaacgggggtcccgtaatttacccgaaccctagttacccccttcccgaaaggaaccgaaacccgaaaaccgggtcccccaaaaagggtaaaacctttccgtaaaagggtttacgttaaacttccgtaaacgaaactaaagtacgaacgacgtaccgtaggaacggacggaccggacggacgtaccgggtcgttagttacgttacgtcggtaggacggaagacgaacgtacgtaacggaaaccggtaaacggggttacgtaaaaccggtaaacgggggtacggggtttacgtagg

SEQ ID NO: 370019 - DNA, 726 bp, Homo sapiens
  misc_feature: GZ8MTXP02GOUYW.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctccgtgtgccgcctctggactcacctttagtagctatggatgagcgtgggtccgccaggctccgaggggaaggggctgggaggtggggtcggaccaaacgaagtaaaagggaagagtagggaaagtcaaaggaaaaccactagttaggtgggaacttcgtaggtacgaaacgggggccctaatttacccaaccctattaccctacccgaaaggaacgtaaacccgaaaaccgacccgtaaaaaggtaaactttccgaaagtttggtaaacttccttaaggaaccttaaaaagtcggaaaaaccgtacgacccgttaagggaaagtaccgggacccggtaaagggaacccgttaaccgggggccccgtttaagttaacgttttaaccggtgggttaggagaacggaacgaacgtagtaacggaaacgtaaacggggtacgaaacgggttaaacgggggtaggtttacgaacgg

SEQ ID NO: 370020 - DNA, 625 bp, Homo sapiens
  misc_feature: GZ8MTXP02IVZ9G.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccgggggggtccctgagactctcctgtcgccgcctctggactcaccttagtagctattggatgagcgtgggtccgcaggctccgaggggaagggctggaggtggggtggccaaacataaaggagagtaggaagtcaagaaaacactaatggtggactcgtaggtagaaggggccgattccaaccctagttccctaccgaaggacgaaccgaaacgacccgaaaagtaatttacgagttcgttaatccgtagactaaaagtcgaaacacggcctaggacggacgcccggaagggacccacgggtccgttagttacttacgtggtagtacgaggtacgacgagtaaggaaaccgtaacgggtagaaacggttaaccgggggagggtttgaagg

SEQ ID NO: 370021 - DNA, 671 bp, Homo sapiens
  misc_feature: GZ8MTXP02JALV6.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggaggccgtggtccgagggccggggggtccctgacgactctcctgtcgcccgcctcgtggactctaccttagtagctattggatgagcgtggtcccgccgaggcctccgaggggaaggggcgtgggaggtggggtggaccaaacgaagtaaaaggaagagtagggaaagtcaaagaaactactagtggtggactcgtggtaggaaggggccctattcccaaccgtattccctaccaaggaacaaccaaacgccaaaagtacttacgagttagtactcgtagaactaaagtcgaaacacgccgtaggaaggaccggaccggaaggaaccgtaccggggtccgttagtttaacgttaccgttgggtacgttacggaaggaacgtaaccgagttaacggaaaaccgtaacggggtacggtaaacggttaaaccgggggtaggggttacgtaagggg

SEQ ID NO: 370022 - DNA, 618 bp, Homo sapiens
  misc_feature: GZ8MTXP02JFWUG.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggccgggggggtccctggagactctcctgtgccgcctcgtggactcacctttagagctatggatgagctgggtccgccaggcctccgaggggaaggggcgtgggaggtggggtggaccaaacgagtaaaaggaagagtacgggaagtacaagaaaacactaagtgtggactcgtggtagaaggggccgattccacccatccctaccgaagacgaaccaacgaccaaagaacttcgagtgtaatctagactaaaatgaaaccagcccgagaagaggacgaaggaaccgacggtccgtaggttacttacgtaggtggtaggagaacgacgtataaggaaaccgaagggttaggaacggtaaacccgggggtagggggtttacgaagg

SEQ ID NO: 370023 - DNA, 563 bp, Homo sapiens
  misc_feature: GZ8MTXP02I251D.15.23.C01.1.454.CMB.2.raw
  modified_base (407)..(407): a, c, t, g, unknown or other
  modified_base (517)..(517): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgcccgcctctggactcacctttagagctattggatgagctgggtccgcaggctccgaggggagggctggagtgggtggccaacataaaggagataggaagtcagaaacactatgtggactcgtgtgaaggggccagttccactatcnccagagacaacgccaagattcagtgtatctgacaaatgaaactagacctgacgacggaccgaggaacgaccgggccgtaggtacttacgtggtagtagagaacgacgtanaaggaacgaacgggttgaacggtaaccggggtagggggttactagg

SEQ ID NO: 370024 - DNA, 675 bp, Homo sapiens
  misc_feature: GZ8MTXP02JU3ZE.15.23.C01.1.454.CMB.2.raw
  modified_base (609)..(609): a, c, t, g, unknown or other
  modified_base (648)..(648): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggccgggggggtccctgacgactctcctgtcgcccgcctctggactctacctttagtagctattggatgagcgtgggtccgccaggctccgaggggaaggggctgggaggtggggtcgggaccaaacgaagtaaaagggaagagtagggaaagtacaagaaaacactaagtgggtggacttcgtaggtaggaaaggggtcccgtaatttcccgaaccctaattccctaccccgaaggaaacgaaacccaaaccggccccaaaaggtaaactttccgaagttacggttaaatcccgttaggacctaaaagtggaaacccagtacccaggaacggacgaccggaggtaccgacggggtacccgttggtaactttacgnggtggttagaacgtagaccagtcgaacgtaaacggggtnaaacgtaccgggggaggtttacgaagg

SEQ ID NO: 370025 - DNA, 684 bp, Homo sapiens
  misc_feature: GZ8MTXP02JRHNT.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtgggtccgaggcccgggggggtccctgacgactctccgtgtcgccgcctcgtggactctacctttagtagctagttggatgagcgtgggtccgccgaggcctccggaaggggaacggggcgtggggaggtggggtacggaccaaacgaagtaaaagggaagtagtagggaaagtacgaaagaaaacactaagtggtcggtactcgtaggtacgaacggggcctattcccgaaacctattcccaccgaagacgaaccaaacggcctaaaagtaacttccgaagttcgtaactccgtagaactaaaagtcgaaacacggacctaggaacggacggacccggaaggtacccgacgggtccgttagttaaacgttaccgtggtagtacggaaagaacgtacaagtaacggaaacccgtaaaacgggttcggaaaacgtaaccgggggtggggttactaaaggg

SEQ ID NO: 370026 - DNA, 569 bp, Homo sapiens
  misc_feature: GZ8MTXP02ITS26.15.23.C01.1.454.CMB.2.raw
  modified_base (382)..(382): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagtggggctgagctgggttttccttgttgctattttagaaggtgtccagtgcgaggagcagctggtggagtcgtgggggagcctggtccgaggccgggggggtccctgagactctcctgtgccgcctctggactcacctttagtagctattggatgagctgggtccgccaggctccgaggggaaggggctgggaggtgggtggccaacaagtaaaggaagataggaagtcaagaaaacactangtggactctaggtgaaggggcgattcaccatcctcaagagacaacgaccaaagtaatacagtgtatcgtgacaaatcgaaacagacctgaggacgaccgaggaccgacgggaccgttgtacgttacgtggtgtagagacgacagtcgaacgacgggtagaacggtaaccgggtagggggttataggg

SEQ ID NO: 370027 - DNA, 789 bp, Homo sapiens
  misc_feature: GZ8MTXP02HCWET.15.23.C01.1.454.CMB.2.raw
  modified_base (330)..(330): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgttgggttttccttgttgcttattttagaaggtgtccagtgcgaggagcagcgtggtggagtcggtgggggacgtccgtggtccgagggcccggggggtccctggacgacctcctcctggtcgcccgcctctggactcctaacctttagatcttaattggatgagcgtcgggtcccnccgaggcctaccggaaggggaaggggctggggaggtggggtacgaccaaacgaagtaaaagggaagacgtagggaaactacgaaagaaaaccgagttagtagggtcgggaaccttggtagggtaagggtaacgggggtcccttaagtttacccaaacccgtagttacccacccgaaaaggaacgaaacccgttaaaaccggaacccctaaaaggtaaacctttccgaaaggtttaggtaaacttacccgttaggaaaccgtttaaaaagtaacggaaaccgaaccggtaccgtaagggaaaccgggaaccggaaccgggaacggttaacccggtaccgggttacgtttaacgttaacgtttacggtacggttacggtaacgaacgtaacgtaacgtaaggtaacggaaaccggtaaacgggtaacggtaaacgggtaacggggtagggtttacgtacgg

SEQ ID NO: 370028 - DNA, 600 bp, Homo sapiens
  misc_feature: GZ8MTXP02HPCW7.15.23.C01.1.454.CMB.2.raw
  modified_base (316)..(316): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtgggtccgaggcccgggggggtccctggagactctcctgtcgccgcctcgtggacctctacctttagtagctattggatgagctgggtccnccaggctccgaggggaaggggctgggaggtggggtggaccaaacgaagtaaagggaagagtaggaaagtacaagaaaaccatatggtgactctggtggaagggccgtattccgacctatctacagacgacaacgccaaagaatcagtgtatctagactaaagtacgaaacacgccgtaggaacgacggccggaaaggaccgtaccggtaccgtagtactttacgtgtgtagagacgactagaacgacaaacgggtcgtaaggtaaccgggtaggggtttacagg

SEQ ID NO: 370029 - DNA, 737 bp, Homo sapiens
  misc_feature: GZ8MTXP02HEU5C.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtggagtcgtgggggaggcctgggtccgacggccggggggtccctggagactcctcctgtcgcccgcctcgtggactcacctttagtagctattggatgagctgggtccgccaggcctccgaggggaaggggctggggaggtggggtaggacccaaacgaaagtaaaaggaagagtaggggaaatccgaaagaaaacactaagtggtcgggaccttcgtggtaggaacggggccgtaattcccgaacctagttccctacccgaaggacgaaacccaaaccgcccaaaaggtaacttaccgagttacgtaattaccctggaaacctaaaaagtcggaaaacgaccgtacccgttaaggaacggaacggaccccggggtaaggaacccgaacccggggtcccgtttaaggttaactttaaccggttgggttaacggttacgggaagaaccgggaactaagtaacgggtaaaaccgaaaccgggggtacgtaaaacgggtaaaacccgggggtttagggggtttaactaacgggg

SEQ ID NO: 370030 - DNA, 711 bp, Homo sapiens
  misc_feature: GZ8MTXP02J1UGW.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggaggccgtggtccgaggccggggggtccctgagactctcctgtcgccgcctctggacctctaccttagtagctattggatggagtcgtgggtcccgccgaggcctaccggaggggaacggggcgtggggaggtggggtcggaccaaacgaagtaaaagggaagagtagggaagtacaaagaaaaccactaagtggtaggactcgtaggtagggaacgggtcccgtaattcccaaccctagtccctacccgaaggaaacgaacccaaaccggaacccaaaagaaactttaccgaaggttcgttaaacgtaccttaggaaactaaaagtacggaaaaccgacggacctagggaaacggaacggacccggtaagggacccgaccgggtaccgttagttaaacgttacgtagggtacgtaggaagaacgacgtaacgtaacggaaaacgtaaccggggtagtaaaacgggtaaccgggggtaggggtttacgaggg

SEQ ID NO: 370031 - DNA, 623 bp, Homo sapiens
  misc_feature: GZ8MTXP02G1O82.15.23.C01.1.454.CMB.2.raw
  modified_base (427)..(427): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggggggagcctgggtccaggccgggggggtccctgagactctcctgtgccgcctctggactcacctttagtagctattggatgagctgggtccgcaggctccgaggggaggggctggaggtggggtggccaaacgaagtaaaaggaagagtaggaagtacaagaaacactagtgtggacttctagtagaaggggccgattccaacccattccnccaagacgaacaaacgccaaagaacttcagtgtaatctagactaaaatcgaaactagccctaggaacggacggacccggaagggacccgaacggggcccggttagtaacgtttacgtggttaggtagacggagaaccgagtaagaaaccgtaaacggggtacgaaaggtaaacccgggggagggggttactaaggg

SEQ ID NO: 370032 - DNA, 667 bp, Homo sapiens
  misc_feature: GZ8MTXP02G1KV7.15.23.C01.1.454.CMB.2.raw
  modified_base (651)..(651): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcgtgggggaggccgtggtccgacggccggggggtccctggacgactctccgtgtcgcccgtcctctggactctacctttagagctagttggatgagcgtcgggtcccgccgaggcctccggaggggaacggggcgtagggacggtggggtcggacccaaagaagtaaaaggaagagtacggaagtacgaaagaaactactagtgtcggacttcgtaggtagaacggggtctacttccaacctattcccgtaccaaaggacaacccaaacgaccaaaagtacttacgagtctagtctagaacaaatcgaaacgagcccgtaggaacggacgaccggtaaggaccacggggtacgttagttacttacgtagggttgaacggagtaaacgcgtaagttaaggaaaccgtaaacggggtataaaaccgggttaaaccggggngggggtttacaacggg

SEQ ID NO: 370033 - DNA, 701 bp, Homo sapiens
  misc_feature: GZ8MTXP02G5TIO.15.23.C01.1.454.CMB.2.raw
  modified_base (611)..(611): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctcctgtcgccgcctctggactcacctttagtagctattggatgagcgtgggtccgccaggcctccgaggggaaggggcgtgggaggtggggtcggaccaaacgaagtaaaagggaagtagtagggaaagtcaaagaaacacttaagtggtcggacttcgtaggtaggaacggggtcccgaattcccgaaccattcccacccgaaggaacgaaacccgaaaccggacccgaaaaggtaactttaccgaaagttcgttaaacttccgttaggaacctaaaagttcgaaaccgtacgacccgttaggaacggacggacccggaagggaccgaaccggggtcccgttagttacgtttacgnggttggacggaacggaagaccgtaagtaacggaaaccgtaaaacggggttagaaacggttaaacccgggggtagggggtttaactacggg

SEQ ID NO: 370034 - DNA, 637 bp, Homo sapiens
  misc_feature: GZ8MTXP02F8ASS.15.23.C01.1.454.CMB.2.raw
  modified_base (557)..(557): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctgagactctcctgtcgccgcctctggactcacctttagtagctattggatgagcgtgggtccgccgaggcctccgaggggaaggggcgtgggaggtggggtcggaccaaacgaagtaaaaggaagagtagggaagtacaagaaacactaagtggtggactcgtagtggaagggccgattcacctattccaccaaggacgaaccaaacgaccaaagtaacttcgaagttgtaaacttcgagaactaaaagtcgaaacacgaccgtagacggacggaccggaaggaccgacgggtccgtagttacgtttagngggtttagagaggaacgacgtaagtaacggaaacgtaaacggggtaggaaacggtaaaccgggggtaggggttataaggg

SEQ ID NO: 370035 - DNA, 599 bp, Homo sapiens
  misc_feature: GZ8MTXP02GIANC.15.23.C01.1.454.CMB.2.raw
  modified_base (427)..(427): a, c, t, g, unknown or other
  modified_base (458)..(458): a, c, t, g, unknown or other
  modified_base (593)..(593): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggcccggggggtccctgagactctcctgtgccgcctctggactcacctttagtagctattggatgagctgggtccgccaggctccgaggggaagggcgtgggaggtggggtcggaccaaacgaagtaaaagggaagagtaggggaaagtcaaagaaacactatggtggtactcgtgtaggaagggccattccaccntccacagagacaacgccaaagtattcagttntatcgtagacaaaagttcgaaactgaccctaggaacggacgaccggaaggaccgacgggccgttagttacttagtggtggtacgagaacgactagtaagaaccgtaagggtacgaaacgtaacggggtagggttntaacgg

SEQ ID NO: 370036 - DNA, 609 bp, Homo sapiens
  misc_feature: GZ8MTXP02JX1K6.15.23.C01.1.454.CMB.2.raw
  modified_base (343)..(343): a, c, t, g, unknown or other
  modified_base (565)..(565): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaagcctggtccaggccgggggggtccctgagactctcctgtgccgcctctggactcacctttagagctattggatgagctggtccgcaggctccgaggggagggctggagtggatggaccaaanagtaaaggaagagtaggaagtcaagaaacactaatggtaggactcgtgtaggaacggggccgtagttccaacccgtattccctacccgaaggaacgaaccaaccgaccgaaaggtaattccgaagttgtaacttctaggaacctaaaagtcggaaaaccaggtccctaggaagacggccggaaggaccgacgggtccgtagttattacgtggtggtagaagngacaagtagaaccgacggtagaacgtaaccggggaggggtttag

SEQ ID NO: 370037 - DNA, 616 bp, Homo sapiens
  misc_feature: GZ8MTXP02HZFMF.15.23.C01.1.454.CMB.2.raw
  modified_base (308)..(308): a, c, t, g, unknown or other
  modified_base (477)..(477): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctgagactctcctgtgccgcctctggactcacctttagtagctattggatgagctgggtccnccaggctccgaggggaaggggctgggagtgggtgccaaacagtaaaagggaagatgggaaagtcaagaaaacactagtgtggaactcgtagtaggaacggggccatttccgacaatctccagacgactaacgccaaagaacttcagttgatcgtagacaaatgaaaccngacaggaacgacggacgacggacgtaccgggtcgttacgttaacgttacgtggtacggtacggaacgtaacgaaccgagtaacggaaacggtaacgggtacggaaaaccgggttaacgggggtagggggtttacgtagg

SEQ ID NO: 370038 - DNA, 552 bp, Homo sapiens
  misc_feature: GZ8MTXP02JQ2OR.15.23.C01.1.454.CMB.2.raw
  modified_base (380)..(380): a, c, t, g, unknown or other
  modified_base (456)..(456): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctggggggaggcctgggtccaggccggggggggtccctgagactctcctgtgccgcctctggactcacctttagtagctattggatgagctgggtccgccaggctccgagggaaggggctgggagtgggtggccaacataaaggaagatagggaatcagaaacactaangtgactctggtgaagggccattcaaccatcctaccagacgacaacgcccaaagaattcagtgtaatctagcaaatnaacagcctagagagccgagacgacgctacgtattactgtgtagagacggacagtcgaacgaacggtagaagtaaacccggggaggggttagtaagg

SEQ ID NO: 370039 - DNA, 696 bp, Homo sapiens
  misc_feature: GZ8MTXP02F9HUU.15.23.C01.1.454.CMB.2.raw
  modified_base (321)..(321): a, c, t, g, unknown or other
  modified_base (581)..(581): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcttgggttttccttgttgcttattttagaaggtgtccagtgcgaggagcagctggtggagtcgtgggggagccgtggtccgacgggcccggggggtccctggagctctcctgtcgcccgcctcgtcggactctacctttagagcttagttggatgagtcgtcggggcccnccgaggccgtaccggaagggggaacggggcgttaggggagggttggggtacggaaccccaaaagaaagtaaaaaggggaaagtaagttaggggaaaacgttacaaaacggaaaaacctacgttaagttggtcgggtacttcggtagggtaacgggaaaccgggggcctaaatttcccaaacctacttcccgaccaaagaacgaaacccaaaccgccaaaagtacttcgaagttgtatactagaactaaaagtcgaaaacncgaccgtaggaacgacggtacccggaaggaccgtacgggtccgtagttaacttcgtggttagaggagacgactagaacgaacgaacggtagaacggtaaccgggtgggtactagg

SEQ ID NO: 370040 - DNA, 724 bp, Homo sapiens
  misc_feature: GZ8MTXP02HQY7K.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggcccgggggggtccctggagactctcctgtcgcccgcctctggactcacctttagtagctattggatgagtctgggtccgcaggctccgaggggaaggggctggaggtggggtcggccaaacgagtaaaaggaagagtaggaaagtacgaacgaaaacacgttaatggtgggtaacttcgtggttacggaaagggggccctaatttcccgaaccctaacttcccgtacccaaggaacgaaacccgaaaccgaacccgtaaaaggtaaactttaccgaaggttaggttaacttaccgttacggaactaaaattacggaaaacaacggaccctaggaaacggaccggtaccggaaagggtaccgaaccggggcccggttaggttaaccgtttaacgttgggttacggttacggaaggacggaaccaagtaacggaaaaccgtaacggggttacgaaagggttaaaacccggggtagggggtttacgtaaggg

SEQ ID NO: 370041 - DNA, 664 bp, Homo sapiens
  misc_feature: GZ8MTXP02HA6N3.15.23.C01.1.454.CMB.2.raw
  modified_base (585)..(585): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggaggccgtgggtccgagggcccggggggtccctggacgactcctcctgtcgcccgcctctggacctctacctttagtagctattggatgagcgtgggtcccgccaggcctccggaggggaaggggcgtgggaggtggggtcggacccaaacgaagtaaaaggaagagtagggaaagtcaaagaaaacacttaagtggtcggacctcgtggtagaacgggccgtaattcccaaccattcccaccgaagacgaaccgaaccgacccaaagtaactttcgaagttgtaaatcgtagaactaaatacggaaccagcctaggaacggacggacccggtaggaccgacggggtccttagtaactttaccggnggtcgtaggaggaacacgaagtaacggaaacgaaacggggttagaaacggtttaaaccgggggagggtttagtaacggg

SEQ ID NO: 370042 - DNA, 632 bp, Homo sapiens
  misc_feature: GZ8MTXP02GJKVO.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggagcctggtccgaggccggggggtccctgagactctcctgtcgccgcctcgtggactcacctttagagctattggatgagctgggtccgccaggctccgaggggaaggctgggaggtggggtcggaccaaacgaagtaaaaggaaagagtaggaagtacaagaaaacactagtgtggactcgtgtagaacgggccgattaccgacccattcccgaccaagacgaaccaaacgcccaaagtaacttcagtgtaaatcctagacaaaagtcgaaacacgacctagggaacgacgacccgggaaggaaccgaccgggacccgttagttaaactttacgtggtggtaggaacgaagacgtaatggaaacccgtaaaacgggtgaaaccggttaaaccggggtagggggtttagaagg

SEQ ID NO: 370043 - DNA, 684 bp, Homo sapiens
  misc_feature: GZ8MTXP02H6Y20.15.23.C01.1.454.CMB.2.raw
  modified_base (618)..(618): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggaggccgtggtccgaggccggggggtccctggagactctccgtgtcgccgcctcgtggactctacctttagtagctattggatgagcgtggtccgccgaggtctccggaaggggaaggggcttggggaggttggggtacggaccaaacgaagtaaaagggaagagtagggaaacgtacaaagaaaaccataagttggtcgggaacttcgttagggtaggaacggggcccgtatttccaaagttccaattccctaccgaaaggaaccgaaaccaaaaccggccaaaaaggtaactttcgaaggtttagtactttaccgacgaactaaaaagtccggaaaacacgggtacctaggaacggaacgcccggaaggtacccgacggggttcgtattaatttcgnggttagagacgacgaacgtaagtacgaaacggtacgggtagtaaacggttaacgggggtaggttag

SEQ ID NO: 370044 - DNA, 632 bp, Homo sapiens
  misc_feature: GZ8MTXP02F91V2.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggcccgggggggtccctggagactctcctgtgcccgcctctggactcacctttagtagctattggatgagcgtgggtcccgccaggcctccggaggggaaggggcgtgggaggtggggtcggaccaaacgaagtaaaagggaagagtagggaagtacgaaagaaaacactagtggtggactcgtaggtaggaacggggccgattcccaacctatccctaccgaaggacgaaccaaaccggcccaaaagtaactttcgagttgtaatctagactaaaatgaaacagcctaggaacgacggaccgagggacgaccgggaccgttagttacttacgtggttagtaggacgtagacagtaacgaacgtaacggtagaacggtaaccggggaggggtttcgaagg

SEQ ID NO: 370045 - DNA, 739 bp, Homo sapiens
  misc_feature: GZ8MTXP02JAAKS.15.23.C01.1.454.CMB.2.raw
  modified_base (308)..(308): a, c, t, g, unknown or other
tcagtctacgtagccacgaccggtgctcgatttagtacacgtgattagggattgggaggtctcagagatgagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggcccggggggtccctgagactctcctgtcgccgcctctggactcacctttagagctattggatgagctgggtccncaggctccgaggggaaggggctgggagtggggtgaccaaacgaagtaaaagggaagagtagggaaacgtcgaaaggaaacacgttagtcggtagggaccttcgtaggtacgggaaacggggccccgtatttacccgaaccctaattccctacccgaaaggaaacgaaacccgaaaacccggacccaaaacggtaaaactttacctaaaggttaggtttaaacttaccgttacggaactaaaaagttcggaaaaccgaccgtacccgtagggaacgaacggacccggaaagggacccgaaccggggtcccggtttaggttaacgtttaccgttaggtacggttacgggaaacgtaaggtaaccaagttacggaaaccggtaaaaccggggttggaaaacgggttaaacccgggggtaagggggttttaacgg

SEQ ID NO: 370046 - DNA, 663 bp, Homo sapiens
  misc_feature: GZ8MTXP02JWAZB.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggaggccgtggtccgagggccggggggtccctggagactctcctgtcgccgcctcgtggactccacctttagagctattggatgagcgtggtcccgccaggctccgaggggaagggcgtgggagtggggtagaccaaacgaagtaaaaggaagatagggaagtcaagaaaactcgtaatggtggaccttgtaggtagaacggggtcctaatttcccgaacctatcccgtaccgaagacgaaccaaaccgacccgaaaagtaatttaccaggttacgtaacttcctaaggaaccctaaaagttcgaaaaccgaggtacccgttaggaacggacgacccgggaaagggacccgacggggtcccgttagtaaacgttcgtaggtaggtaggaagacgacaagtaacgaacgtaaacggtgaaacgtaccggggtaggggttacgtagg

SEQ ID NO: 370047 - DNA, 579 bp, Homo sapiens
  misc_feature: GZ8MTXP02I14PU.15.23.C01.1.454.CMB.2.raw
  modified_base (433)..(433): a, c, t, g, unknown or other
  modified_base (577)..(577): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggtttcctgtgctattttagaggtgtccagtgcgaggagcagctggtggagtcgtgggggaggcctggtccgaggccgggggggtccctgagactctcctgtgccgcctctggactcacctttagtagctattggatgagcgtcgggtccgccaggcctccgaggggaaggggctgggaggtggggtggccaaacgaagtaaaggaagatacgggaagtcgaagaaacactagtgtgggactctggtgaacgggggccattccaccatccaccaaganacaacgccaaagtacttcgaagtgtatctgactaaatggaacagccctagagacgccgaaggacgacggccgtagttacttactggtgtagagagactagaagaaccgtaacgggtagaacgtaaccggggtagggggtttaanag

SEQ ID NO: 370048 - DNA, 679 bp, Homo sapiens
  misc_feature: GZ8MTXP02JP65U.15.23.C01.1.454.CMB.2.raw
  modified_base (416)..(416): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgttgggttttccttgttgcttattttagaaggtgtccagtgcgaggagcagctggtggagtcgtgggggaggccgtggtccgagggtcccggggggtccctgacgactctccgtgtcgcccgcctcgtggacctcctacctttagtagctagttggatggacgcgtcgggtccccgccgaggcctccggaaggggaaggggctgggaggtggggtcgaccaaacgaaagtaaaaggagagtaggaacgtcaaagaaacactanggtcgactcgtaggtaggaacgggtcccgtaattcccaacctatcccgtacccgaaggaacgaaccgaaacccgacccaaaagtaacttcgagttgttaatcctagactaaaagtacgaaacagacccgtaggaacggacgacccggaacggtaaccgaccgggtccgttagttactttaccgtggtagtaggaacgtagaacagtaacgaaacgtaaacgggtacggaaaaccggttaaccggggtaggggtttcgtaaggg

SEQ ID NO: 370049 - DNA, 660 bp, Homo sapiens
  misc_feature: GZ8MTXP02H525G.15.23.C01.1.454.CMB.2.raw
  modified_base (313)..(313): a, c, t, g, unknown or other
  modified_base (655)..(655): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccgagggccggggggtccctggacgactctcctgtcgccgcctctggactctacctttagtagctattggatgagcgtgggtccnccaggcctccgaggggaaggggctgggaggtggggtgaccaaagagtaaaagggaagagtaggaagtacaaggaaaacactaagttggtcgggtaaccttcgttaggtaggaaacggggtcccgtaatttacccgaaccctatccctacccgaagaacgaaccaaaaccgtacccaaaagtaacttaccgagttagtaacttccgtagaacctaaaatacggaaacaggccctaggacgacggaccggtaagggaccaacgggtccgttagtactttacgtgtaggtagacgaagacagtaagaaacgtaacggtagaaacggtaaccgggggtgggtttanaacgg

SEQ ID NO: 370050 - DNA, 628 bp, Homo sapiens
  misc_feature: GZ8MTXP02JZSXH.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccagggccggggggtcctgagactctcctgtgcccgcctcgtggactctactttagagctatggatgagcgtggtccgccaggcctccggaggggaagggcgtgggaggtgggtacgaccaaacaagtaaaaggaagagtagggaagtacgaaagaaaacactaagtggtacggacttcgtaggaggaacgggccgtaattcccaacccgtatccctaccgagacgaaccacgaccaaagtaactacgagtgtatcgtagaacaaatagaacgacgacgtaggagacggaccggaggaccgacggtccgtagttacgttacgtggtagtacggtagacgtaacgagtaacgaacggaacggtacggtaaacggttaaccgggggtaggggttacgtagg

SEQ ID NO: 370051 - DNA, 654 bp, Homo sapiens
  misc_feature: GZ8MTXP02HZB69.15.23.C01.1.454.CMB.2.raw
  modified_base (563)..(563): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtggagtcgtgggggaggccgtggtccgaggcccgggggggtccctgagactctcctgtcgccgcctctggacctcacctttagtagctattggatgagcgtggtccgccgaggctccgaggggaggggctgggaggtggggtgaccaaacagtaaaaggaagatggaatacaagaaacactagtgtggacttcgtggtagaacggggccaatttccaacccattcccaccgagaacgaccaaacgaccgaaagtaactcgagtgtaatcctagaactaaagacgaaacgacgacccgtaggaacggacggacccggaaagggtacccgacgggtacccgttagttaacgtttaacgnggtttaggtacggaacgaagaacctagttaaccgggaaacctaaaggggttacgaaacggttaaacccgggggttagggggttactaaggg

SEQ ID NO: 370052 - DNA, 691 bp, Homo sapiens
  misc_feature: GZ8MTXP02I7D6R.15.23.C01.1.454.CMB.2.raw
  modified_base (616)..(616): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccgaggcccggggggtccctgagactctcctgtgcccgcctctggactcacctttagtagctattggatgagcgtgggtcccgccaggcctccggaaggggaacggggtctggggaggtggggtggacccaaacgaagtaaaagggaagagtagggaaagtcgaaagaaactactagtgtgggacctcgtaggtacggaaaggggtccctaagttcccaaaccgtattaccccacccgaaaggaacgaacccgaaaaccggacccaaaaggtaaactttccgaaagttgttaaactccgttaaggaaactaaaagttcgaaaacctaacgcccgtaggaacgaacggacccggaaggacccgaaccgggtccgttagtaactttacgnggtaggtacgaagacgacaagtcggaaacgtaaacgggtagaacggttaaaccgggggtaggggtttacgtaagg

SEQ ID NO: 370053 - DNA, 660 bp, Homo sapiens
  misc_feature: GZ8MTXP02H5PP9.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggcccggggggtccctggagactctccgtgtcgccgcctcgtggacctctaccttagtagctagttggatgagcgtcgggtccgccgagggctccggaaggggaaggggcgtgggaggtggggtggaccaaacgaaagtaaaagggaagagtaggaagtacaagaaacactagtgtcggactcgtgtagaaggcccgtagttccaaaccctatccctaccgaaggaacgacgaaaccgaccaaaagtaacttcgaggttatactacgttagaaactaaaagtacgaaacgacgaccgtaggaaacggaccggaccggaagggaccgacccgggtccgttagtaacttagtcgtaggtacggagacggtacagtaacggaaacgtaaaccgggtgtaaaccggtaaacgggggtaggggttactaagg

SEQ ID NO: 370054 - DNA, 621 bp, Homo sapiens
  misc_feature: GZ8MTXP02HGORE.15.23.C01.1.454.CMB.2.raw
  modified_base (478)..(478): a, c, t, g, unknown or other
  modified_base (551)..(551): a, c, t, g, unknown or other
  modified_base (616)..(616): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggccggggggtccctgagactcctcctgtgccgcctctggactcacctttagtagctattggatggagcgtcggggtcccgccgaggcctccggaggggaaggggcgtggggaggtggggtcggaccaaacgaagtaaaaggaagaagtagggaaagtcaaagaaaacactaagtggtgggacttcgtaggtaggaacggggccattccacatccaccagacaacaacgccaaagtacttcagtntatctagactaaaagtcgaaacgagacctaggaggacgccggaaggacccgacgggtccgtagttacttacgnggttagtacgagacgacagtaacggaacgtaacgggtagaacggtaaaccgggggtggggtttanaacgg

SEQ ID NO: 370055 - DNA, 766 bp, Homo sapiens
  misc_feature: GZ8MTXP02HJR1N.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcttgggttttccttgttgcttattttagaaggtgtccagtgcgaggagcagctggtggagtcgtgggggaggccgtggtccgacgggcccggggggtccctgagactcctccgtgtcgccgcctcgtggacctctacctttagtagcttattggatggagtcgtcgggtccccgccgaggcctaccggaaggggaacggggtcgtaggggaggttggggtacggacccaaaacgaaagtaaaagggaacgaagtaacgggaaagtaccaaagaaaactacgttaagtgggtagggaccttcggtggtaagggaaacgggggtcccctaaagtttaccccgaaccctacgttaccctacccgaaaggtaacgaaacccaaaaccggacccaaaagtaaacttaccgaaggttacttaacttccgttaagaacctaaaagtacggaaacctacggaccctaggaaacggacggacccggaacgggaaccgtacccgggtacccggtttagtttaaccgttaccggttaggttacggtaacggaacggaacggaactagtaacggaaacgtaaacggggtaggtaaaaccggtacgggggttaaggggtttacgtagg

SEQ ID NO: 370056 - DNA, 804 bp, Homo sapiens
  misc_feature: GZ8MTXP02GMQ5K.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggaggttggggctgagcgttgggttttccttgttgtcttattttagaaggtgtccagtgcgaggagcagcgtgggtggaggtcggtgggggacggccgtcgggtccgacggggtcccgggggggtccctggacgacctcctccgtcggtcgcccgtcctcgtcggaccttctacctttagtagtctagttgatgaggcgtcggggtcccaccgagggtccctaccgggaagggggaacgggggcgttagggggtacggttcggggggtacggaacccgaaaacggtaaaaggtaaaaaaggggaaaggtaaggtaacggggtaaacgtaaccgaaaacggaaaacctaagtttaggtcgggttacggggtaccttcggttaggggtaacgggaaccgggggtcccttaattaccccgaaccttacttccccgaacgaacggaaaccgaaaccgaaaacccggaccctaaaaggttaacttacggaaagttagttaacttaccggataaacgtaaaagtaccggaacgtacgtaccgagggaaacggaccggaacccgggaggaacccgaccggggttacttagttacgttagtgtaggaagtaacgacgtacgttaaggaacgaacggtaaacgggtagaacgggttaaacggggtggggttatggg

SEQ ID NO: 370057 - DNA, 622 bp, Homo sapiens
  misc_feature: GZ8MTXP02GLSUL.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccagccgggggggtccctgagactctcctgtgccgcctctggactcaccttagagctattggatgagcgtgggtccgccgaggcctaccggaggggaaggggcgtaggggaggtggggtcggaccaaacgaaagtaaaagggaagagtagggaaacgtcaagaaacacttagtggtggactcgtaggtaggaacggggccgtaattccgaacccagttccctacccgaagaacgaaaccaaacgacccaaagtaacttcaagtgttaatcgtagacaaatgaaacagcctgacgagaccgaggacgacgggcgtagtattcgtggtgtagagacgtacagtaacggaaaccgtaacggggtagaaccggtaaccgggggtaggggtttagtaagg

SEQ ID NO: 370058 - DNA, 736 bp, Homo sapiens
  misc_feature: GZ8MTXP02JCMU3.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgagggccggggggtccctgagactctcctgtcgcccgcctctggactctaccttagtagctattggatgagcgtgggtccgccaggcctccggaggggaaggggcgtggggaggtggggtcggaccaaacgaaagtaaaagggaagagtagggaaagtcaaataaaaccactagtgtgggactcgtggtaggaacggggccctagttacccaacctactaccctcccgaaggaacgaaaccgaaccgacccaaaaggtaaactttccgaaggttcgttaaattccgttaggaaacctaaaaagtacggaaaacctaacggtacccgtaagggaacggacgggaacccggtaaacgggaacccgaaaccgggggtcccggttaagttaaacccgtttacgttagggttaggtaacgggtaaaggaacggaacctaaggtaacgaaaaccgggaaacgggttacggaaaaccggttaaaccgggggttagggggtttaagtaacgggg

SEQ ID NO: 370059 - DNA, 633 bp, Homo sapiens
  misc_feature: GZ8MTXP02HNES2.15.23.C01.1.454.CMB.2.raw
  modified_base (351)..(351): a, c, t, g, unknown or other
  modified_base (491)..(491): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttccttgttgctattttagaaggtgtccagtgcgaggagcagctggtggagtcgtgggggaggcctggtccgaggcccgggggggtccctgagactctcctgtgccgcctctggactcacctttagtagctattggatgagctgggtccgcaggctccgagggaaggggctgggaggtgggtggaccaaanagtaaaggagatgggaagtcaagaaacactatggtggaccttgtgtaggaacggggtccgtaatttcccgaaacctatccctaccaaggacgaaaccaacgaccaaaagtaacttcgagtgttaatcctagaactaaaanacgaacgacgtacgaggacggacggaccggaacggacgtaccgggtccgttagtaacgttgtaggtagtacggaagacggtaagtagtaacggaaacggtaacgggtacggtaaacgggtaacgggggtagggtttagtagg

SEQ ID NO: 370060 - DNA, 567 bp, Homo sapiens
  misc_feature: GZ8MTXP02IQZZA.15.23.C01.1.454.CMB.2.raw
  modified_base (307)..(307): a, c, t, g, unknown or other
  modified_base (415)..(415): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgcccgcctctggactcacctttagtagctattggatgagctgggtccncaggctccgaggggaaggggctgggagtggggtggccaacagtaaaggaagatggaagtcaagaaacactatgtggactcgtgtagagggcgatcaccatcgtcaganacaacgccaaagattacagtgtatctagacaaatgaacagcctgagcgaccgaggactacggccgttagtatttacctggtagtacgagaagacctaagtaacggaaacgtaacgggtagaaggtaaacccggggtagggggtttacgaagg

SEQ ID NO: 370061 - DNA, 704 bp, Homo sapiens
  misc_feature: GZ8MTXP02JE1TL.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccaggccgggggggtcctgagactctcctgtgccgcctctggactcacttagtagctattggatgagctgggtccgccaggcctccgaggggaaggggctgggaggtggggtggccaaacgaagtaaaaggaagtagtaggggaaagtaccaagaaaaccacgtaagtggtggggaacctcgttaggtacgggaaggggccgtattccaaaccctaatcctacccgaaaggacgaacccgaaaaccgtaccccgaaaaggtaaaactttccgaaaagggtttacgttaacgtacgtaacggaaactaaaacgtacggaaaccgacggtacccgtaaggaacggaaccgggaccggaacgggtaaccgacgggtaccggttacgttaacgtttacggtcgggtaggtacggaacgtaacgacgaagtaacggaaacgtaacggtaggtaacggtaaaccgggggtagggtacgtacgg

SEQ ID NO: 370062 - DNA, 669 bp, Homo sapiens
  misc_feature: GZ8MTXP02HVHA0.15.23.C01.1.454.CMB.2.raw
  modified_base (312)..(312): a, c, t, g, unknown or other
  modified_base (594)..(594): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggcccggggggtccctggagactctcctgtcgccgcctcgtggactctacctttagagctattggatgagctgggtccncaggctccgaggggagggctgggaggtgggtcggaccaaagaagtaaaaggagagtagggaaagtacaagaaaacacttaagtggtggtactcgtaggtacggaagggcccgtattcccaaccctattcccaccgaaggaacaaacccgaaaccgaccctaaaaggtaacttccgaaagttcgtaaacttccgtaagaacctaaaaagtcgaaaaccgcgtaccctagggaacggaacgccccgggaaaggaccgaccgggtccgttagtttaacttacggnggtaggtacggaagtacgaactagtaacggaacgtaaacgggtgaaaccggttaaacgggggtggggtttacagg

SEQ ID NO: 370063 - DNA, 631 bp, Homo sapiens
  misc_feature: GZ8MTXP02FUACK.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtcccctggagactctcctgtcgccgcctctggactcacctttagtagctattggatgagcgtgggtcccgccaggcctccgaggggaaggggctgggagtggggtgccaaacagtaaaggaagagtaggaagtcaagaaacactatgtggactcgtaggtagaaggggcccgattaccaacctataccctcccgaagaacggaaccaaacggacccaaagaacttcgagtgtaatcctagactaaaatcggaaacacggaccctaggacgacggacccggaaggaacccgacgggtcccgttagttacgtttaacgtggtaggtaggacgaacgactaagaaggaacgaaacgggtcgaaacggttaaccggggaggggttacgtaagg

SEQ ID NO: 370064 - DNA, 591 bp, Homo sapiens
  misc_feature: GZ8MTXP02JSV95.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggcccgggggggtccctggagactctcctgtcgccgcctctggactcaccttagtagctattggatgagctgggtccgccaggctccgaggggaaggggctgggaggtggggtggaccaaacgaataaaaggaaagatagggaagtcaagaaaacacatgtggactcgtgtgaaggggccgattccacatctccagagaacacgccaaagaattcagtgtatcgtagcaaaatcgaaacacgcctggaagacgcccgagggaccacgggccgttaggtacttaccgtggtagtgaacgagaacctagtcggaaactaaaccggggtgaaaacgtaacccgggggtagggggtagtaagg

SEQ ID NO: 370065 - DNA, 755 bp, Homo sapiens
  misc_feature: GZ8MTXP02I8DVF.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttccttgttgcttattttagaaggtgtccagtgcgaggagcagcgtggtggagtcgtgggggagccgtggtccgagggcccggggggtcctgacgactcctctgtcgccgcctcgtgactcacctttagtagctagttggatgagcgtcgggtccgccgaggcctaccggaggggaaggggctagggaggtggggtcggaccaaacgaaagtaaaaggaaagtagtaggggaaacgtcgaaagtaaaaccacttagaggtcgggaccttcgtagggtaggggaaaccggggtcccgtaactttcccaaacctactttaccccgaacccgaaaggaacgaaaacccgaaaacccgtaacccgaaaaggttaactttacccgaggttagttaaactcccgttaaggaaccctaaaagtacgaaaccgtaacggacccgtagggaacggaacggaccccggtaagggaaccgtaaccgggaccggtttagttaacgttacgtacggtaggttacggacgaaggtaacccagtaacggaaacccgttaaacggggaggtaaaacgggttaacccgggggtaggggttacggttaacggg

SEQ ID NO: 370066 - DNA, 724 bp, Homo sapiens
  misc_feature: GZ8MTXP02FPKW3.15.23.C01.1.454.CMB.2.raw
  modified_base (521)..(521): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgcttattttagaaggtgtccagtgcgaggagcagcgtggtggagtcgtgggggaggccgtggtccgaggccggggggtccctgagactctcctgtcgcccgcctctggactcctacctttagagtctattggatgagcgtgggcccgccgaggcctccggaggggaaggggcgtagggaggtggggtcggacccaaacgaagtaaaagggaagagtaggggaaagtacgaagaaaacctacgtaagtggtggactcgttaggtacggaaacggggcccgtacttccaacccattccctacccgaaaggacgaaacccgaaacccgacccgaaaagtaaactttccgaaaggttnttaacgtaccttaaggaaactaaaagttcggaaaaaccgtagaccccgttagggaaacggaacgggccccggaaacgggtaacccgaccggggtacccgtttaaggttaactttacgtaggttaggtagaaaccgaacgacgaagtaacggaaccgtaaacgggttacggaacggtttaaaacggggaggggtttacgtaagg

SEQ ID NO: 370067 - DNA, 579 bp, Homo sapiens
  misc_feature: GZ8MTXP02IMCHB.15.23.C01.1.454.CMB.2.raw
  modified_base (435)..(435): a, c, t, g, unknown or other
  modified_base (516)..(516): a, c, t, g, unknown or other
  modified_base (524)..(524): a, c, t, g, unknown or other
  modified_base (534)..(534): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgcccgcctctggactcacctttagtagctattggatgagctgggtccgccaggctccgaggggaaggggctgggaggtggggtggaccaaacgaagtaaagggaaagagtacgggaagtcaagaaaacactatgtgggactcgtggtgaaggggccgattcaccatcctccaganacaacgccaaagacttcagtgtatctagactaaatgaacagcctagagacgccgaaggtaccgacggcctaggtattacgnggttacgnggagaccganagtcgaacgaacggggttgaagtaaaccgggggtggggttatagg

SEQ ID NO: 370068 - DNA, 627 bp, Homo sapiens
  misc_feature: GZ8MTXP02JPMYE.15.23.C01.1.454.CMB.2.raw
  modified_base (481)..(481): a, c, t, g, unknown or other
  modified_base (610)..(610): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggaggcccgtggtcccgaggcccgggggggtccctgagactctcctgtgccgcctctggactcacctttagtagctattggatgagctgggtccgccaggctccgaggggagggctgggagtgggtggccaaacgaagtaaaaggaagatagggaaagtcaagaaaacactatggtggacttcgtggttaggaaggggcccgtaattccaaccctatccctacccgaggacgaaccaaacgccaaagtaacttcagttgatcngacaaagtgaacagacctaggaagacgaccggaaggaccgacgggtcccgttaggtactttacgtggttgtacggaacgaaggactaagtcggaaacgaacggggttagaaacggtaaaacccgggggngggggtttacgtaaggg

SEQ ID NO: 370069 - DNA, 707 bp, Homo sapiens
  misc_feature: GZ8MTXP02HG21R.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggcccggggggtccctgagactctcctgtgcccgcctctggactcaccttagtagctattggatgagcgtgggtccgccaggctccgaggggaaggggctgggagtggggtggaccaaacgaagtaaaaggagagtgggaaagtcaagaaaacactagtggtggacttgtgtaggaaacgggccgaattccgaaccctattccctacccgaaggaacgaaacccgaaccggaccctaaaaggtaactttaccaaggttcgttaatccgttagacctaaaaagtcgaaaactacgacccgtaggaacggacggacccgggaaagggaacccgtacccgggggcccggtttaaggttaacgtttacccggttgggttacggtacggaaaggtacgaaccgtaaggttcggggaaaccgtaaaaccgggggttggaaaaccggttaacccggggggtaagggggtttacgtaacggg

SEQ ID NO: 370070 - DNA, 704 bp, Homo sapiens
  misc_feature: GZ8MTXP02H2HCO.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggagccgtggtccgagggccggggggtccctggagactctcctgtcgccgcctcgtggactcctacctttagagctattggatgagtcgtgggtcccgccgaggcctccggaaggggaacggggctaggggaggttggggtacggaccaaacgaaagtaaaacgggaaagagtaggggaaagtcaaagaaaaccacgttagtgtcggactcgtggggtaggaacggggccgtaatttcccaacctatccctacccgaaggacgaaacccaaacggtacccaaaggtaaactttccgaggttagttaaatcccttaaggaacctaaaagttacgaaaaccgtacggaccctagggaaacgaccgggaccggaacgggaccgtaaccggggtcccgtttaaggtacgttttaacgtggtacggtaagacggactaacgagtaacgaacgtaacgggtagtaacggaaccgggggtagggtttacgagg

SEQ ID NO: 370071 - DNA, 755 bp, Homo sapiens
  misc_feature: GZ8MTXP02JN2WL.15.23.C01.1.454.CMB.2.raw
  modified_base (308)..(308): a, c, t, g, unknown or other
  modified_base (355)..(355): a, c, t, g, unknown or other
  modified_base (377)..(377): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccaggccggggggtccctgagactctcctgtcgccgcctctggactctacctttagtagctattggatgagctgggtccncaggcctcgaggggagggctggagtgggtgccaaagagtaaaagganagtaggaagtcgaagaaaaccntaatggtgggactcgtaggtagaacggggtccctaaattccaaccctaatccctacccgaaggaaacgaaccgaaaaccggacccaaaaggtaaaactttccgaaaaggttgttaaactccgttagaaacctaaaaagttacggaaaaccgtaacggtcccgtaagggaaaacggtaccgggacccggtaaaggggaaaccccgaaccgggggtaccccggtttaagggttaaaacccttttaaacgggtcgggttacgggttacggaaagggtaaccgggaaaccaagttaacggggaaaaccggtaaaaacccgggggttacgggaaaaccggtttaaaaccccgggggggtagggggtttaacgtttaaacgggg

SEQ ID NO: 370072 - DNA, 605 bp, Homo sapiens
  misc_feature: GZ8MTXP02GDDI6.15.23.C01.1.454.CMB.2.raw
  modified_base (489)..(489): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccgggggggtccctggagactctcctgtcgccgcctctggactcacctttagagcttattggatgagctgggtccgccaggctccgagggaagggctgggagtgggtcgaccaaacataaaggagatcggaagtcaagaaacactatgtggactcgtgtagaacgggccgtattccgaaccatcctacccgaagacgaaccaacgaccaaagtaacttcgagttagtactactacggaacaaaagtgaaaaccngtacccgtgaacggacgaccggaaggaacgccgggtaccgtgttaaactacgtggttagcgaagatacgagtaacgaacgaacgggttgaacgttaacgggggtggttagtaacgg

SEQ ID NO: 370073 - DNA, 584 bp, Homo sapiens
  misc_feature: GZ8MTXP02F77I1.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggcccgggggggtccctgagactctcctgtgccgcctctggactcacctttgagctattggatgagctgggtccgccaggctccgaggggaaggggctgggagtggggtggccaaacgagtaaaaggaagatagggaagtcgaagaaacactatgtggactcgtgtagaagggccgattcaccatcctcaagacgacaacgaccaaagtaacttcagtagtatctagacaaatgaacagcctagagacgaccgaaggaccacgggtaccgtagtacgttactggtggtacgagacgacaagtaacggaaacgaacggggttagaaacgtaaccgggggtaggggttcgtaagg

SEQ ID NO: 370074 - DNA, 724 bp, Homo sapiens
  misc_feature: GZ8MTXP02H4EBB.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctggagactctcctgtcgcccgcctcgtggactctaccttagtagctattggatggagcgtcgggtcccgccgagggtccgtaccggaagggggaacggggtcgttaggggaggttggggtcggacccaaaacgaaagtaaaaggggaagtagtagggaaagtacgaaagaaaacctacgttagtgtggacttcgtggtagggaacgggtccgtaatttacccgaaccctaatccgtaccgaagaacgaacccaaaccggaccaaaagtaacttcgagttagtactcgtagaaactaaagtacgaaactcgaccgtaggaacgaccggaccggaacggaccgtacggggtacccgtttaggttaaaccgttttaggtggttagggaagaaacgaacgtaaactagggttaaacggaaaaccggtaaaacggggtttcgaaaaccggggttaaaccgggggtagggggttttaacgagg

SEQ ID NO: 370075 - DNA, 684 bp, Homo sapiens
  misc_feature: GZ8MTXP02HSJDD.15.23.C01.1.454.CMB.2.raw
  modified_base (315)..(315): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggaggcctggtccgagggccggggggtcctgagctctcctgtcgccgtcctcgtggactctacctttagtagctagttggatgagcgtggggtccnccgaggcctccgaaggggaaggggctgggaggtggggtcgaccaaagaagtaaaaggaagagtaggaaagtacaagaaaactactaagtggtcgggtaacttcgtaggtacggaaacgggggtcccgtaaatttcccgaaacctaattcccaccgaaaggacgaaacccaaaaccggtacccaaaaggtaaactttccgaagttgttaaactcgtagaacctaaaatcggaaaactcggacctaggaacgacggcccggaaaggtccgaacccggggtcttaggttaactttacgtggtaggtagacggaacaacgtagtaacggaacgtaaacgggtacgaaacggttaacgggggtagggtttagag

SEQ ID NO: 370076 - DNA, 639 bp, Homo sapiens
  misc_feature: GZ8MTXP02JHK2Q.15.23.C01.1.454.CMB.2.raw
  modified_base (309)..(309): a, c, t, g, unknown or other
  modified_base (348)..(348): a, c, t, g, unknown or other
tcagtctacgtagccacgaccggtgctcgatttagtacacgtgattagggattgggggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggcccgggggggtccctggagactctcctgtgccgcctctggactcacctttagagctattggatgagctgggtccnccaggctccgaggggaaggggctggagtgggtggccaanaagtaaaggaagagtaggaagtcaagaaacatatgtgctctggtagacggggcattcaccatctacccagacgaacaacgaccaaagaattacagtagtatactagaccaaatcgaaacagaccctagaacgtacgacccggaaggaccgaaccgggtcccgtggttaactttaccggtaggttacggttaacggaaggaacgtaaccgaagttacggaaacccggtaaaacgggttaggtaaaacgggttaacccgggggttaaagggggtttacgaaagggtttcgggg

SEQ ID NO: 370077 - DNA, 624 bp, Homo sapiens
  misc_feature: GZ8MTXP02GT1BQ.15.23.C01.1.454.CMB.2.raw
  modified_base (307)..(307): a, c, t, g, unknown or other
  modified_base (346)..(346): a, c, t, g, unknown or other
  modified_base (363)..(363): a, c, t, g, unknown or other
  modified_base (373)..(373): a, c, t, g, unknown or other
  modified_base (483)..(483): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccgaggccggggggtccctgagactctcctgtcgccgcctctggactcacctttagtagctattggatgagctgggtccnccaggctccgaggggaagggctggagtgggtggccaaanagtaaaggagatggaancaagaaaacnctatgtggactcgtggtagaaggggcccagttcccaacctatccctaccaagaacgaaccgaaaccgaccaaaagaacttcagtcgtaatctagaccaaaagtcgaaacngcctagaacggacgacccgggaaggaaccgtacgggacccgttaggttaacttacgtgggttagagaacggaagaaccaaggtaagaaaccgaaacggggttagaaacggttaaaaccgggggagggggtttactaaaggg

SEQ ID NO: 370078 - DNA, 680 bp, Homo sapiens
  misc_feature: GZ8MTXP02G3X98.15.23.C01.1.454.CMB.2.raw
tcagtctacgtagccacgaccggtgctcgatttagtacacgtgattagggattgggaggtctcagagaggagccttagcccctggactccaaggcctttccacttggtgatcagcactgagcacagaggactcaccatggagttggggctgagctgggttttccttgttgcttattttagaaggtgtccagtgcgaggagcagctggtggagtcgtgggggagccgtggtccgagggccggggggtccctgagactctcctgtcgccgcctctggacctctacctttagagctattggatgagcgtcggtccgccgaggcctccgaaggggaacggggctagggaggtggggtacgacccaaagaagtaaaagggaaagagtagggaaagtcaaagaaaaccacgtaattggtagacttcgtacgggtaggaaacgggggtccctaactttcccgaaaccctacgtttacccgacccaaagggaacgaaaaccccgaaacccgacccgaaaaggttaaactttccgaaagttgttaaactcgtagaaactaaagtacggaaacacgacccgtaggaacgaccggacgaacggacgaccgggaccttagtacttacgtgtagagaggaactacagaacgaaacgaacggttagaaacggtaacgggtaggggttatacggg

SEQ ID NO: 370079 - DNA, 705 bp, Homo sapiens
  misc_feature: GZ8MTXP02G38UW.15.23.C01.1.454.CMB.2.raw
  modified_base (528)..(528): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctatttagagtgtccagtgcgaggagcagctggtggagtcgtgggggaggcctgggtccgagggcccgggggggtccctggagactctcctgtgccgcctctggactcacctttagtagctagttggatggagtcgtcggggtcccgccgagggtccctaccggagggggaaacgggggtcgtaggggtagggttggggtacgggacccaaacgaaagtaaaaggggaaggtagtaggggaaagtccaaaggaaaacctatagtggtaggtacctcgtaggtagaacgggggtcctattacccaaccattcccaccgaaggactaaccgaaaccgtaccaaagtactttccgaaggttntaaactcgaacgacaaaagtgaaacgacgaccgtaggaccgggacgaccgggttacggacccgtagggtaccgtttagttaaccgttgtacgggtacggtaagacgaacgtaccaaagtaaccggaaaaccggttagggtaaacggaacgggtaacgggggtttgggtaacgttagg

SEQ ID NO: 370080 - DNA, 600 bp, Homo sapiens
  misc_feature: GZ8MTXP02IT7K7.15.23.C01.1.454.CMB.2.raw
  modified_base (376)..(376): a, c, t, g, unknown or other
  modified_base (588)..(588): a, c, t, g, unknown or other
  modified_base (598)..(598): a, c, t, g, unknown or other
tcagtctacgtagccacgaccggtgctcgatttagtacacgtgattagggattgggaggtctcagagaggagccttagcccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctgagactctcctgtgccgcctctggactcacttagagctatggatgagctgggtccgccaggctccgaggggagggctggagtgggtgaccaacagtaaaggaagagtaggaagtcagaaacatatgnggactcgtgtagaacggggccattccaccgtatcctccaagacgaaccaaacggcccaaaaggtaacttacagttgtaattaccgttagactaaaatacggaaacacgacctaggaacgacggaccggaaggaaccgaacggggcccgttagttaacgttacgtgttaggagaggacgacagtaagaacgaacggtagaacgtaaaccgggngggggtttanag

SEQ ID NO: 370081 - DNA, 635 bp, Homo sapiens
  misc_feature: GZ8MTXP02HDUSP.15.23.C01.1.454.CMB.2.raw
  modified_base (271)..(271): a, c, t, g, unknown or other
  modified_base (620)..(620): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtggggggagcctgggtccaggccggggggtccctgagactctcctgtcgccgcctcnggactcacctttagtagctattggatgagctgggtccgccaggcctccgaggggaaggggctggggagtggggtggaccaaagaagtaaaaggaagagtacggaaagtcaagaaaacactagtggtgggaacttctgtaggaacgggggcctaattccgaaacccattccctaccaggaacaaaccgaaacgaccaaaagtaaatttccgaaagtgttaaatccgtagaacaaaagtcgaaaccaagccgtagaggacgccgaaggacgccggaccgttgtaattacctggtagcggaagtaagacaagtcggaaacaaaacggggttgaaaacggtaaacccgggggngggggtttacaaggg

SEQ ID NO: 370082 - DNA, 985 bp, Homo sapiens
  misc_feature: GZ8MTXP02GKQUA.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcgttgggttttccttgttgcttattttagaaggtgtccagtgcgaggagcagcgtggtggagtcggtgggggacggccgtgggtcccgacggggcccgggggggttccctggacgtaccttccgtcccgtggtcgcccgcctcgtcggacctcctaccgtttagtacgcttagttggattggacgtcgtcgggtccccgccgacgggcctacccggaagggggaacggggtcgtaggggaggttggggtacggacccaaaacggaaagtaaaaggggaaagagtaggggaaaacgtaccgaaaaggaaaacctagttaacgtagggtcgggtaaacctttcggttagggttaacggggaaaccgggggtcctaaacgtttcccaaacccgtattcccccgtaacccgaaaggggaaaccgtaaacccgaaaaccggtaaaccccgaaaaggttaaaaccgtttccaaaaggggtttcgtttaaactttcccgttaaaggaaaaccccttaaaaagtaccgggtaaaaaacccgcgggtacccccgttaaaggggaaaccgggtaaacccggggaacccccgggtaaaagggggtaacccccgaaaaccccggggggtttcccccggtttaaaaggggtttttaaaacccttttttaaaccggggtgggggttttaaacgggaaacgggggtaaacggtaaaacggaaccgttttaaaccggggtaaccggaaaaaaacccccgggggtttaaaacggggttaaacgggggtaaaaacccccggggtttaaaacggggggggtttaagggggggtttaactttaaacccgggggg

SEQ ID NO: 370083 - DNA, 606 bp, Homo sapiens
  misc_feature: GZ8MTXP02IU489.15.23.C01.1.454.CMB.2.raw
  modified_base (594)..(594): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccgggggggtccctgagactctcctgtcgccgcctctggactcacctttagtagctattggatgagcgtgggtcccgccaggcctccgaaggggaaggggctggggaggtggggtcggaccaaacgaagtaaaagggaagagtagggaaagtcaagaaaacactagtgtggactctggtagaaggggccgattccaaccatcctaccgaagacgacaaacgccaaagtactcagtgtaatctagaacaaatgaaacagcctaggagacggacccggaggaaccgacggccgttagtacttacgtggtagtaggagaacgacagtaaggaaacgtaacgggtcgaaaacgtaaccgggggnggggtttacagg

SEQ ID NO: 370084 - DNA, 627 bp, Homo sapiens
  misc_feature: GZ8MTXP02IXZAE.15.23.C01.1.454.CMB.2.raw
  modified_base (404)..(404): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggaggccgtggtccgagggcccggggggtccctggagactctcctgtcgcccgcctctggactcacctttagagctattgatgagcgtcgggtccgccaggctccgaggggaacggggctgggaggtggggtcggaccaaacgaagtaaaagggaagtacgtaggaagtacaagaaacactagtgnggactcgtagtaggaacggccgattcccaacgtatcctacagaacaaccaaacgccaaagtaacttcgagttagttactcgtagaactaaagtacggaaacacggaccctaggaaggacggccggaaggaccgacggtccgtagtatttacgtggtgtagagacgaacagtaacggaaacgaacgggtacgtaaacggtaaaccggggtggggtttacgtagg

SEQ ID NO: 370085 - DNA, 668 bp, Homo sapiens
  misc_feature: GZ8MTXP02I2ENZ.15.23.C01.1.454.CMB.2.raw
  modified_base (386)..(386): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtgccgcctctggactcacctttagagctattggatgagcgtgggtccgccaggctccgaggggaggggctggagtggggtgaccaaacgaagtaaaaggagagtagggaagtcgaagaaacacttaanggtggacttcgtggtaggaacggggtccgtattcccaaccgattcccgtacccaaggaacgaacccgtaaaaccgacccgtaaaagtaactttcgaagttgttaatcctaggaacctaaaatacggaaacacgccctaggaacgacggacccgagggaccgaaccggggtccgttagttacgttaaccgtgggttagaggaacggaacgaccgtaagtaacggaaaccgtaaacggggttaggaaacggttaaacccgggggtagggggtttacgtaagggg

SEQ ID NO: 370086 - DNA, 824 bp, Homo sapiens
  misc_feature: GZ8MTXP02FYJSL.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgcttattttagaaggtgtccagtgcgaggagcagctggtggaggtcgtgggggaggcctggtccgaggcccggggggtccctgagctctcctgtgccgcctctggactctacctttagagtctagttggatggagcgtgggtcccgccgaggcctaccggaggggaaggggcgtgggaggtgggtggacccaaacgtaaagtaaaagggaaagtagtaggggaaaacgtacgaaaaggaaaaccacgttaagtcgggttacggggtaaccttccgttaggggttacgggaaaaccgggggtcccccgtaaagttttcccaaacccgtaactttacccgtaacccgaaaggaaccgaaacccgaaaacccggtacccccgaaaaaggtaaacctttaccgaaagggtttagtttaaacgttcccgttaaggaacctaaaaagttacggaaaaaccgtacgtaccccgtagggaaacggacccgggaacccgggaaggggtaacccgaacccgggggttcccgttaaggtttaacgtttaccgtaggggttacggttacgggaaacggtaaagaacccgtaaggttaacggaaaaccgtaaaccgggggttacgtaaaacggggttaaaacccgggggtgggggtttaagttaacgggg

SEQ ID NO: 370087 - DNA, 665 bp, Homo sapiens
  misc_feature: GZ8MTXP02IB2GR.15.23.C01.1.454.CMB.2.raw
  modified_base (319)..(319): a, c, t, g, unknown or other
  modified_base (498)..(498): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctcctgtcgcccgcctcgtggacctctacctttagtagcttagttggatgagtcgtcggggtcccnccgaggcctaccggaagggggaacggggctaggggaggttcggggtacggacccaaacgaaagtaaaagggaagtagtaggaaagtccaaagaaacacgttaagtgtggaccttcgtggtaggaacggggcctattacccactatcctaccagacgacaacgaccaaagtactcgagtntatactagaactaaagtcgaaacgcgtcccagggaacgacgggaacccggaaggaccgaaccgggtccgttaagttacgtttacgtggtaggtaggaacgtagacaacgtaacggaaaccgtaacgggtaggaaacggttaacccgggggtaagggtttcgaacggg

SEQ ID NO: 370088 - DNA, 692 bp, Homo sapiens
  misc_feature: GZ8MTXP02G2KDA.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccgggggggtccctggagactctcctgtgcccgcctctggactcacctttagagctagttggatgagctgggtccgccaggcctccgaggggagggcgtgggaggtgggtgaccaacgaagtaaaggaagatagggaagtacaagaaacactagtggtcggacttcgtggtaggaacggggtccctaagtttcccaaccctattacccgtacccaaagggaacaaccgaaaccggtacccaaaaggtaactttcgaaggttattaacttccgttaagaacctaaaaagtcggaaaaccacggtacccctagggaacggaacggaccccggaagggaaacccgacgggggtcccgttaggttaacttacggttgttacggaggaacgaaggaccaaagtcggaaaacgtaaacgggggtgaaaacggtttaacccgggggagggggtttaactaagggg

SEQ ID NO: 370089 - DNA, 642 bp, Homo sapiens
  misc_feature: GZ8MTXP02ILMKX.15.23.C01.1.454.CMB.2.raw
  modified_base (457)..(457): a, c, t, g, unknown or other
  modified_base (594)..(594): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaggtgtccagtgcgaggagcagctgggtgggagtcgtgggggaggcctggtccgaggccggggggtcctgagactctcctgtcgccgcctctggactcacctttagtagctattggatgagcgtgggtccgccaggcctccgaaggggaacggggctgggaggtggggtcggacccaaacgaaagtaaaagggaaagagtaggggaaagtccaaaggaaaacctacttaagtgtggggtacctgtggtaggaaacgggggtccgaatttcccgaacctntccctaccaaggacgaacaaaccgccaaaagtacttcagttgtaattctagaactaaagtggaaacagtcccgtagaagacgacccggaggaaccacggggtcctaggttacttagtggttgacggagaacggtaanagtaacgaacgaacggtacggtaacggtaacgggtacggggtaggtag

SEQ ID NO: 370090 - DNA, 691 bp, Homo sapiens
  misc_feature: GZ8MTXP02FPTWT.15.23.C01.1.454.CMB.2.raw
  modified_base (305)..(305): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcgtgggggaggcctgggtccgagggcccggggggtccctgagactctcctgtcgccgcctctggactcacctttagagctattggatgagngtgggtcccgccgaggcctcccggaaggggaacggggcgtggggaggtcggggtcggacccgtaaagaaagtaaaagggaaagtagtagggaaagtcgaaagaaaaccacttagtggtcggacttcgtaggtaggaaacggggtccgtatttacccaaacccgtatacccgtaccgaagaacgaaccgaaaccgaccctaaaagtaacttcgaagtcgttaattccgtagaactaaaagtacgaaaacgacgtacccgtaggaacggacggacccggaaggggaacccacggggtaccgttacggttactttacgtggtagtaggaacggaagtactaagtaacgaacgaaacgggtagaacggtaaacggggtaggggttatagg

SEQ ID NO: 370091 - DNA, 600 bp, Homo sapiens
  misc_feature: GZ8MTXP02IPZ60.15.23.C01.1.454.CMB.2.raw
  modified_base (547)..(547): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccaggccggggggtcctgagctctcctgtcgccgcctctcggactcacctttagtagctatggatgagcgtggtcccgcaggctccgaggggaaggggcgtgggaggtggggtcggaccaaacgaagtaaaaggaagtagtaggaaagtacaaggaaaacactaagttgtgggtacttcgtggtagtaacgggggccgtattccgaccctataccctcaagacgaacaaacgcccaaagtaacttacgagtgtaatcctagactaaatgaaacagccgtaggagacgaccggaaggacgtcggccgttagtagtttacgnggttgagacgagacagtgaacgaaggtcgaagtacggggtagggttcgtaagg

SEQ ID NO: 370092 - DNA, 711 bp, Homo sapiens
  misc_feature: GZ8MTXP02GYR6G.15.23.C01.1.454.CMB.2.raw
  modified_base (561)..(561): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggaggccgtggtccgagggccggggggtcctgacgactctcctgtcgccgcctctggactctacctttagtagtctagttggatggacgtcgtcggggtccccgaccgacgggtcccgtaccggaagggggaacggggtcgtaggggtagggttcgggggtcggaacccaaaacgtaaaggtaaaagggaaaggtagtaggggaaagtacgaaacgaaaactacgttagtggtcggtactcgtaggtacggaacggggacccgtattacccgaccctattacccgacccgaaaggaccgaaacccgaaacccggaccctaaaaggttaactttacgaagtttnttacttcgtaagaacctaaaagtacgaaaccgacgacccgtaggaacggacgaccgggaaagccggaccggtcgttagttacttcgtgtaggtagagtacgactagaacgaacgtaaacggtcgaacggttaacggggtgggttatacgg

SEQ ID NO: 370093 - DNA, 665 bp, Homo sapiens
  misc_feature: GZ8MTXP02HI5C0.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctggagactctcctgtcgccgcctctggactcacctttagagctagttggatgagcgtcgggtcccgccgaggcctccgaggggaaggggctgggaggtggggtcggaccaaacgaaagtaaaaggaagagtaggaaagtacaaagaaaacacttatggtggacttcgtggtacggaacgggggcccgtaattccgaaccctagtccctaccgaaggaaacgaaccaaaccggacccaaaagtacttacgagttgttaatccttaagaacctaaaagtcgaaacgtacgaccgtaggaacggacggacccgggaaggaaccggaccgggtaccgttagttaacttcgtgggtggtagacgtagtaacgagtaacggaaacgtaacgggtagaacggtaacgggggaggggtttataggg

SEQ ID NO: 370094 - DNA, 646 bp, Homo sapiens
  misc_feature: GZ8MTXP02HHGRM.15.23.C01.1.454.CMB.2.raw
  modified_base (316)..(316): a, c, t, g, unknown or other
  modified_base (484)..(484): a, c, t, g, unknown or other
  modified_base (527)..(527): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggtgctgagcttgggttttccttgttgcttattttagaaggtgtccagtgcgaggagcagctggtggagtcgtgggggaggcctgggtccgagggccggggggtccctggagactctcctgtcgcccgctcgtggactctacctttagtagctattggatgagcgtgggtccnccgaggcctaccggaggggaaggggcgtgggaggtggggtcggaccaaacgaagtaaaaggaagacgtagggaagtacgaaagaaacacgtagtggtcggactcgtagtacgggacggaccgtacttcccgaaactctcccacggaagaaaccgaacgaaccccgtanaaaagttacttcgaagtttatacctacggtagaaacttaaaanaacgaacgacgacgacggacggacggacggacggacgaccggtacgtacgttacgttacgtgtacgtacgagaagagtaagacgaacgtaacggaacggtaacggtaacgggtaggtag

SEQ ID NO: 370095 - DNA, 623 bp, Homo sapiens
  misc_feature: GZ8MTXP02FOB9J.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagtagctattggatgagcgtgggtcccgccaggctccgaggggaaggggctggggaggtggggtggacccaaacgaagtaaaagggaaagagtagggaaagtaccaagaaaacactagtggtgggactcgtggtagaacggggccgtattcgaccatcctcccaagacgaaccaaccgaccaaagtaaattcagtagtattcagacaaagtagaaacagacccgtagaggacgacccggaaggacaccggggaccgttagtacgtttactggtgtaggaacgagacaagtcggaaacgtaagggtacgtaacggtaaaccggggtagggggtttagtaacgg

SEQ ID NO: 370096 - DNA, 685 bp, Homo sapiens
  misc_feature: GZ8MTXP02G3F38.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggaggccgtggtccgaggccggggggtcctgagactctcctgtcgccgcctctggactctacctttagtagctagttggatggagcgtcgggtcccgccgaggcctaccggaggggaaggggcgtgggaggtggggtcggaccaaacgaaagtaaaagggaaagtagtagggaaagtacaaagaaaaccacgttaagtggtcgggtaaccttcgtagggtaggaaacgggggtcccgtaatttcccgaaaccctattacccacccgaaggaaaccgaaacccgaaaaccggcccaaaagtaactttccgaaaggttcttaaactccgtaggaactaaaagtcgaaaccgtacgcctaggacgacgaccggagacccgcggtcccgttagtacttagtggttagagacgaacgacagtaacgaaacgtaacgggttagaacggtaaccgggggtaggggtttacaggg

SEQ ID NO: 370097 - DNA, 715 bp, Homo sapiens
  misc_feature: GZ8MTXP02I4CWY.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctcctgtgccgcctctggactcaccttagtagctattggatgagcgtgggtccgccaggcctccgaaggggaaggggctgggaggtggggtcggaccaaacgaagtaaaagggaaagataggggaaagtacaaaggaaaacacgtaagtggtcgggaacttcgtaggttaggaaacgggggtcccgtaatttacccgaaacccctattaccccgtaacccgaaagggaaacgaaacccgaaaacccggaccccgtaaaaaggtaaactttcccgaaaggtttaggttaaacttccgttaaggaacctaaaaagttcggaaaaccaggaccccgtagggaacgacggacccggaagggaacccgacgggcccgtttagtaacgtttactggtacgtaggagtaacggacaagtaacgaacgaaacgggtagaaacggtaaaccgggggtggggtttacgaagg

SEQ ID NO: 370098 - DNA, 643 bp, Homo sapiens
  misc_feature: GZ8MTXP02F0TEG.15.23.C01.1.454.CMB.2.raw
  modified_base (470)..(470): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccggggggggtccctgagactctcctgtcgccgcctctggactcacctttagagctattggatgagctgggtccgcaggctccgagggaaggggctgggagtgggtggccaaacagtaaaggaagatacggaaagtcaagaaaacactatggtggacctcgtgtagaaggggccgattcacatcctccaagacacaacgccaagaattcagtgtaaatctgacaaaagtgaaaacngaccctaggagaggaccccggaggaaaccgaacggggcccgttaggttaaaactttccggtaggttacggttaggaacggaacggaaccttaaagtaacggggaaaacccgtaaaagggggttacggtaaaacggttaaaaccccggggggtagggggtttaacggttaaggg

SEQ ID NO: 370099 - DNA, 608 bp, Homo sapiens
  misc_feature: GZ8MTXP02HN4V8.15.23.C01.1.454.CMB.2.raw
  modified_base (390)..(390): a, c, t, g, unknown or other
  modified_base (425)..(425): a, c, t, g, unknown or other
  modified_base (432)..(432): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtcctgagactctcctgtgccgcctctggactcacctttagagctattggatgagctgggtccgccaggctaccgaggggaaggggcgtggaggtggggtcggaccaaacgaataaaaggaagatagggaagtacaagaaaacagtangtggaactgtgtagaaggggccgattcacctatcncgaaganactaacgacaaagtaatcagtataatctagactaaaatgaaacagccctaggacgacggcccgaaaggccctaacgggcccggttattaaaccggtttataggtacgtagaacgaacgacgaagtaacgaaacggaaacggtacggtaaacggtaaccggggtagggtttagacgg

SEQ ID NO: 370100 - DNA, 598 bp, Homo sapiens
  misc_feature: GZ8MTXP02JN99H.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccgggggggtcctgagactctcctgtcgccgcctctggactcacctttagtagctattggatgagctgggtccgccaggctccgaggggaggggctgggagtggggtggaccaaacgaagtaaaaggaaagagtagggaaagtcaagaaaacactaagttggtggactcgtgtagaagggccgattccaccatcctacccaagacgaaccaacgaccaaagtaacttcaagtgtactctgaacaaatacgaaacagccgtagagacgaccggaggacgacgggcgtacgttacgttactggtgtagacgaggtacagtcgaacgtaacgggtacgaacggtaaccgggtagggggttgtaacgg

SEQ ID NO: 370101 - DNA, 577 bp, Homo sapiens
  misc_feature: GZ8MTXP02J2ZLN.15.23.C01.1.454.CMB.2.raw
  modified_base (386)..(386): a, c, t, g, unknown or other
  modified_base (471)..(471): a, c, t, g, unknown or other
  modified_base (478)..(478): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccgaggccgggggggtccctgagctctcctgtgccgcctctggactctacctttagtagctattggatgagcgtggtccgccaggctccgaggggaacggggctggggagtggggtcggaccaaacgagtaaaagggagagtcggaagtcaagaaaacnctagtggtggaccttgtggtagaagggggcccaattccaacctatccaccgagagaccacgaccaaagaattcgagtgtattcgngacaaanagacacgacgagagacgacgacgacgacgacgtacgtacgtagtcgtgtagagacgacgagtaacgacgacggtacggtacggtacggtacggtagtag

SEQ ID NO: 370102 - DNA, 670 bp, Homo sapiens
  misc_feature: GZ8MTXP02GAZC3.15.23.C01.1.454.CMB.2.raw
  modified_base (660)..(660): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggaggccgtgggtccgagggcccgggggggtccctggagactctcctgtcgcccgcctctggactctacctttagtagcttattggatgagcgtcgggtccgccaggcctaccggaaggggaacggggcgtggggaggtggggtcggaccaaacgaaagtaaaaggaaaggagtaagggaaacgtacgaaagaaaaacctactaagtggttcgggaacttcgtgggttagggaaacggggcccgtaatttacccgaacctactcctaccaaaggaacgaaaccaaaccgaccaaagtaaacttcgaagtcgttaatcctagaaactaaagtacgaaacgacgaccctaggaagacggaccggacggaacgaccggtacgtagttaacttagtcggtaggtgaacgtagactagaagaacgaggtacgacggttaacggggnggtttagagg

SEQ ID NO: 370103 - DNA, 684 bp, Homo sapiens
  misc_feature: GZ8MTXP02IWI9G.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggcccgggggggtccctggagacctcctcctgtcgccgtcctctggacctctacctttagtagcttagttggatgagctggtccgcaggctccgaggggaacggggctgggaggtggggtcggaccaaacgaagtaaaaggaacgatagggaacgtacgaacgaaaacctactagtggtggaaccttcgtaggtaggtaacgggggaccgtactttaccaacccgtacttcccgtacccgaagtacgaaacccaaacccgacccgaaaagtaacgtttaccaaagttcggttaaactccttaaggaacctaaaacgttacgaaaacacgtccctaggaggacggaccggacggtacgaccggtacgttacgttattacgtggttgacggagaacgactaagaacgaaccgtaaggggtacgaaacggtaaccggggtagggttacggtagg

SEQ ID NO: 370104 - DNA, 678 bp, Homo sapiens
  misc_feature: GZ8MTXP02FZ525.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctgagactctcctgtcgccgcctctggctcacctttagagctagtggatgagcgtgggtcccgcaggctccgaggggagggctgggagtgggcgaccaaacaagtaaaaggaagagtaggaaagtcaaagaaaactactaagtgtcggactcggtaggtacggaacggggccctaagttcccaaacccgtattcccgtacccgaaaggacgaaacccgaaaccgacccaaaagtaactttacaagttgttaaactcgtacggaacaaaagttacggaaaaccaggaccctaggaaacggacggacccggaagggaaccgaccggggtccttaggttaacgtttaccgtgggttagtacggaagaacgacaagttaacggaaacgtaaacggggtagaaaccgggttaaaaccgggggtggggtttacgaagg

SEQ ID NO: 370105 - DNA, 704 bp, Homo sapiens
  misc_feature: GZ8MTXP02GM1SG.15.23.C01.1.454.CMB.2.raw
  modified_base (372)..(372): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccgaggccggggggtccctgagctctcctgtcgccgcctcgtggactcctacctttagtagctagttggatgagcgtgggtcccgccaggcctaccggaggggaggggctgggaggtggggtggaccaaacgaaagtaaaagganagtagggaaagtcaagaaactactagtggtcgacttcgtaggtagaaacggggcctacttacccaacctatccctacccgaaagacgaaaccgaaaccgtacccaaaaggtaactttaccgaggttagttaactctacggaactaaaagtcgaaaaccgtacgacccgaggaacggacggaccccggaaagggtacccgaaccggggtcccgtttaaggttaaactttaaccgtgggttaggtacggaaaacgtacgacgtaagtaacggaaaaccggtaaacgggttaggaaaaccggtttaaaaccgggggaggggtttaagaaccgggg

SEQ ID NO: 370106 - DNA, 686 bp, Homo sapiens
  misc_feature: GZ8MTXP02G4TH3.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagttggtggagtcgtgggggagcctggtccaggccgggggtcctgagactctcctgtcgccgcctcgtggactcacctttagagctatggatgagcgtgggtcccgccgaggcctaccggaggggaacggggctggggaggtggggtcggacccaaagagtaaaagggagaagtaggaaacgtaccaaagaaaaccacgttaagtggtagggaccttcgtaggtaggaaacggggccctaagttcccaaccgtatcccgtacccgaagaacgaaccgtaaaccgacctaaaagaactttcgaagttcgtactaccgtagaactaaaagttcgaaaccacgggtaccctaagggaacggaaccggtaccggaacggacccgtaacggggtccgttaagttaacgttacggtggtacgtaggaagacgaactagacggaaccgtaagggtagaaacggttaaccggggaggggtttacagtttcgggg

SEQ ID NO: 370107 - DNA, 560 bp, Homo sapiens
  misc_feature: GZ8MTXP02FVV9C.15.23.C01.1.454.CMB.2.raw
  modified_base (420)..(420): a, c, t, g, unknown or other
  modified_base (450)..(450): a, c, t, g, unknown or other
  modified_base (469)..(469): a, c, t, g, unknown or other
  modified_base (502)..(502): a, c, t, g, unknown or other
tcagtctacgtagccacgaccggtgctcgatttagtacacgtgattagggattgggaggtctcagagaggagccttagccctggactccaaggcctttccacttggtgatcagcactgagcgacagagactcaccatggagtgggctgagctgggttttccttgttgctattttagaaggtgtccagtgcgaggagcagctggtggagtcgtgggggaggcctggtccaggccggggggtccctgagactctcctgtcgccgctctggactcacctttagagctagtggatgagctgggtccgccaggctccgaggggagggctggagtgggtggacccaaagaagtaaaaggaaagagtaggaaacgtcaagaaaacactaagtgtggactcgtagtaggaacggggcctaattcaccntccacgagagacaacgcaaagtaatcagtntagctagacaaatgaaacngactgagcgacgaggacgcggcttagtattagngtgagagacgacagtaacgaacgtaacgggtcgtaacggtaacggggtagggttagag

SEQ ID NO: 370108 - DNA, 663 bp, Homo sapiens
  misc_feature: GZ8MTXP02FMGQV.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgccgcctctggactcacctttagagctattggatgagctgggtccgccaggctccgaggggaaggggctgggaggtggggtggccaaacaagtaaaagggaagagtagggaaagtcaagaaaacactatggtggactcgtggtaggaaagggggcccgtaattccaacccattccctacccgaaggaacggaaaccaaaccggacccaaaaggtaaactttcgaaaggttgttaaatcctaggaacctaaaagtcggaaaacacgcccgttaggacgacggcccggaagggaccgaacggggcccgttaggttaactttaacgtggtaggttacgaacgaagaacagtaacgaaacgtaaacggggtagaacggttaaaaccgggggagggggtttgtaacgg

SEQ ID NO: 370109 - DNA, 751 bp, Homo sapiens
  misc_feature: GZ8MTXP02HB3Z1.15.23.C01.1.454.CMB.2.raw
  modified_base (328)..(328): a, c, t, g, unknown or other
  modified_base (739)..(739): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcgtgggggaggccgtggtccgacggccggggggtccctggagactctccgtgtcgcccgcctcgtggacctcctacctttagtagcttagttggatcggagtcgtcggggtcccnccgagggccgtacccggaagggggaaggggtcgtaggggaggttggggtcggaacccaaacgaaagtaaaaaggggaagtaagtaggggaaagtaccgaaagaaaacctacgttaagttggtacgggtaaccttcggtagggtaggaaccggggtacccggtaaactttcccgaaaccctactttcccgaacccgaaagggaaaccgaaacccgtaaaacccggaccccgtaaaaagtaaacgtttccgaaaggttcgttaaacttccgaaggaaacctaaaagtccgaaaaacacgtacccgtaaggacgggaacgccgggaaaggtacccggacgggtccttacggtattacgtggttagagaggactaacgagtaacgaacggtaacgtacggtaacggtaacggggnggggtttacagg

SEQ ID NO: 370110 - DNA, 571 bp, Homo sapiens
  misc_feature: GZ8MTXP02IU268.15.23.C01.1.454.CMB.2.raw
  modified_base (303)..(303): a, c, t, g, unknown or other
  modified_base (344)..(344): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtcctgagactctcctgtgccgcctctggactcacctttagagctatggatgagctgggtccnccaggcctcgaggggaggggctgggagtgggtggaccaaanagtaaaaggaagagtaggaaagtcaagaaaacactattgtggactcgtgtagaaggggccctaattccaccatcctccaagagaaccaaacgaccaaagtaacttcagtgtatctagacaaaatcgaaacagcctagagacgaccgaggacacggcctgtattacgtgtgtagagacgacataacgaacgaaacggtagaacgttaaaccggggagggttacgtaag

SEQ ID NO: 370111 - DNA, 652 bp, Homo sapiens
  misc_feature: GZ8MTXP02FRO9D.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtcgccgcctcgtggactcctactttagagctatggatgagcgtggtcccgccgaggcctaccggaggggaacggggcgtgggagggttggggtcggacccgaaacgaaagtaaaagggaaagtagtaggggaaagtaccgaaaggaaaacctacttaagtgggtacggacttcgtagggttagggaacggggaccgtattccaaaccctatccctaccaaggaaacgaaccaaacccgaccctaaaagtaactttacaaggttagtaacttctacgtaaacaaaatacggaaaaccagacctaggaacgacgaccggaaggacgtacggccgtagtattacgtgagtagacgaagacagtgaacgtacggtagaacgtaacgggagggtagtag

SEQ ID NO: 370112 - DNA, 696 bp, Homo sapiens
  misc_feature: GZ8MTXP02FFGIU.15.23.C01.1.454.CMB.2.raw
  modified_base (571)..(571): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgctattttagaaggtgtccagtgcgaggagcagctggtggagtcgtgggggaggcctggtccgaggcccgggggggtccctgagactctcctgtgcccgcctctggactcacctttagagctattggatgagcgtgggtcccgccaggcctccgaggggaaggggcgtgggaggtggggtcggacccaaaacgaagtaaaaggggaaagtaagtagggaaacgtaccgaaaggaaaacctacgtaagtgggttcggaaccttcgttagggttacgggaaacgggggtcccgtaaatttcccaaaccctaattcccctacccgaaaggaacgaaacccaaacccggacccaaaagtaaactttccgaaggttcgtaaactccgtagaaccaaaagtcgaaaaccnggccccgtagaacggacgcccggaagggacgaccgggccgttagtaactttacgtggtggtacgaacgaagaccaagtcgaaacgtaacgggtagaacggttaaaccgggggaggggttactagg

SEQ ID NO: 370113 - DNA, 672 bp, Homo sapiens
  misc_feature: GZ8MTXP02IDGKX.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggagccgtggtccgaggccgggggtcctgagactctcctgtcgccgcctcgtggactctaccttagtagctattggatgagcgtcgggtcccgccgaggcctaccggaaggggaacggggtcgtggggaggttggggtacggacccaaaacgtaaagtaaaaagggaaagtagtaggggaaagtaccgaagaaaactacttagttggtcgggacttcgtagggttaggacggggtccgtattcccaacctagtccctaccgaagaacgaaccgtaaaccgacccaaaagtacttacgagttacgtattcgtagaaactaaagtacgaaacacgaccgtagacgacggaccgggaaggaccgaccgggtccgttagttacgtttgtacggttggtacgagacgttacagtaacgaacgaacgggtacgaacggtaacggggtagggttagtaagg

SEQ ID NO: 370114 - DNA, 737 bp, Homo sapiens
  misc_feature: GZ8MTXP02F77I5.15.23.C01.1.454.CMB.2.raw
  modified_base (607)..(607): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcgttgggttttccttgttgcttattttagaaggtgtccagtgcgaggagcagcgtggtggagtcggtgggggacggccgtgggtccgacgggcccggggggtccctggacgctcctcctgtcgcccgcctcgtggacctctacctttagacgcttagttggatgagtcgtgggtcccgccgagggcctccggaaggggaacggggctggggacggtggggtcggacccaaaacgaagtaaaagggaagtagttagggaaacgtacgaaagaaaacctacgttaagtagggtacgggtaccttcggttagggtaacggggaacggggtacccgtaactttcccgaaccctagttaccctacccgaaggaaacgaacccaaaacccggacccgaaaagttaactttaccgaaggttacgtaaacttccgtaggaaacctaaaaagttacgaaaaccgngtacccgtaagggaaggaccggaacccggaggaaccgtaccgggtaccgttagttaagttacgtggtaggtagaagtacgctaaagtcgaaacgtaacggtagtaacggtaacggggtagggtacgtagg

SEQ ID NO: 370115 - DNA, 654 bp, Homo sapiens
  misc_feature: GZ8MTXP02HGN7R.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtggagtcgtgggggaggcctggtccgaggcccggggggtccctggagactctcctgtcgccgcctcgtggactcacctttagtagctattggatgagcgtggtccgccaggcctccgaggggaaggggctgggaggtggggtcggaccaaacgaaagtaaaagggaaagagtacgggaaagtcgaaagaaaacactaagtggtgggtaccttctggtagaaacggggcccgtatttacccgaccatccgtccaacggagaaccgaaacgacccaaaagaactttaccgaagttacggttaaacttccgtagaacctaaaagtacggaaacaacgcccgtaggaacggacgacccgggaggaacgaccggccgttacggtatttacgtgtagttacgacgagacgtataagaccgtaacggtagaacgtaaccgggtaggggttatagg

SEQ ID NO: 370116 - DNA, 579 bp, Homo sapiens
  misc_feature: GZ8MTXP02FPCED.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggccgggggggtccctggagactctcctgtgcccgcctctggactcacctttagtagctattggatgagctgggtcccgccaggctccgaggggaaggggctgggaggtggggtggaccaaacagtaaaaggaagatgggaaagtcaagaaacactatggtggactctgtgaaggggccattccaccatcctccagagacaacgaccaaagtaacttcagtgtaatcagtacaaaactagaaactacgcctagagacgaccggaggaccgacggccgtagtattactggtgtgaggagacagtaagaacgtaacgggtagaacgtaaccggggaggggttgtaagg

SEQ ID NO: 370117 - DNA, 663 bp, Homo sapiens
  misc_feature: GZ8MTXP02HAW7O.15.23.C01.1.454.CMB.2.raw
  modified_base (581)..(581): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctcctgtcgccgcctctggactctacctttagtagctattggatgagcgtgggtccgccaggctccgaggggaaggggctgggaggtggggtcggaccaaacaagtaaaagggaagagtagggaaacgtcaaaggaaaaccacgtaagtggtacggggacttcgtggtaggaaacggggccgtaatttcccaaccctatccctacccaaggaacgaaccgaaacgcccaaaagtaactttcgaagttgtaatcctagacaaaagtcgaaactagcctaggacgacggacccggtaagggaccacgggcccgttaggttaactttacgnggttaggaggagacgtactaagtaacggaaacgtaaacggggttagaaacggttaaaccgggggtagggggtttacgtaagg

SEQ ID NO: 370118 - DNA, 642 bp, Homo sapiens
  misc_feature: GZ8MTXP02GQUUL.15.23.C01.1.454.CMB.2.raw
  modified_base (616)..(616): a, c, t, g, unknown or other
tcagtctacgtagccacgaccggtgctcgatttagtacacgtgattagggattgggggtctcagagaggagccttagccctggactccaaggcctttccacttggtgatcagcactgagcacagaggactcaccatggagttgggctgagcttgggttttccttgttgcttattttagaaggtgtccagtgcgaggagcagctggtggagtcgtgggggaggccgtggtccgacgggcccggggggtccctggacgactctcctgtcgcccgcctcgtggacctctaccctttagagctattggatgagcgtgggtcccgccaggcctccgaggggaaggggcgtgggaggtggggtcgaccaaacaagtaaaagggaagagtaggaactacaaagaaacactagtgtaggctcgtggtaggaacgggcccgaagtttccaaaccgtattccctacccgaaggaaacgacccaaaaccggacccaaagtaaactttcgaagttagtactccgtagaaactaaaagtgaaaaccagcccaaggacgaacgtcccggaaaggaccaaccgggtcgtattacttacgtgtgtagaactagactgtagaacgaaacggtnaacgttaacggggaggttgaagttgg

SEQ ID NO: 370119 - DNA, 689 bp, Homo sapiens
  misc_feature: GZ8MTXP02J0F3R.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtgggagtcgtgggggaggccgtgggtccgaggccgggggggtccctgagactctcctgtgccgcctcgtggactctacctttagtagctattggatggagcgtgggtccgcaggctccgaggggaggggctggaggtgggtcggaccaaagaagtaaaaggagagtaggaaagtcgaagaaaactactaagtggtgggaccttcgtaggtagggaaacgggggtcccgtatttacccgaaccctaacgttccctacccgaaacggaacgaaacccgaaaccgaacccgaaaaggtaaactttacgaacgttagttaactccgttaggaacaaaagtacggaaaaccacggtacccgtaggaacggacggaccggaagggtaccgaaccggggccgttagtacttacgtggtagtagaacgagaacgagtaacgaaacgtaacgggtacggtaaaacggtaaccgggggtagggggtttactagg

SEQ ID NO: 370120 - DNA, 715 bp, Homo sapiens
  misc_feature: GZ8MTXP02HFHPL.15.23.C01.1.454.CMB.2.raw
  modified_base (329)..(329): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggaggtcgtgggggaggccgtggtccgagggcccggggggtccctgagactctcctgtcgcccgccctcgtggacctcctacctttagtacgcttagttggatggagcgtcggggtcccncccgagggtcctacccgaagggggaaggggctaggggaggtggggtacggaccaaacgaaagtaaaagggaaaggtagtacggggaaagtacgaaaggaaaacctactaagttacggtacggggtaccttcggttaggtacgggaaacgggggccctatttacccgaacctagttcccaccgaagacgaacccgaacgaccaaagtatacagtacttatacgttgaactaaatacgaacgacgccgtaggacgaccggaccggaaggaccgacggggtaccctagttaacttacggttggtacgtagaaaggacgaactaacgtaaggaaaaccggtaaacgggtggtaaaacggtaaaccgggggtaggggtttacgtaacgggg

SEQ ID NO: 370121 - DNA, 666 bp, Homo sapiens
  misc_feature: GZ8MTXP02INR0W.15.23.C01.1.454.CMB.2.raw
  modified_base (530)..(530): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccgggggggtccctggagactctctgtcgcccgcctctcggactcctacctttagtagctattggatgagtcgtcgggtccgccgaggcctaccgaaggggaacggggcgtgggaggtggggtggacccaaacgaaagtaaaagggaagaagtaggaagtcaaagaaaacacgtaagttgtcggacttcgtaggtaggaaacggggccgtaattcccaaccgtatccctaccgaagacgaaaccctaacgacctaaagtaacttcaagttgtatcctagactaaaagtcgaaacncgccgtagaacggaacgccgggaaacggtacgaccgggaccgttagtaactttacggtgtaggtagaacgaagactagtaacggaacgtaaacggggttacgaaacggtttaaaccgggggaggggtttacaaggg

SEQ ID NO: 370122 - DNA, 630 bp, Homo sapiens
  misc_feature: GZ8MTXP02F8C0H.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttccttgttgctattttagaaggtgtccagtgcgaggagcagctggtggagtcgtgggggaggcctggtccgaggccggggggtccctgagactctcctgtcgccgcctctcggactcacctttagtagctagttggatggagcgtgggtccccgccagggcctccggaaggggaacggggctgggaggttggggtcggacccaaaagaagtaaaagggaagagtaggggaaagtacgaaagaaaaccactagtggtggactcgtggtaggaacggggccgtattccaaccctatccctacccaagaacgaacaaaccgacccaaagaaacttcgagttgtaactctagaccaaagtcgaaactagacccgtaggacgacggaccggaggaaccgtacggccgtagtacttacgtggtagtagagagacagtaagaaccgaaggtagacgtaacggggtagggttgtagg

SEQ ID NO: 370123 - DNA, 823 bp, Homo sapiens
  misc_feature: GZ8MTXP02GOEK5.15.23.C01.1.454.CMB.2.raw
tcagtctacgtagccacgaccggtgctcgatttagtacacgtgattagggattgggggtctcagagaggagccttagccctggactccaaggcctttccacttggtgatcagcactgagcacagaggactcaccatggagttgggctgagctgggttttccttgttgctattttagaaggtgtccagtgcgaggagcagctggtggagtcgtgggggagcctggtccgaggccggggggtcctgagactctcctgtcgccgtcctcgtggacctctaccgtttagtagctagttggatgacgtcgtcgggtcccgccgaggccgtaccgaaggggaacggggtctaggggagttggggtacggacccaaagaagtaaaaggagagtacggaagtcaagaaaacacgttagtaggtacggtacttcgtaggttacgggaaacggggtcccgtaatttcccaaccctaattcccaacccgaaggaaaccggtaaacccaaaacccggtaccccaaaaggtaaacttttaccgaagggtttagtaacttacccgttaggaaacctaaaaagtttcgggaaaaaaccccgtacgggtacccgtaaagggaaccgggaaccgggaccccgggaaaacgggttaaccccggtacccggggttaccggtttaagtttaaccgtttaacccgggttagggttaacgggtaaaggaaaacggtaacgtaaaaccgtaaggttaaaccgggaaaacccggtaaaacgggggttaacggtaaaaacccgggggttaaaccgggggttaaggggtttacgtaaaggttttaacgg

SEQ ID NO: 370124 - DNA, 594 bp, Homo sapiens
  misc_feature: GZ8MTXP02GBJWR.15.23.C01.1.454.CMB.2.raw
  modified_base (310)..(310): a, c, t, g, unknown or other
  modified_base (389)..(389): a, c, t, g, unknown or other
  modified_base (398)..(398): a, c, t, g, unknown or other
  modified_base (478)..(478): a, c, t, g, unknown or other
  modified_base (492)..(492): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttccttgttgctattttagaaggtgtccagtgcgaggagcagctggtggagtcgtgggggaggccgtggtccaggccgggggggtccctgagactctcctgtcgcccgcctctggactcacctttagtagctattggatgagctggtccnccaggctccgaggggaggggctggaggtgggtgaccaaacataaaggaagagtaggaaagtcaagaaaaccataatggnggacttcgnggtagaaggggcccaattccaaccatcctccagacgacaaacgccaaagaacttcagtgtaatctagacaaatcgaaacncgaccctagggaanacggacccgagggactacgggccggtattacgttacgtgtgtagacgaagacaatggaacgaaacggtgaaaccggtaaccgggtaagggggtttactaagg

SEQ ID NO: 370125 - DNA, 638 bp, Homo sapiens
  misc_feature: GZ8MTXP02JN5RD.15.23.C01.1.454.CMB.2.raw
  modified_base (504)..(504): a, c, t, g, unknown or other
  modified_base (566)..(566): a, c, t, g, unknown or other
tcagtctacgtagccacgaccggtgctcgatttagtacacgtgattagggattgggggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgagggcccggggggtccctggagactctcctgtgcccgcctctggactcacctttagtagcttattggatgagtcgtgggtcccgccgaggcctccgaggggaacggggctggggagtggggtcggaccaaagagtaaaaggagagtggaaacgtcaaagaaacacgtatggaggactcgtggtaggaaacggggccgtagttccaccctatcccgtaacccgagaacgaacctaaacccggaccaaagtaacttcgaagtgtaactcgtaganaaaagtcgaactacggacctgaacgaggcccgaaggaccaccgggtcgtagttaactttagnggtcggtaggaagtaccgaactagacgaaacgtacggttagaaaccggtacggggtagggttacagttacgg

SEQ ID NO: 370126 - DNA, 792 bp, Homo sapiens
  misc_feature: GZ8MTXP02JX84O.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgttgggttttccttgttgcttattttagaaggtgtccagtgcgaggagcagcgtggtggagtcgtgggggaggccgtggtccgagggcccggggggtccctggagactctcctgtcgccgcctcgtggactctacctttagtagctagttggatgacgcgtcgggtcccgccgaggcctaccggaggggaacggggcgtaggggaggtggggtcggaccaaacgaagtaaaagggaagtagtagggaagtacaagaaactactagtggtcggtactcgttaggtaggaacggggtccctaattacccaaccctattacccgtacccgaaaggaacgtaaacccgaaacccggtacccaaaagtaaacgtttccgaaggtttgttaaacttccgtaaggaaaccaaaagttacggaaaaccgtacggaccccgtaagggaaacgggaccggacccgggtaaacggggaacccgacccgggggtaccgttttaacgttaaccggttttaacgtcggggtttaggaacgggaaaacggaacgaaaccgttaaggttaacggaaaaccccgggttaaaacgggggttacgggtaaaaaccggggtttaaaacccggggggttagggggtttacgttaaagggg

SEQ ID NO: 370127 - DNA, 623 bp, Homo sapiens
  misc_feature: GZ8MTXP02JN9PK.15.23.C01.1.454.CMB.2.raw
  modified_base (393)..(393): a, c, t, g, unknown or other
  modified_base (471)..(471): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagacctctccctgtcgccgcctctggactcacctttagtagctattggatgagcgtgggtccgtcaggcctccgaggggaaggggctgggaggtggggtcggaccaaacgaaagtaaaaggaaaggtatagggaatacagaaaacnctatggtggactcgtggtagaaggggccagttccacccattccgccaagacgacaaacgccaaaagacttcaaggttntatctagaactaaagtacaacagccgtaggaacgtacggccggaaggaccgaccggttacgttacgttacttagtggtaggtacgaacgacgtaacgagtaacggaaacgtaacggggacgtaaacggttaacgggggtagggtttagacgg

SEQ ID NO: 370128 - DNA, 600 bp, Homo sapiens
  misc_feature: GZ8MTXP02IWXRF.15.23.C01.1.454.CMB.2.raw
  modified_base (587)..(587): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctcctgtgccgcctctggactcaccttagtagctattggatgagcgtcgggtccgccaggcctccgaggggaacggggctgggaggtggggtcggaccaaacgaagtaaaagggaaagagtagggaaagtcaagaaaacactagtgtggactcgtgtagaacgggcctattccaacctatcctaccgaagacgaacaaacgccaaagtaactcgagtgtatctagactaaatcgaacagcctagagacgaccgaggaccacggcgttagtacttacgtggtagtagagtaacgactagtaacgaacgtaacgggttagaacggttaaacggggnggggtttactagg

SEQ ID NO: 370129 - DNA, 668 bp, Homo sapiens
  misc_feature: GZ8MTXP02JKDJZ.15.23.C01.1.454.CMB.2.raw
  modified_base (405)..(405): a, c, t, g, unknown or other
  modified_base (603)..(603): a, c, t, g, unknown or other
  modified_base (657)..(657): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgagggccggggggtccctgagactctcctgtcgccgcctcgtggactctacctttagtagcttattggatgagctcggggtccgccaggcctaccggaggggaaggggctaggggacggtggggtcggacccaaacaagtaaaaggaagaagtcgggaaagtacaaagaaaacnctaagtggtgggaaccttcgtaggtaggaaacggggccgtaacttccaaacctacttcccacccgaaggaacgaaacccgaaaaccgacccaaaagtaaacgtttccaaaggtttgttaaactcctaaggaacctaaaagtcggaaacctaggccctaggaagaccgacggacggaccgtacggcgttagtattacgngtagtagagaacgactagaacgaaacgaacggtacgtaacgtaaaaccgggggnggtttacgagg

SEQ ID NO: 370130 - DNA, 821 bp, Homo sapiens
  misc_feature: GZ8MTXP02GBV84.15.23.C01.1.454.CMB.2.raw
  modified_base (616)..(616): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttccttgttgcttattttagaaggtgtccagtgcgaggagcagcgtggtggaggtcgtgggggaggccgtggtccgacgggcccggggggtccctggacgtactctcctgtcgcccgctcgtggacctctaccttagcgtctagtggatgacgtcgttcgggcccgacgacggtcccgtaccgggaaggggaacggggtcgtaggggtagggtttcggggaccggaaccccgaaaagtaaaaggtaaaaaggggaaagtaaggtaagggtaaaacgtacgaaaacgtaaaacctagttaagttcgggtacggtaccttggttaggtaacggggaacccgggggtacctttaacgttacccgaaacctacttaaccccgtaccgaaaaggtaaaccgaaaacccgaaaccgaaccccgtaaaaaggttaaccctttacggaaagttacgtttaaccncgttaaaggaaccttaaaagtacgtaaaaccgaccgtaccgttaaggaaccggaccgggaaaccggaaggtaacccggacggttaccgttaacgttaaaccgtttgggttacggtagggtacgaaaggtaaccgacgttaagaacggaaaacggtaacgggtaaggtaaaacccgggtaacgggggtagggtagtttaaccgggg

SEQ ID NO: 370131 - DNA, 620 bp, Homo sapiens
  misc_feature: GZ8MTXP02HVS9J.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgcccgcctctggactcacctttagtagctattggatgagctgggtccgccaggctccgaggggaaggggctgggaggtggggtggccaacaagtaaaaggaagagtaggaaagtcaagaaaacactatgtggactctgtgaaggggccattcaccatctccagacgaacaacgccaaagtaattcagtgtaatcgtagactaaaatgaaacacggaccaggaacgacggaccggagggaaccgaacggggcccgttacgttaacgtttacgtaggttggttagaccgaacggttaaacgaagtaacggaaacgtaaacgggtacggaaacggttaaccgggggtaggggtttacggaagg

SEQ ID NO: 370132 - DNA, 696 bp, Homo sapiens
  misc_feature: GZ8MTXP02FQPTA.15.23.C01.1.454.CMB.2.raw
  modified_base (664)..(664): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccaggccggggggtccctgagactctcctgtcgccgcctctggactcacctttagagctatggatgagcgtgggtccgccaggcctccgaggggaacggggcgtgggaggtggggtgacccaaacgaagtaaaaggaagagtagggaaagtacaaagaaaaccacttaagtggtcgggacctcgttggtacggaacgggggtaccgtactttacccgaaccctattacccgtacccgaaagggaacgaaacccaaacccggaccctaaaaaggtaaacttttccgaaaggttgttaaacttccgtagaacctaaaagttcgaaaaccgagtacccgtaggaacggacggacccggaagggtaaccgacggggtcccgttagttaacgttacgttggtagtaggaacgaacgactaagaaggaaccgaaacggggtanaacgggtaaaaccggggtgggggttataaggg

SEQ ID NO: 370133 - DNA, 646 bp, Homo sapiens
  misc_feature: GZ8MTXP02HKYTN.15.23.C01.1.454.CMB.2.raw
  modified_base (417)..(417): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcggtgggggaggccgtggtccgacgggcccggggggtccctggacgactctccgtgtcgccgcctcgtggacctcctaccctttagtagcttagttggatggagcgtgggtcccgccgaggcctccggaggggaagggcgtgggaggtggggtcggacccaaagaagtaaaaggaagtagtaggaaagtcaagaaaactactanggtgacttcgtagtaggaaacgggccattcccaactatccgaccagacgaaccaaccgcctaaaagtactcgagtgtatctagactaaaatcgaaacagccctaggacgacggaccggtaaggacccgtacgggcccgtttagtaacgtttacctggttgagtaagacgaactaggtaacgaaacgtaaacgggtgaaacgggttaaaccggggtaggggtttacaagg

SEQ ID NO: 370134 - DNA, 687 bp, Homo sapiens
  misc_feature: GZ8MTXP02GR1MS.15.23.C01.1.454.CMB.2.raw
  modified_base (631)..(631): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgttgggttttccttgttgcttattttagaaggtgtccagtgcgaggagcagcgtggtggagtcgtgggggaggccgtggtccgacgggcccggggggtccctgacgacctctcctgtcgcccgcctctcggaccttcacctttagtagcttagttggatgacgtcgtcggggtccccgccgagggcctaccggaagggggaacggggcgtggggaggttggggtacggaccaaacgaaagtaaaaggaaagtagtaggaacgtacaaagaaaaccacgttaagtggtacgggtacttacgtgggtaacggaaccggggtaccgtaacgttacccaaccctagttcccacgaaaggaaaccgaaacccgaaaccgacctaaaagttaccttacgagttagtaactcgtaagaacctaaaagtcgaaacacgtcccgagagaccggaccgaaggtaccgacgggtcttagtacgtttagnggttagagacgacgacagtaacgacgtaacggtacgaacggtacgggtggtatagg

SEQ ID NO: 370135 - DNA, 721 bp, Homo sapiens
  misc_feature: GZ8MTXP02HCVVG.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctgagactctcctgtcgccgcctcgtggactcacctttagagctattgatgagctgggtccgccaggcctccgaaggggaaggggctgggagtggggtcgaccaaacaagtaaaaggagagtaggaaacgtcaagaaacacgtagtggtggactctaggtagaacggggcctaattccaaccctattcccacccaaggaacgaacccgtaaaccgaccctaaaaggtaaactttccgaagtttagtaaacttccaggaaactaaaaagtcgaaaaccgacgtccgtaaggaaccggaagaccccgggaaaggttaacccgaccggggtacccgtttaaggttaaaaccttttacgtcggtagggttaaacggaaacggtaacggaaactaaaggttaaccggaaaaccggttaaaaccggggttacggaaaacccggggtttaaaaccgggggaggggggtttttaacgaacggg

SEQ ID NO: 370136 - DNA, 574 bp, Homo sapiens
  misc_feature: GZ8MTXP02F4XSY.15.23.C01.1.454.CMB.2.raw
  modified_base (343)..(343): a, c, t, g, unknown or other
  modified_base (373)..(373): a, c, t, g, unknown or other
  modified_base (381)..(381): a, c, t, g, unknown or other
  modified_base (399)..(399): a, c, t, g, unknown or other
  modified_base (402)..(402): a, c, t, g, unknown or other
  modified_base (409)..(409): a, c, t, g, unknown or other
  modified_base (513)..(513): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctgagactctcctgtgccgcctctggactcaccttagtagctattggatgagctggtccgccaggctccgagggaggggctggagtgggtgccaaanataaaggaagatggaatcaagaaacactangtggactntgtagagggcgattcacntcncagaganaacgccaaagattcagttgtactcgtgactaaaagtcgaaacacggccctagggaacgacggcccggaaaggtaccgaacgggggtcccttaggtaatttacgnggttagaggacgaagacaagtggaaccaaacggtgaaacgtaacgggtaggggtagtaagg

SEQ ID NO: 370137 - DNA, 705 bp, Homo sapiens
  misc_feature: GZ8MTXP02H68Z8.15.23.C01.1.454.CMB.2.raw
tcagtctacgtagccacgaccggtgctcgatttagtacacgtgattagggattgggaggtctcagagaggagcccttagccctggactccaaggcctttccacttggtgatcagcactgagcacagaggactcaccatggagttggggctgagcgtgggttttccttgttgctattttagaaggtgtccagtgcgaggagcagcgtgggtggagtcgtgggggaggccgtggtccgagggcccggggggtccctgagactcctcctgtcgcccgcctctggactcacctttagtagcttattggatgagtcgtcggggtccccgccgagggcctcccggaagggggaacggggtcgtaggggaggttggggtcggacccaaacgaaagtaaaagggaaagagtaggggaaagtcgaaagaaaacacgtaatggtgggaacttcgtagggttagaaacgggggcctaatttcccgaacctatccctacccgaaggaacgaaccaaaaccgacccaaaaggtaacttaccaaggttgtaaacttccgtagaaacctaaaagtacggaaaacacgtacccgtaggaacggacggtacccggaaggaaccgaccgggtcccgttagtaacgtttaccgtggttagtacggagaacgaactagtaagaacccgtaaagggtcgaaagtaacccggggtaggggttatagg

SEQ ID NO: 370138 - DNA, 697 bp, Homo sapiens
  misc_feature: GZ8MTXP02GOVKK.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtcgccgcctctggactcacctttagtagctattggatgagctgggtccgcaggctccgagggaaggggctgggagtggggtgccaaagagtaaaggagatggaagtcaagaaacactaagtggtggactcgtggtagaacggggccgattccaaacctattcccacccgaaggaacgaaccgaaaccgacccgaaaagtaactttaccgaggtaagtacttccgtaggacctaaaaagtcgggaaaacctacggtaccccgttagggaaacggtaccgggaacccggggtaaacggggacccgtaaaccgggggtaccccgtttaggtttaaacgtttacggttggttagggttacggaaggtaacggaactaagttaacgaaaccggaacggggtaggtaaacggtaaaaccgggggtacgggggtttaacgtaaggg

SEQ ID NO: 370139 - DNA, 743 bp, Homo sapiens
  misc_feature: GZ8MTXP02G8AFN.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggaggcctggtccgaggccggggggtccctgagactctcctgtcgccgcctctggactctacctttagtagtctagttggatggagcgtcggggtcccgccgagggcctaccggaagggggaacggggtcgtaggggagggttcgggggtacggacccaaacgaaagtaaaagggaaagtagtaggggaaagtacgaaagaaaacctacttaagtggtcggacttcgtggtacggaacggggtcccgtattacccgaaccctattccccgtacccgaaagggaacgaaacccgaaaacccgcccgaaaaaggttaactttccgaaaggtttgttaaacttccgttaagaacctaaaagttccgaaaacgacgtcccgtaggaacggacggacccggaaggacccgacgggtccttaggttacgtttacgtgggttagacggaacgtaacgacctaaggttaacggaaaccggtaaaggggtacgtaaaacggggtaaccgggggtagggggtttactaacgggg

SEQ ID NO: 370140 - DNA, 694 bp, Homo sapiens
  misc_feature: GZ8MTXP02HY752.15.23.C01.1.454.CMB.2.raw
  modified_base (271)..(271): a, c, t, g, unknown or other
  modified_base (611)..(611): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctggagctctccgtgtcgccgcctcnggacctctacctttagtagctagttggatgagcgtggtcccgcaggcctccgaggggaacggggctgggaggtggggtcggaccaaagaaagtaaaaggaagagtaggaaacgtacaaataaaacactagttgtgggtacttctagggtacgggaaacgggggtcccgtaatttacccgaacccgtatccccgtaacccaaggaacgaaaccctaaaccggacccaaaaggtaacttacaaggttcgttaaattcgtaagaactaaaagtcggaaaccacgaccgtaggaacggacggaccggaaggaacccgacggggtaccgttagtactttaccggngttagggtaacgagtaacggactagtaacggaaaccgtaacgggtaggtaaacggtaaaccgggggtagggggtttaacaggg

SEQ ID NO: 370141 - DNA, 712 bp, Homo sapiens
  misc_feature: GZ8MTXP02H3DTE.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggtggccgtggtccgaggccggggggtccctggagactctcctgtgccgcctctggactcacctttagtagctattggatgagcgtgggtcccgccgaggcctccggaaggggaacggggtcgtaggggaggttggggtcggacccgaaacgaaagtaaaaggggaaaggaagttagggaaagtaccaaaggaaaacctaactaagttaggtcggggaacttccgtagggttagggaaacgggggtacccgtaaatttcccaaaccctaattcccacccgaaagaaccggaaaccaaaaccggcccaaaagtaaacttcgaagttgtaaattccgttagaacttaaaagtcggaaaaccacgaccgtaggacggacggaccggacggaaccgtacggtaccgttagttacgttacgtggtaggtaaggacgtacgtaacgagtaacggaaaccgtaacgggtacggaaacggtaacgggggtagggttacgtagg

SEQ ID NO: 370142 - DNA, 731 bp, Homo sapiens
  misc_feature: GZ8MTXP02IVOKD.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctgagactctcctgtcgcccgcctctggactcacctttagtagctattggatggagcgtgggtcccgccgaggcctccggaaggggaacggggctgggaggtggggtcggaccaaacgaagtaaaagggaaagagtagggaagtacgaagaaaaccactaagtggtgggaacttcgtaggtacggaaacgggggccccgtatttacccaacccgtacttcccgtacccgaaggaaaccgaaaccgaaacccggaaccccgaaaagtaaacgttttaccgaaaggttaggttaaacttacccgttacggaaaccctaaaagttacgggaaaacctacgaaccccgttaggaacggaaccggaccccggaagggaacccgaaccggggtcccgttaggttaacgtttacgtggtggttacggagacgacgtaagtaacgaacgtaaacgggtagaaaacggtaaccgggtaagggggtttacgaagg

SEQ ID NO: 370143 - DNA, 572 bp, Homo sapiens
  misc_feature: GZ8MTXP02I6O4C.15.23.C01.1.454.CMB.2.raw
  modified_base (413)..(413): a, c, t, g, unknown or other
  modified_base (564)..(564): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctgagactctcctgtgccgcctctggactcacctttagtagctattggatgagctgggtccgccaggctccgaggggaggggctgggagtgggtggccaaacataaaaggagatggaagtcaagaaacactatgtggactcgtgtgaagggccgattccaccatccnccagcgacaacgccaagattcaagtgtaatcgtgactaaaatcggaaactagccctagaacggagcccggaaggactaccggggccttaggtattaccgtgtgtacgagacgacagtaacgacgtaaacgggtgaactttaaaccgggggnggttagag

SEQ ID NO: 370144 - DNA, 694 bp, Homo sapiens
  misc_feature: GZ8MTXP02HDE3U.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtggagtcgtgggggaggccgtgggtcccgaggcccggggggtccctggagactctcctgtgccgcctctggactcaccttagtagctattggatgagctgggtccgccaggcctccgaggggaaggggctgggagtggggtggaccaaacaagtaaagggaagagtagggaaagtacaagaaaaccatagtgtgggactcgtggtagaaaggggcccgtaatttccaaccctatcctacccgaagaacggaaacccaaacgaccccaaaagaacttacgaagttgtaaatccttagaacctaaaagtcgaaaccgaagtcccgaggaacggacgacccggaaggaacccgaacgggcccgttaggttaaaccgttttaacgtcggttaggttacggaaacgggtaacctaacgaagtaaggaaacccgaaaacggggttacggaaaacggtttaaacccgggggtaagggggttttacggaaaccggg

SEQ ID NO: 370145 - DNA, 753 bp, Homo sapiens
  misc_feature: GZ8MTXP02IZIE6.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtcctgagctctcctgtgccgcctctggctcaccttagtagctattggatgagcgtcgggtccgccgaggcctccggaggggaaggggtcgtagggaggttggggtcggacccgaaacgtaagtaaaagggaaacggtagtagggaacgtcgaaaggaaaacctacttaagtggtcgggtaccttcgttggtaggaacgggggcccgtagtttaccaacccgtattccctacccgaaggaacgaaacccgaaaaccgacccgaaaacggtaaactttaccgaaggttacgttaacgttacccgttaggtaaaccctaaaagttaccgggtaaaacgaaccgtacccgttaggaacggacgggaaccccgggaacgggaaccgaccggggttacccgttacggtttaacgtttaaccgttgggttaggtacggtaacggaacgacgtaagtaacggaacccgtaaagggttacggtaaacggttaaaccggggtagggggtttagttaacggg

SEQ ID NO: 370146 - DNA, 663 bp, Homo sapiens
  misc_feature: GZ8MTXP02HR9GU.15.23.C01.1.454.CMB.2.raw
  modified_base (308)..(308): a, c, t, g, unknown or other
  modified_base (514)..(514): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggagccgtggtccgaggccggggggtcctgagactctcctgtcgccgcctcgtgactctaccttagtagctatggatgagcgtgggccnccgagctccgaggggaggctgggaggtgggtcgaccaaacgaaagtaaaagggagtagtaggaagtacgaaagaaaacacttagtgtcgggacttcgtagacggaaacggggcctaatttacccgaacctactccctaccgaagacgaaaccgtaaccgaccaaagtattacgagttacgtaattctagaactaaagtacgaaacncgaccgtagaacggacgcccgggaaaggtacccgacggggtaccttaggttaacgtttacgtacggttggaacggaagaacgtaaaccgtagtaaccggacgtaaaaccggtaggtaaaccggtaaccgggggtaggggtttactaggg

SEQ ID NO: 370147 - DNA, 792 bp, Homo sapiens
  misc_feature: GZ8MTXP02HSK1W.15.23.C01.1.454.CMB.2.raw
  modified_base (345)..(345): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggcccgggggggtccctgagactctcctgtgccgcctctcggactcacctttagtagctatttggatgagctgggtccgcaggctccgagggagggctggagtgggtgccaanaagtaaaggaagagtggaagtcaagaaaacactaatggtgggacttactggtaggaaacggggcccgtaatttcccacccaaacttccgtacccgaacgggaacgaaacccgaaacccgaccccgaaaaggtaaaactttaccgtaaacgttaggttaacttaccgttaggaacctaaaaagtttacgaaaacgtaaaccggtaccccgtaacggaaggaaccgggtaaccccggggaaacggggtaaccccgggaaaaccggggtccccccggtttagggtttaaaaccggtttttaccgttaacgggtttgggttacgggtaaaacgggtaacgggaaaacccttacgttaaagggaaaacccggtaaaaccggggtttacgggtaaaaacgggggtttaaaacccccgggggttaagggggggtttttaccggttaaacggggg

SEQ ID NO: 370148 - DNA, 625 bp, Homo sapiens
  misc_feature: GZ8MTXP02FXBTE.15.23.C01.1.454.CMB.2.raw
  modified_base (341)..(341): a, c, t, g, unknown or other
  modified_base (379)..(379): a, c, t, g, unknown or other
  modified_base (383)..(383): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctcctgtcgccgcctctggactcacctttagtagctattggatgagcgtgggtcccgccaggcctccgaggggagggctggagtgggngaccaaacagtaaaaggagagtaggaagtcaagaaacnctangtgactctgtagaacgggccgattccacctatcctaccgaagagaacctaacgacccaaataacttcaagttcgtaaacttcgtagtaccaaaattcggaaaacctagacccgtaggaacgacggaccggaagggaaccgaccgggtccgtaaggttactttaccggtgtagtacggagaacgacgtaagtaacgaaaaccgtaacgggtacggtaaacgtaaccggggtaggggtctaagg

SEQ ID NO: 370149 - DNA, 592 bp, Homo sapiens
  misc_feature: GZ8MTXP02HBTI4.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggcccggggggtccctgagactctcctgtcgccgcctctggactcacctttagagctagttggatgagcgtggggtccgccaggcctccgaggggaaggggcgtgggaggtggggtggaccaaacgaagtaaaaggaagatagggaagtcaagaaacatatgtggactcgtgtagaaggggccgattccacctatcctaccgagacgaaccaacgccaaagaattcagttgtatctagacaaatgaacagcctagagacgccggaggaccgacggccgttagtacttacgtggtagtagagagactaagtcggaacgtaacgggagtaaacggtaaaccggggtaggggttagtacggg

SEQ ID NO: 370150 - DNA, 660 bp, Homo sapiens
  misc_feature: GZ8MTXP02F6N5O.15.23.C01.1.454.CMB.2.raw
  modified_base (309)..(309): a, c, t, g, unknown or other
  modified_base (391)..(391): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttccttgttgctattttagaaggtgtccagtgcgaggagcagctggtggagtcgtgggggaggcctggtccgaggcccggggggtccctgagactctcctgtgcccgctctggactcacctttagagctagttggatgagctgggtccnccaggctccgaggggacgggctgggagtggggtcgaccaaacgagtaaaggaagacgtagggaaagtcaagaaaacactagngtgggaactcgtagtaggaacggggccattaccgacctattcccgtaccaaaggtacgaaacaaacccgccgaaaaaggtactttacgaagttgtaattccgtagaacctaaaagtgaaaaccgcgtacccgaggaagaccgggaaccgaaggggaacctaccggggccgttaagttacttaaccgtgggtagtaaggacgaacgtccgtaagtaacggaaccgaaaggggttacaaacggtaaccgggggtacgggtttagtaaacgg

SEQ ID NO: 370151 - DNA, 619 bp, Homo sapiens
  misc_feature: GZ8MTXP02GL0AS.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtgcccgcctctggactctacctttagtagcttattggatgagctggggtcccgccaggcctccgaggggaaggggcgtgggaggtggggtcggaccaaacgaataaaagggaagagtagggaaagtcaagaaaccactatggtgggactcgtaggtaggaacggggccctattccaacccatccctaccgaagacgaacaacgccaaagaacttcaagtgtaatcgtgacaaaagtgaaacagccctgagacgaccgtaggaacgacgggccttaggtacttacgtggttagtacggagtaagactaagtcggaaacgaaacgggttgaaacggtaaaccggggtagggggtttagaagg

SEQ ID NO: 370152 - DNA, 800 bp, Homo sapiens
  misc_feature: GZ8MTXP02FLB4V.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtgggtccgagggccggggggtccctggagactctcctgtgccgcctctggactcacctttagagctattggatgagcgtgggtccgccaggcctccggaaggggaaggggctggggaggtggggtcggaccaaacgaagtaaaagggaagagtagggaaagtaccgaaaggaaaacctacgtaagttgggtacgggacctcgttagggtagggaaaacgggggtcccctaaatttacccaaacccgtacttacccgttaccccgaaaagggaaccgaaaaccccgtaaaacccgggacccctaaaaaaggtaaacttttaccgaaaaggttcgtttaaacttccgtaaggaaaccctaaaaagttacgaaaaaccgacggtaccccttaagggaaaccggaacgggacccccggaaagggaaaccccgaccgggggtacccgttaggtttaaaacgtttacggtcggttaggttaacggaaaggtaacgaacctaaaggtaacggaaaaccggtaaaacggggttagggtaaaaccgggttaaaaccgggggtaaggggggtttcgttaaacggg

SEQ ID NO: 370153 - DNA, 667 bp, Homo sapiens
  misc_feature: GZ8MTXP02GZ2HW.15.23.C01.1.454.CMB.2.raw
  modified_base (311)..(311): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggcccgggggggtccctggagactctcctgtgccgcctcgtggactcacctttagagctattggatgagctgggtccnccaggctccgaggggaaggggctgggaggtggggtggacccaaacgaagtaaaagggaagagtacgggaaagtcaaagaaaacactaatgtggactcgtaggtagaaacgggggtcccaatttcccaaaccctaatccctacccaaaggaacgaacccaaaccggacccaaaagaaacttccgaaagttgtaaattccgtagactaaaagtgaaaaccagaccctaggaacggacggacccggaagggtaaccgaaccggggtcccgttaggttaactttacgtgtaggtagaaggacgatagaagaacccgaaacggggttagaaacggtaaaccggggtaggggtttagaaggg

SEQ ID NO: 370154 - DNA, 634 bp, Homo sapiens
  misc_feature: GZ8MTXP02G4EBG.15.23.C01.1.454.CMB.2.raw
  modified_base (517)..(517): a, c, t, g, unknown or other
  modified_base (595)..(595): a, c, t, g, unknown or other
  modified_base (627)..(627): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcggctggtggagtcgtgggggagcctggtccagggccggggggtcctgagactctcctgtcgccgcctcgtggactctaccttagagctattgggatgacgcgtggggtcccgccgaggcctccggaggggaaggggctggggaggtggggtacggacccaaacgaagtaaaaagggagaaggtggaaacgtcgaaagaaacactagtggtaggacttcgtaggtaggaaacggggcctaatttccaaccctattctacccgaaggaacgaaccaacgtaccaaagtaacttcaagtgtaatctaggaaacaaaagtnaaacgagaccctagaacggacgaccggtaaggaccgtaaccggccgtagttacttacgagtgtacggatacgactagngaacgaacggtgtaaacggaacgggtgggttnaggttgg

SEQ ID NO: 370155 - DNA, 643 bp, Homo sapiens
  misc_feature: GZ8MTXP02HTEYU.15.23.C01.1.454.CMB.2.raw
  modified_base (395)..(395): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtcctgagactctcctgtcgccgcctcgtggactctaccttagtagctattggatgagcgtcgggtccgccgaggcctccgaaggggaaggggcgtgggaggtggggtcggaccaaacgaagtaaaaggaagagtaggaagtacaagaaaacnctagtgtcggacttcgtggtacgaacggggcccgtaatttacccaacctatccctaccgaagaacgaaaccgaaacgacccaaaagtaacttacgagttcgtaatccgtagaactaaaagtacgaaacacgacccgtaggaagacggccggaaggaccgacggtccgtagtactttacgtggtagtagagaacgatagaacgaacgtaaacgggtagaaaacggtaaccggggaggggtttacgaagg

SEQ ID NO: 370156 - DNA, 644 bp, Homo sapiens
  misc_feature: GZ8MTXP02FXAJB.15.23.C01.1.454.CMB.2.raw
  modified_base (340)..(340): a, c, t, g, unknown or other
  modified_base (360)..(360): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgctattttagaaggtgtccagtgcgaggagcagcgtggtggagtcgtgggggaggccgtggtccgaggcccggggggtccctggacgactctcctgtcgcccgcctcgtggactcacctttagagctatggatgagctggccgccaggctccgaggggagggctggagtgggnggccaaagagaaaggaaganagggaatcaagaaaccatagtgtggactcgtggtagaacggggtcctattaccgacctaattccctaccgaaagacgaaacccgaaaccgacccaaaagtaactttcgaaggtgttatactggaacctaaaatcgaaaacacgtacccgtaggaacggaacgacccggggaaggaccgaaccggggtccgttaagttaacgtttaccgtggttggtacgaaggacgtaacgagtaacggaacgtaagggtacggaaacgtaaaccgggggaggggtttacaggg

SEQ ID NO: 370157 - DNA, 760 bp, Homo sapiens
  misc_feature: GZ8MTXP02J3L8E.15.23.C01.1.454.CMB.2.raw
tcagtctacgtagccacgaccggtgctcgatttagtacacgtgattagggattgggaggtctcagagaggagccttagccctggactccaagtcctttccacttggtgatcagcactgagcacagaggactcaccatggagttggggctgagctgggttttccttgttgctattttagaaggtgtccagtgcgaggagcagctggtggagtcgtgggggaggcctggtccgagggccggggggtccctggagacctctcctgtcgccgcctcgtggacctctacctttagagctagttgatgagcgtgggtccgccaggctaccggaggggaaggggctgggaggtgggtacgaccaaacgaagtaaaaggagagtagggaatacaaagaaacactagtggtcggactcgtaggtaggaacggggtccctaaattcccgaaccctaattccctaaccgaacggaaacggaacccaaacccggacccgtaaaaaggtaaacttttaccggaagttacggttaacttacccgttagaaacctaaaagtaccggaaaaccgtacgggtaccctaaggggaaacggaaccgggaccccgggttaaacgggggaaccctaaacccgggggtccgtttaaggtttaaacgttaaccggttgggtaacggttacggaacgtaacggaaaccgtaaggttaacggaaaaccggtaaacggggtacggtaaaaccgggttaacccgggggtagggggtttacgaacggg

SEQ ID NO: 370158 - DNA, 766 bp, Homo sapiens
  misc_feature: GZ8MTXP02IIH8S.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgcttattttagaaggtgtccagtgcgaggagcagcgtggtggagtcgtgggggaggccgtggtccgacggccggggggtccctggagacctctccgtgtcgcccgcctctggactctaccttagtagctattggatgagcgtcgggtcccgccagggtcctaccggaaggggaaggggcgtaggggacggttggggtcggaccaaacgaaagtaaaaggaagagtagggaaagtacgaaagaaaactacttaagtggtcggaacttcgtaggtacggaaaccggggtcctaaattcccgaaaccctatccctaaccgaaggaacgaaacccgaaaccgacccgtaaaagtaaccttaccgaaggttcgttaaactccgttagaaacctaaaagtcgaaaaccgacgtccgaggaaacggaaccggccgggttaaaacggacccgtaaccgggtcccgggtttaaggttaaccttttacgggaggtttacggtaaacgggaacggaaacgtaaccgtaagttaaaccgggaaaccgtaaaacgggggttacgtaaaacggggtttaaccccgggggttaaagggggtttactaacggggg

SEQ ID NO: 370159 - DNA, 808 bp, Homo sapiens
  misc_feature: GZ8MTXP02FHT78.15.23.C01.1.454.CMB.2.raw
  modified_base (309)..(309): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggcccgggggggtccctgagactctcctgtcgccgcctctggactcacctttagagctattggatgagctgggtccnccaggctccgaggggaaggggctgggagtggggtggaccaaacaagtaaaagggaaagagtagggaaagtccaaagaaaaccactatgggttggaactctaggtggaaacggggtccgaatttaccaacctattccctacccgaaggaacgaaacccaaaccggacccaaaaggtaaacttttccgaaaaggttcggttaaattcccgtaggaaccctaaaaagttacggaaaaaacccgaggtacccccgttaagggaaaccgggaaaccggacccccggggaaaagggggaaaccccaaacccgggggggtccccgtttaaacgggtttaaaacgtttttaacccggtcggggtttaggttaaacggggaagggtaaaacccggaactaagttaacccggggaaaaccggtaaaaacccggggggtttagggaaaaaaccgggtttaaaaccccggggggggtaaaacggggggggtttttacggtaaaaacggggg

SEQ ID NO: 370160 - DNA, 698 bp, Homo sapiens
  misc_feature: GZ8MTXP02GOSEQ.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgctattttagaaggtgtccagtgcgaggagcagctggtggagtcgtgggggagcctggtccgaggccggggggtcctgacgactctccgtgtcgcccgtcctcgtggactctaccctttagtagcttagttggatggagcgtcgggtcccgccgagggcctaccggaaggggaacggggcgtaggggaggttggggtcggaccctaaacgaagtaaagggaagagtacggaaagtacgaagaaaactactagtggtggaacctcgtaggtacggaacggggcccgtaattcccgaaccctagttcccgtacccaaggtaacgaacccgaaacggaccctaaagtaaactttaccgaagttcgttaaattccgaacggaactaaaagtacgaaaccgtagacccgtaggacggacggaccggaacgggacgacccgggtaccgttaggttacgtttaccgtgtaggtacgagacgactagtaacggaaacgtaaacgggtagtaaacgtaaccgggggtagggttcgtaagg

SEQ ID NO: 370161 - DNA, 702 bp, Homo sapiens
  misc_feature: GZ8MTXP02HMZ26.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtggagtcggtgggggaggccgtggtccgacgggccggggggtccctggacgctcctcctgtcgcccgcctctcggactcctacctttagtagctagtggatggagcgtcgggtcccgccgaggctccggaggggaaggggcgtgggaggtggggcgaccaaataaagtaaaggaagagtaggaaagtacgaacgaaaacctacgttaagttgggtacggtaccttcggtaggtaacggggaacggggtacccgtaattacccgaacctatccctaccgaagaaccgaaaccaaaccgaccaaaagtaacttcgaggttatacttcgtacgaaactaaaagtacgaaaccgagtacccgtaggaacgacggacccggaaggacccgtacggtaccggttagttaacgtttacgtgtgggtaacgaacggtaacaccgtagtaacggaacggtaacggtacgaaaacgggttaaccgggggtaggggtttactaaggg

SEQ ID NO: 370162 - DNA, 704 bp, Homo sapiens
  misc_feature: GZ8MTXP02G7AW7.15.23.C01.1.454.CMB.2.raw
  modified_base (309)..(309): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggcccggggggtccctgagactctcctgtcgccgcctctggactcaccttagtagctattggatgagctgggtccnccgaggcctaccgaggggacggggctgggaggtggggtggaccaaacgaaagtaaaagggaaagaagtgggaaagtaccgaaagaaaacacttatggtgggaacttcgtggtaggaaacgggggtcctaatttcccgaaaccctattccctacccgaaggaaccgaaccgaaaaccgcccaaaaggtaacttaccgaagttgttaaacttccgttaggaacctaaaatcgaaaccgacgtacccgtaggaacggaacggaccggaacggggaaacccgacccggggtacccgtttaggtaaaccgttttaaccgtgggttacggtaggaacgaggaactagtaaggaaacggaaacggtaggaaacggtaaccgggggtaggggtttagaacggg

SEQ ID NO: 370163 - DNA, 623 bp, Homo sapiens
  misc_feature: GZ8MTXP02IFYFI.15.23.C01.1.454.CMB.2.raw
  modified_base (402)..(402): a, c, t, g, unknown or other
  modified_base (504)..(504): a, c, t, g, unknown or other
  modified_base (510)..(510): a, c, t, g, unknown or other
  modified_base (621)..(621): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaagtgtcagtgcgaggagcagcgtggtggagtcgtgggggaggccgtggtccgaggccggggggtcccgtgagactctcctgtgccgcctctggactctaccttagtagctattggatgagcgtgggtccgccaggcctccgaggggaaggggcgtggaggtggggtggccaaacgaagtaaaggaaggagtaggaagtacgaagaaacactagttgcgacttntagtaggaacgggccgtattaccgaccctaatccgtacccgaaggacgaaacaaacccgcctaaaagtaaattccgaagttagtactacttaggactaaaanagaacncgtcgagaagcggacgaacggacgaccggtcgttatacgttacgtgtacggacgaacgacgacagtaacggaaacgtaacgggtagtaaaccggtacgggggtagggtttnag

SEQ ID NO: 370164 - DNA, 748 bp, Homo sapiens
  misc_feature: GZ8MTXP02FKX9B.15.23.C01.1.454.CMB.2.raw
  modified_base (314)..(314): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgttgggttttccttgttgcttattttagaaggtgtccagtgcgaggagcagctggtggagtcgtgggggaggcctggtccgagggccggggggtccctgagactctcctgtcgcccgcctctggctcacctttagagctattggatgagcgtggggtcccnccagggcctccgaggggaaggggcgtggggaggtggggtcggacccaaaacgaagtaaaaggggaaagagtacggggaaagtcaaaaggaaaacctacgtaagttgggtcggaaccttcgttagggtacggaaacgggggtcccgtaaatttcccgaaccctaacttccctacccgaaaggaacgaaaccaaaacccggaccctaaaaggtaactttaccgaaagtttcgttaaactaccgttaggaacctaaaaagttacggaaaaacccgcgtaacccgtaggaacggaacgggaccccggaaacgggaacccgtaccggggtacccgttaggttaaactttacggtggtaggttacggaagtaacgaccgtaagtaacggaacgtaaacgggtggtaaacggttaacccgggggaggggtttacgtaaggg

SEQ ID NO: 370165 - DNA, 652 bp, Homo sapiens
  misc_feature: GZ8MTXP02FJ3HH.15.23.C01.1.454.CMB.2.raw
  modified_base (647)..(647): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgagggccggggggtccctggagactctcctgtcgcccgcctctggactctacctttagagctagttggatgagcgtcgggtcccgccaggcctaccggaaggggaaggggctggggaggtggggtcggaccaaacgaagtaaaaggggaagagtaggaagtacaaagaaacactagtgtggacctgtggtaggaacgggaccgtatttacccgaacctaacgttcccaccgaaaggaacgaaacccaaaccggacccaaaaggtaaactttcgaaagttcgtaactctagaacctaaaagtcgaaaacagacctaggaagaacggaccggaagaccgtacgggcctagttacttacgtggtaggtagagacgacacgtaagacgtaaacgggagtaacggtaaccggggaggggtntaagg

SEQ ID NO: 370166 - DNA, 656 bp, Homo sapiens
  misc_feature: GZ8MTXP02F1TZ3.15.23.C01.1.454.CMB.2.raw
  modified_base (536)..(536): a, c, t, g, unknown or other
  modified_base (653)..(653): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtggagtcgtgggggagccgtggtccgagggcccggggggtccctggagactctcctgtcgcccgcctctggactctacctttagagtctagttggatgagtcgtggggtcccgccaggcctaccggaggggaagggcgtgggaggtgggtcggaccaaacgaaagtaaaaggaagagtagggaaagtacaaagaaacacgtagtagtggactcgtagtaggaacggggtcctattcccaaccgtatccctaccgaagacgaaacccaaacggacccaaaagtaactttcgaagttcgtaacttccgaggaaacctaaagtcgaaaaccgngtaccccgtagaacggacggaccggaaggaccgacggtccgttagtacgttacgtggttagaggacgacgactagtaaccgaaacgtacggtagaacggtaacggggtggggtttanagg

SEQ ID NO: 370167 - DNA, 690 bp, Homo sapiens
  misc_feature: GZ8MTXP02JGNHZ.15.23.C01.1.454.CMB.2.raw
  modified_base (479)..(479): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccgagggccggggggtcctgacgactctcctgtcgccgcctctggacctctacctttagtagctagttggatgagtcgtcggggtccccgccgagggtcctaccggaagggggaacggggtcgtaggggaggttggggtcggaccaaacgtaaagtaaaagggaaagtagtagggaaagtacgaaaagaaaactacgtaagtggtacgggacttcgtaggtaggaacggggacctaagttcccaaaccctnttacccgtaccgaaggaaacgaaacccgaaaccgaccgaaaagtaacttacgaggttagttaactctacggaaactaaagtacggaaactaggcctaggaacggaccgaccggaacggaccgacggccgttagttactacgtgtacggtagaacgtagaactagtaacgaaccgtaagggtacgaaagtaaccggggtggggttactaagg

SEQ ID NO: 370168 - DNA, 599 bp, Homo sapiens
  misc_feature: GZ8MTXP02J1H5O.15.23.C01.1.454.CMB.2.raw
  modified_base (313)..(313): a, c, t, g, unknown or other
  modified_base (336)..(336): a, c, t, g, unknown or other
  modified_base (348)..(348): a, c, t, g, unknown or other
  modified_base (378)..(378): a, c, t, g, unknown or other
  modified_base (543)..(543): a, c, t, g, unknown or other
  modified_base (553)..(553): a, c, t, g, unknown or other
  modified_base (596)..(596): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccgggggggtccctggagactctcctgtcgcccgtcctcgtggactctacctttagtagctattggatgagctgggccnccaggctccgaggggaggctggngtgggtgccaanaagtaaaggagatggaagtcaagaaaaccntagtgtggacttcgtgtggaacgggccgaattccgaccctaatccctacccaaggacgaaccaacggcccaaaagtaattcaagttgtaactctgacaaagtcgaaacacgcctaggacggacgacccggaggacacgggtaccgtagtaacgttacgtggtagngaagacgaanagtcgaaacgaacggttagaacgtaaccggggtaggggtttanagg

SEQ ID NO: 370169 - DNA, 599 bp, Homo sapiens
  misc_feature: GZ8MTXP02FV9BZ.15.23.C01.1.454.CMB.2.raw
  modified_base (397)..(397): a, c, t, g, unknown or other
  modified_base (485)..(485): a, c, t, g, unknown or other
  modified_base (506)..(506): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctgggtggagtcgtgggggaggccgtggtccgaggccggggggtccctgagacctctcctgtgcccgcctcgtggactctaccctttagagctagttggatgagcgtgggtcccgccgaggcctccgaggggaggggctgggaggtgggtcggacccaaacaagtaaaaggaagagtacggaaagtcaagaaaacnctaagtcggtgggaacttcgtagtacgggaacggggccgtattccacctagtccctacgagacgaacaacgcctaaagtattcgagtntaatcagacaaaatcgaaacngccagacgacgcgagaccgacggtctagttatacgtgtagagagagacagtaacggaacgtaaggtacgtaacggtaacggggtaggtcgtag

SEQ ID NO: 370170 - DNA, 572 bp, Homo sapiens
  misc_feature: GZ8MTXP02JW6ZV.15.23.C01.1.454.CMB.2.raw
  modified_base (375)..(375): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtcgccgcctctggactcacctttagtagctattggatgagctgggtccgcaggctccgaggggaagggctgggagtggggtggccaaacagtaaaggagatcggaagtcaagaaacnctatgtggactctggtagaacggggtccaattccgaacctatcctacccgagacgaacaacgccaaagaacttcagtcgtaatctgacaaatgaaccagcctggacagccgaggacctacgggccgtagtattacgtggtgtagagagacagtaacgaacgtaacggtagaaacggtaccggggagggggttacagg

SEQ ID NO: 370171 - DNA, 656 bp, Homo sapiens
  misc_feature: GZ8MTXP02IR6MU.15.23.C01.1.454.CMB.2.raw
  modified_base (425)..(425): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggaggttggggctgagcgttgggttttccttgttgcttattttagaaggtgtccagtgcgaggagcagcgtggtggagtcgtgggggaggccgtggtccgagggcccggggggtcctggacgactctcctgtcgccgcctctggactctacctttagtagctattggatggagcgttcgggtcccgccaggcctccggaggggaaggggctgggaggtggggtcggaccaaacaagtaaaaggaacgatagggaaagtacaaagaaaacacttagtgtcggacttcgnggtaggaaaggggcccgatttccaaccctatccctccaaggacgaacaaaccgcctaaaagtactcgagtacgtattcgtagaactaaaagtcgaaaacacgaccgttaggaaacgacggacggaaacggacgaaaccgggtcccgtagttacgtttacgtggtagtacgaggacgtacaagtaacgaacgaaacggtacgaacgggtaaaccgggtggggtttaagaagg

SEQ ID NO: 370172 - DNA, 807 bp, Homo sapiens
  misc_feature: GZ8MTXP02GC4KD.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctgagactctcctgtcgccgcctcgtggactcacctttagtagctattggatgagcgtgggtcccgccgaggcctaccgaggggaaggggcgtgggaggtggggtcggacccaaacgaagtaaaagggaagtaagtacgggaaacgttcgaaaggaaaacctacttaagttcgggtacgggaaccttcgttagggtagggaaacggggtccccgtaaatttacccgaaccctattcccctacccgaaaggaaccgaaacccgaaaacccggaccccaaaaggtaaactttccgaaggttagtaaacgttccgtaggaacccgtaaaaagttcggaaaaccgaacggtaccccgttagggaaacggacgggaaccccggaaaggggaacccgtaccggggtaccccggtttaaggtttaaacgttttaaacccggtgggttacgggtacggtaaacgggtaacggaacctaaaggttaacgggaaaaccccggtaaaacgggggttacggtaaaaccgggtttaaaacccggggggttagggggtttaccggtttaaagggg

SEQ ID NO: 370173 - DNA, 580 bp, Homo sapiens
  misc_feature: GZ8MTXP02J4C1M.15.23.C01.1.454.CMB.2.raw
  modified_base (197)..(197): a, c, t, g, unknown or other
  modified_base (380)..(380): a, c, t, g, unknown or other
  modified_base (473)..(473): a, c, t, g, unknown or other
  modified_base (529)..(529): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaggtgtccagtgcgaggancagctggtggagtcgtgggggaggcctggtccgaggccggggggtccctgacgctctcctgtgccgccttctggactctacctttagtagctattggatgagctgggtccgccgaggctccgaggggaaggggctgggagtggggtggaccaaacaagtaaaaggagatggaagtcagaaacnctatgtggactctggtgaaggggccattcccacgatcctaccagagaccaaacggccaaagaatttcgagtgtatctagacaaaagtgaaacngccgtgagacgacccgggagtaccgacgggtacccgttgtaacttacgtggttagngaacgagacatggacaacggggtcgaaagtaccggggtaggggttagtagg

SEQ ID NO: 370174 - DNA, 731 bp, Homo sapiens
  misc_feature: GZ8MTXP02G8H6Q.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggagcctggtccgaggccggggggtcctgagactctcctgtcgccgcctcgtggactctacctttagagctattggatgagcgtgggtcccgccagggcctaccggaaggggaaggggcgtgggaggtggggtcggacccaaacgaaagtaaaagggaagaagtaggggtaaagtacgaaagaaaactacgtaagttggtcggtaccttcgtaggtaggaaacgggggcccgtatttacccaaacccgtaactttcccgtaacccgaaacggaaacgtaaacccgaaaacccggacccaaaaaggtaactttaccgaagtttcgttaaactccgttaggaaaccctaaaagtacgaaaaccgacgacccgtaggaacgaccgggtacccgaacggggaaacccgccggggtacccgttagttaccgttagttcggtagggtagaacgaaagccgaaagtaacgaaacgtaaaccggtaggtaaaccggtaaccgggggtaggggtttagtagg

SEQ ID NO: 370175 - DNA, 783 bp, Homo sapiens
  misc_feature: GZ8MTXP02IUMUZ.15.23.C01.1.454.CMB.2.raw
  modified_base (704)..(704): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcggtgggggaggccgtgggtcccgacgggcccggggggtccctggagtacctctccgtcgtcgcccgtccctcgtcggtactcctacccgtttagtacgtcttagttaggtattggacggtccggttcggggtaccccggcccgacgggcccgtacccggaagggggaacggggcggtaggggagggttcggggtacggaacccaaaacgtaaaggtaaaaagggaaaggtagtaacggaaagtaccgaaaggaaaacctacgtaagttggtcgggaacttcgtaggtacgggaaccggggtccgtaacttccaaacccacgttccctaaccgaacggaacgaaaccgaaacccgtaaccgaaaaggtaactttaccaaggttcgtaagttacgtacggaaacctaaaagtacggaaaaccgcggtacccgtggaagggaaccggaccgggaaaggtacccggtaccggtaccggttaagttacgtttaccgngggttcgagtaacgacgaacttagaacggtaaaccgagggtaacggaaacggtaaccgggggtagggtttacgtaaggg

SEQ ID NO: 370176 - DNA, 788 bp, Homo sapiens
  misc_feature: GZ8MTXP02FJ2KK.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggcccgggggggtccctgagactctcctgtgcccgcctctggactcacctttagagctagtggatgagctgggtccgccaggctccgaggggaaggggctgggaggtgggtggaccaaacaagtaaaaggaagatgggaagtccaagaaacactatggtgggactcgtggtaggaaacgggggcccgtaatttcccgaaaccctaagttcccgtacccaaaggaacgaaacccgaaaaccgccccaaaaagggtaaactttaccgaaaggttacgttaacttaccgttaaacggaaccctaaaaagttacgggaaaaacccgaaggtacccccgttaggggaaaccggaaccgggacccggggaaacggggaaacccgtaaccgggggtacccccggttaggttaaaaccgttttaccggttacgggttacgggttaacggtaaacggggaaggaaaccctaaggttaaccgggaaaacccggtaaaaccgggggttaaggtaaaacggggtaaaacccccggggggttaaggggggtttaccgttaaaacggggg

SEQ ID NO: 370177 - DNA, 614 bp, Homo sapiens
  misc_feature: GZ8MTXP02HT6OV.15.23.C01.1.454.CMB.2.raw
  modified_base (312)..(312): a, c, t, g, unknown or other
  modified_base (398)..(398): a, c, t, g, unknown or other
  modified_base (498)..(498): a, c, t, g, unknown or other
  modified_base (506)..(506): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccgaggccggggggtcctgagactctcctgtcgccgcctctggactcacctttagtagctagttggatgagcgtcggggtcccnccgaggctaccggaaggggaaggggctagggaggtggggtcggacccaaagaagtaaaaggagagtacgggaaagtcaagaaaacncttaagtggtggacttcgtggtagaaacggggtccaattccaaccctattccaccgaagacgaaccaaacgcctaaaagacttcgagttgtaatcgtaanaactaaanagaacgacgacgagacgacgacggacggacgacgacgtacgtagttacgtagtagtagagacgagagtaacgacgaacggtacgtaacggtaacggtacgggtagtag

SEQ ID NO: 370178 - DNA, 603 bp, Homo sapiens
  misc_feature: GZ8MTXP02HBKQW.15.23.C01.1.454.CMB.2.raw
  modified_base (371)..(371): a, c, t, g, unknown or other
  modified_base (389)..(389): a, c, t, g, unknown or other
  modified_base (392)..(392): a, c, t, g, unknown or other
  modified_base (400)..(400): a, c, t, g, unknown or other
  modified_base (445)..(445): a, c, t, g, unknown or other
  modified_base (457)..(457): a, c, t, g, unknown or other
  modified_base (461)..(461): a, c, t, g, unknown or other
  modified_base (481)..(481): a, c, t, g, unknown or other
  modified_base (590)..(590): a, c, t, g, unknown or other
  modified_base (599)..(599): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccgggggggtcctggagactctcctggtcgccgcctctggacctcacctttagtagctattggatgagctcgggtccgccagggcctccgaaggggaaggggctgggagtggggtcgaccaaagaagtaaaggaagntacggaatcaagaaaacntangtgactgngtagagggcgattccacgtatcctcaagacacgaaaccgccaaanaacgttcaggtntaanctagaactaaaagtcgaaanacgccgtaggaacgacggtacgaggtaaccgacgggccttagttaactttgaggtgtacggaagtacgaattagaacgaaacggtaacggtagaacgttaaaccggggnggggtttanaagg

SEQ ID NO: 370179 - DNA, 688 bp, Homo sapiens
  misc_feature: GZ8MTXP02F8NSH.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctggtttccttgttgctatttagaaggtgtccagtgcgaggagcagctggtggagtcggtgggggaggtccgtggtccgacgggccggggggtccctgacgacctctccctgtcgcccgcctcgtggtactccgtaccttttagacgtcttagttggatggacggtcgtcgggtccccgaccgacgggtccgtacccggaagggggaacggggtcgtaggggtaacgggttcgggggtacggaccccaaaacgtaaaggtaaaaaggggaggtaacgtaggggaaacgtacgaaagtaaaacctacttagtagggtcggacttcggtaggtagggacggggacctatccacgtactctaccgaagacgaacacgaccaaagtacttacagtgtatcgtagacaaatagaacgagtaccgagaggacgaccggaaggtaccgaacggtccgttagtacgttaacgtggtgtagagaacgtaacgaagtaacgaaacggtaacggtacggaacggttaacgggggtaggttacgtaagg

SEQ ID NO: 370180 - DNA, 705 bp, Homo sapiens
  misc_feature: GZ8MTXP02G2UF4.15.23.C01.1.454.CMB.2.raw
  modified_base (321)..(321): a, c, t, g, unknown or other
  modified_base (383)..(383): a, c, t, g, unknown or other
  modified_base (550)..(550): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggaggttggggctgagcttgggttttccttgttgctattttagaaggtgtccagtgcgaggagcagcgtggtggagtcggtgggggacggccgtggtccgacgggccggggggtcctggacgactctcctgtcgccgcctctggactctacctttagtagctagttggatgagcgtgggtcccncaggcctaccgaggggaaggggctgggaggtggggtcggaccaaacgaaagtaaaagggaanagtagggaaacgtaccgaaagaaaactactagtggtgggaccttgtaggtagggaacgggtcccgtaatttcccgaacccatttcccgacccaaagggaacaacccgaaaacgaccccgaaaagtaacttacagttagtaaactcttagaactaaaagtcgaaacgngaccgtaggaacggacgacccgggaaaggtaaccgaccgggtccgttagttaacgttacgtggttggagaacgggaaacgtaacgtaaggtaacggaaaacggtaacggggttaacggaaacgggtaaaccgggggttaggggtttaacgtacgg

SEQ ID NO: 370181 - DNA, 575 bp, Homo sapiens
  misc_feature: GZ8MTXP02FL3BI.15.23.C01.1.454.CMB.2.raw
  modified_base (476)..(476): a, c, t, g, unknown or other
  modified_base (524)..(524): a, c, t, g, unknown or other
tcagtctacgtagccacgaccggtgctcgatttagtacacgtgattagggattgggggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggaggcctggtccgaggccggggggtccctgagctctcctgtcgccgcctctggactctacctttagagctattggatgagcgtggtccgcaggctccggagggagggctggaggtggggtacgccaaagataaaaggagtagtaggaaacgtcaagaaaacactaatggtaggactcgtggtaggaacgggccgtaattcgaccatcctaccaagacgacaacgcaaagtaattacagttagtaactctgaactaagngaaacgtcgacctaggagacgacgaggacacgggtctgttatactggngtagagacgtaacagacgaacgaggtagaacggtacgggtaggtcgagtcg

SEQ ID NO: 370182 - DNA, 562 bp, Homo sapiens
  misc_feature: GZ8MTXP02FRBGN.15.23.C01.1.454.CMB.2.raw
  modified_base (345)..(345): a, c, t, g, unknown or other
  modified_base (352)..(352): a, c, t, g, unknown or other
  modified_base (413)..(413): a, c, t, g, unknown or other
  modified_base (422)..(422): a, c, t, g, unknown or other
  modified_base (440)..(440): a, c, t, g, unknown or other
  modified_base (557)..(557): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctgggtggagtcgtgggggaggcctgggtccgaggccgggggggtccctggagactctcctgtgcccgcctctggactcaccctttagtagctattggatgagctgggtccgccaggcctccgaggggaggggctggagtgggnggccaanataaaggagagtggaagtcaagaaacactatgtggactcgtggtgaacgggccattccacntctccaganacaacgcaaagatcagtntaatctagacaaatggaaacagccctaggacgacgcggacggacgaccgggtcgtgttattacgtggtagtagacgagacagtaagaacgtaacggtgaacgtaacggggtggggtntaagg

SEQ ID NO: 370183 - DNA, 716 bp, Homo sapiens
  misc_feature: GZ8MTXP02GGTTO.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtgggtccgaggccgggggggtccctgagactctcctgtcgccgcctctggactcacctttagagctattggatgagctgggtccgcaggctccgaggggaaggggctgggagtggggtgccaaacagtaaaaggaagagtacggaaagtcaaagaaaacactaagtgtgggactcgtggtaggaacggggtccgattccaaccctattccctacccgaaggaacgaaaccaaacccggacccaaaaggtaaactttccgaaaggttggttaaacttacccgttaggaacctaaaaaagttcgggaaaaaccgacggacccccgttagggaaacggaaccgggaaccccgggaaaggggaaccccgtaaccgggggtccccgtttaggttaaactttacggttggttaggtacggaaggaaacgacgtaagtcggaaaacccgtaaacgggttacgaaaacggttaaaccgggggtagggggtttaacgagg

SEQ ID NO: 370184 - DNA, 548 bp, Homo sapiens
  misc_feature: GZ8MTXP02HSE0Q.15.23.C01.1.454.CMB.2.raw
  modified_base (458)..(458): a, c, t, g, unknown or other
  modified_base (544)..(544): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccagccgggggggtccctgagactctcctgtgccgcctctggactcacctttagtagctattggatgagctgggtccgccaggctccgaggggaaggggctgggaggtgggtggccaaacgaataaaaggagatggaagtcagaaacactatgtggactctgtgaagggccgattccacatcctacagacgacaacgccaagtaattcagtgtatctgacaaatgaaacngcctgagagccgaggacacggccgtgtattacgtgtgtagacgagaacagtcgaacgaacggtgaacgtaaccgggaggggtttanaagg

SEQ ID NO: 370185 - DNA, 773 bp, Homo sapiens
  misc_feature: GZ8MTXP02JNPU1.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggagccgtggtccgagggcccggggggtccctggagacctctcctgtcgcccgcctcgtggactcacctttgagctattggatgagcgtcggggtccccgccgaggcctacccggaggggaaggggctggggaggtggggtcggacccaaacgaaagtaaagggaaagagtacgggaaagtaccgaaagtaaaaccacttagtaggtcgggaacttcggtagggtacgggaaaggggtcccgtaatttcccaaaccctagttaccctacccgaaggtaaacgaacccgtaaaaccggaccctaaaaggtaaactttccgaaggttacgttacttccgttaaggaaccttaaaaagtcgaaacgtacggtaccctaggaaacggacggaccggaacgggaccgtaaaccgggcccgtttagttaacccgtttaggtggttacgggtaggtaacgtaaacggtaaccgtaaggttaaccgggaaaaccggttaaaaccgggggttaggaaaacccggggtttaaaaccgggggtacgggggtttacttaacggggg

SEQ ID NO: 370186 - DNA, 594 bp, Homo sapiens
  misc_feature: GZ8MTXP02FZT3N.15.23.C01.1.454.CMB.2.raw
  modified_base (427)..(427): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccgggggggtccctgagactctcctgtgccgcctctggactcacctttagtagctattggatgagctgggtccgccaggctccgaggggaacggggcgtgggaggtggggtggaccaaacgaagtaaaaggaagatgggaagtacaagaaaacactatgtggactctggtagaaggggccattccaccatccnccaagacgacaacgccaaagaattcagtgtaatctgacaaatcgaaacagacccgtaggaacgacggaccggaaggaaccgaccggggcccgtagtactttaccgtggtagtacgagaacgcagtaagaccgtaaggtagaacgtaaacggggaggggttagtaagg

SEQ ID NO: 370187 - DNA, 634 bp, Homo sapiens
  misc_feature: GZ8MTXP02F4R64.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctcctgtgccgcctcgtggactcacctttagtagctattggatgagcgtgggtcccgccgagggcctaccgaggggaaggggcgtgggaggtttggggcggaccaaacgaagtaaaggaagagtagggaaagtcaagaaacactagtgtgggactcgtgtaggaacgggccgtattccaacctatccctacccaaggacgaaccaaacgacccaaaggaactttcgaagttgtactactgactaaaatcggaaacagcccgtagacggacgcccgaagggaccacgggtacccgtagttactttacgtggttagtgagtaacgactaagtaacgaacgtaaacggtcggtaaacgtaaaccgggggaggggtttagtaagg

SEQ ID NO: 370188 - DNA, 679 bp, Homo sapiens
  misc_feature: GZ8MTXP02IYZ65.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgagggccggggggtccctgagactctcctgtcgccgcctcgtggactcctacctttagtagctagttggatgagcgtcgggtcccgccgagggcctacccggaaggggaaggggcgtgggaggtggggtcggaccaaacgaagtaaaagggaaagtagtagggaaagtacgaaaggaaaacctacgttaagtgggttacgggaacttcggtaggtaggaaaccggggtccgtaatttcccgaaaccctatcccgtaccgaaaggaacgaaacccaaaccgacccaaaagtaactttccgaagttagtaactcctaaggaacctaaaagtcgaaaccagccgtaggaacgacggaccgaaggaccacggtccgtagttattacgtggtagtagaagacgacagtaacggaacgtaacgggtagaacggtaacggggtagggtttacgagg

SEQ ID NO: 370189 - DNA, 631 bp, Homo sapiens
  misc_feature: GZ8MTXP02GWPNK.15.23.C01.1.454.CMB.2.raw
  modified_base (599)..(599): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctggagactctcctgtcgccgcctcgtggactctacctttagtagctattggatgagctgggtccgcgaggcctccgaggggaaggggctgggaggtgggtacggccaaacgaagtaaaaggaagagtaggaagtacaagaaacacttagtgtcggacctgtaggtaggaacgggtccgatttacccaacccgtatccctcccgaaaggaacgaaccaaaccgtaccaaagtaacttcgagtgtaaactcgtagaactaaaagtcgaaacacgccgtagacgacggacccgaaggaccacggccgttagtactacgtgtagagacgtacgactagtaacggaacgaaacgggtntaaacggtaaccgggggtagggttacgtacgg

SEQ ID NO: 370190 - DNA, 602 bp, Homo sapiens
  misc_feature: GZ8MTXP02HXHWU.15.23.C01.1.454.CMB.2.raw
  modified_base (475)..(475): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccagccgtggggggtccctgagctctcctgtcgccgcctcgtggactcacctttagtagcttatggatggagcgtgggtcccgccgaggcctccgaggggaaggggctggggagtggggtggaccaaacgaagtaaaagggaagagtagggaaagtcaaagaaacacttaatggtaggacttctggtagaacggggcctattccaccatcctaccgagagaaccaacgaccaaagaattcagttgtanctgaacaaaatcggaaactgacctagagcgacccgaggaaccgacggtcgtatacgttacgtggttacgtagacgaagactaagtcggtaacgaaacgggttgaaaccggtaacggggtggggttag

SEQ ID NO: 370191 - DNA, 672 bp, Homo sapiens
  misc_feature: GZ8MTXP02HW38H.15.23.C01.1.454.CMB.2.raw
tcagtctacgtagccacgaccggtgctcgatttagtacacgtgattagggattgggaggtctcagagaggagccttagcccctggactccaaggcctttccacttggtgatcagcactgagcacagaggactcaccatggagttggggctgagctgggttttccttgttgctatttttagaaggtgtccagtgcgaggagcagctggtggagtcgtgggggaggccgtggtccgaggcccggggggtccctggagactcctccgtgtcgcccgcctcgtggactcacctttagagctattggatgagcgtgggtcccgccgaggctccggaaggggacggggctggggaggttggggtacggaccaaacgaagtaaaaggggaagtagtaggggaaataccgaaagaaaacctattaacgtggtcggaacgttcgtagggttacgggaaacgggggtcccgtatttacccgaccctaagtccctaccgagacgaaaccaacgacccgaaagtaacttacgagtagtagttcctagaactaaaagtacgtaaacacgttaccgagaggacggaccggaaggaccgacgggtaccgttagtactttacgtgtgttaagagaacgactaacgaagaacgaaacggtagtaacggtaaccgggtggggttactagg

SEQ ID NO: 370192 - DNA, 700 bp, Homo sapiens
  misc_feature: GZ8MTXP02FIZID.15.23.C01.1.454.CMB.2.raw
  modified_base (578)..(578): a, c, t, g, unknown or other
  modified_base (697)..(697): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggcccgggggggtccctggacgctctccgtgtcgcccgcctcgtacggactcctacctttagagtcttagttggatgacgtcgtcggggtcccaccgaggtccctaccggaagggggtaacggggcgtaggggagggtgggggtcggaccctaaaacgtaaagtaaaaggggaaagtacgtagggaaacgtaccgaaaagaaaaccctagttaagtgggttaggacctcgtagggtacggggaaaccggggtccgtaattacccaacctattcccacgaaagacgtaaaccacccgacaaagtaacttcgaagttcgtaattcgagaacttaaaagcgaaaaccgngtccgtagggaacgacggacggaagtacccggacggtaccgttagtactttacgtggtgtaacggagaacgactagtaacggaacgtaccggtagaaaccggtaacggggtaggggttntag

SEQ ID NO: 370193 - DNA, 774 bp, Homo sapiens
  misc_feature: GZ8MTXP02HSI3U.15.23.C01.1.454.CMB.2.raw
  modified_base (404)..(404): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccgaggccggggggtccctggacgactcctcctgtcgccgcctcgtgactctaccttagagctatggatgagcgtcgggtccgccgaggcctaccggaggggacggggctggggacggttggggcggaaccaaacgaaagtaaaaggagtaagtacgggaaacgtacaagaaaacngttaagtggtcggaactgttggaggaaacggggcctaatttacccaactacttacccaccgaaaggacgaaacccaaacggttaccccaaaaaggtaaaccctttcgaaaggttacgttaaatttcccgtaaaacgaaacgtaaaacgtaaacgtaaaccgaaccgtaaccgtaacggaacggaacggaaccgggaaaccgggtaaacccgggtaacccgggtaaccggttaacggtttaacgtttaacggttacggttacggtaacggtaaacggtaacggtaaacgtaacgtaacggtaaacggtaaaaccgggtaaacgggtaaaacggggttaaaaccgggggttaacggggtttaacgggtacgg

SEQ ID NO: 370194 - DNA, 630 bp, Homo sapiens
  misc_feature: GZ8MTXP02FQ2VO.15.23.C01.1.454.CMB.2.raw
  modified_base (393)..(393): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggagcctgggtccgaggcccggggggtccctggacgactctcctgtcgccgcctctggactcacctttagagctattggatgagctgggtccgcaggcctccgaggggaaggggcgtgggaggtggggtacggccaaacgaagtaaaaggaaagataggggaagtcaagaaaacnctaatggtggactcgtgtaggaagggccgtattccaccatcctcaagacgaacaacgaccaaagaattcagtgtattcagacaaatagaaacacgccgtagaacggacggaccggaaggacgaccgggacccggttagttaacgttaacgttggtaggttacgaggtaacgaaccgtagtaacggaaccgtaaacgggtacggtaaacggtaaaccgggtagggggttacgtaaggg

SEQ ID NO: 370195 - DNA, 729 bp, Homo sapiens
  misc_feature: GZ8MTXP02GVSS4.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgtctattttagaaggtgtccagtgcgaggagcagctggtggaggtcgtgggggaggcctggtccgaggccggggggtcccgtgagactctctgtgccgcctctggtactctaccgtttagtagctattggatgagtcgtcggtccggccaggcctaccgaaggggaaggggcgtaggaggtcggggtcgaccaaacaagtaaaaggaagagtaggaagtacaaagaaacactaagtgtggtacctgtaggtaggaacggggccgtaattaccgaacccatttcccgacaacggaacggaacccaaaccgggacccaaaaggtaaaccttacgagggttaacgttacttaccgagtaacccggtaaaattacggaaaccgtaacgaccccgtaggaaaccgggagaaccccgggaaacgggtacccgaaccggggtccccgttaagggtttaactttaaacgtcggttaggtacgtaaagggaccaaagtacgtaacggaaaacccgaaacgggggttaacgaaccggtaaaaaccgggggttcgggggtttagtaaacgggg

SEQ ID NO: 370196 - DNA, 637 bp, Homo sapiens
  misc_feature: GZ8MTXP02F3U5D.15.23.C01.1.454.CMB.2.raw
  modified_base (309)..(309): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgagggccgggggggtccctgagactctcctgtgccgctctggactcacctttagagctagtggatgagcgtgggtccnccaggcctcgaggggagggctgggaggtgggtcggaccaaacgaagtaaagggaagagtacgggaaagtcaaagaaacactagtggtggactcgtggtacggaacggggtccctattccaaccgtatccctacccgaaaggacgaaaccctaaacgaccaaaagtaaacttcaagttgtaaactctagaactaaaagtcgaaaacagacccgtaggaacggaacggaccggaaggaaccgtacgggccgttaggttacttacgtggttagacgagaacgacagtaacggaaacgaacgggtagaacggtaacggggtagggttagagg

SEQ ID NO: 370197 - DNA, 623 bp, Homo sapiens
  misc_feature: GZ8MTXP02FQP1E.15.23.C01.1.454.CMB.2.raw
  modified_base (315)..(315): a, c, t, g, unknown or other
  modified_base (431)..(431): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgagggcccggggggtccctggagactctcctgtcgcccgcctcgtggactctacctttagagtctattggatggagctgggccncgaggcctcggaggggaggggctgggaggtggggcggaccaaacgaagtaaaagggagagtaggaaagtcaaagaaacactagtgtggactgtgtaggaacggcattcactatccncagacgacaacgaccaaagattcgagtgtatcgtagaacaaagtacgaaacacgtaccgtaggaacggacggacccggaagggaaccgacgggtccgttagttaacttacgtggtaggtacggaagaacgactaagtaacgaaacgtaaacgggtagaaacgggttaaaccggggtaggggttacgtaaagg

SEQ ID NO: 370198 - DNA, 665 bp, Homo sapiens
  misc_feature: GZ8MTXP02IWZ3R.15.23.C01.1.454.CMB.2.raw
  modified_base (400)..(400): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtgggtccaggccggggggtccctgagactctcgtgtcgccgcctcgtggactcaccttagtagctattggatgagctcgggtccgcaggcctcgaggggaaggggctgggaggtggggtcggaccaaacgaagtaaaagggaaagagtaggaaagtcaaagaaaaccactagtgngggactcgtgtagaacggggccgattccaccctatcctaccaaggacgaaccgaacgacccgaaagaactttcgagttagtaatcttaggaactaaaagtacgaaaccagacccgttagggaacggacggaccgggtaagggaaccgaccggggtacccgttaggttactttaccggttggtaggttacggaaagacggaaacaagttcggaaaacgtaacggggtacgaaacggtaaacccggggggtaggggttttacgaagg

SEQ ID NO: 370199 - DNA, 577 bp, Homo sapiens
  misc_feature: GZ8MTXP02HQV3E.15.23.C01.1.454.CMB.2.raw
  modified_base (347)..(347): a, c, t, g, unknown or other
  modified_base (448)..(448): a, c, t, g, unknown or other
  modified_base (452)..(452): a, c, t, g, unknown or other
  modified_base (454)..(454): a, c, t, g, unknown or other
  modified_base (460)..(460): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccaggccgggggggtccctgagactctcctgtgccgcctctggactcacctttagtagctattggatgagctgggtccgccagggctccaggggaaggggctggagtggggtggccaaanataaaaggaagatcggaagtcaagaaaacataatgtgggactctgtagaaagggggcccaattccaccatcctccagagacaaacgccaaagaattcagtntatntnacaaangaacagcagagacgcgaaggacgacggtccgtagttaacttacgtggtagtagaagacgaacaagtaagaaacgaaacggtaacggtaacggtaaaccgggtaacggggttaggtag

SEQ ID NO: 370200 - DNA, 706 bp, Homo sapiens
  misc_feature: GZ8MTXP02G3K95.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgttggttttccttgttgcttattttagaaggtgtccagtgcgaggagcagctggtggagtcgtgggggaggccgtggtccgaggccggggggtccctggagactcctcctgtcgcccgcctctggactctacctttagtagctattggatgagcgtcgggtcccgccgaggcctaccgaaggggaacggggcgttgggaggtggggtcggaccaaacgaaagtaaaagggaaagtagtagggaaagtacaaaggaaaaccacgttaagtggtgggtaccttcgtagggttagggaaacgggggtcccctaaagtttacccaaacccatttacccctacccgaaaggaaccggaaacccaaacccggacccaaaaaggtaactttaccgaaggttagttaaactcgttaagaacctaaaagtacgaaaaccgacgacccgtaagacgacgaccgtaagggaccaacgggtcctagttaaacttcgtggtggtaggacgggacagtacgaacgtaaacggtaggaaacggtaacgggtagggttacgaagttcgg

SEQ ID NO: 370201 - DNA, 633 bp, Homo sapiens
  misc_feature: GZ8MTXP02JSZ9Z.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtcccgagggcccgggggggttccctggacgactctcctgtcgcccgcctctggacctcacctttagtagctatttggatggagcgtgggtcccgccgaggcctccgaggggaaggggcgtgggaggtggggtcggaccaaacgaagtaaaaggaagagtacgggaaagtcgaagaaaacacgtaatgggtgggacctcgtggtaggaaacggggcccgtatttaccaccctatccctacccaaggaacgaaccaaaccgacccaaaagtaattccgagttcgtaatctaggacaaaatcgaacagccgtagacggagccgaggaccacgggcgtgttactacgtgtggtagagacacgagtaagaaccgaaggtcgaaacgtaaccggggtaggggttacgtagg

SEQ ID NO: 370202 - DNA, 715 bp, Homo sapiens
  misc_feature: GZ8MTXP02HKF1N.15.23.C01.1.454.CMB.2.raw
  modified_base (391)..(391): a, c, t, g, unknown or other
  modified_base (550)..(550): a, c, t, g, unknown or other
  modified_base (622)..(622): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgtcttattttagaaggtgtccagtgcgaggagcagcgtggtggagtcggtgggggaggccgtggtccgacggccggggggtccctgacgactctccgtgtcgccgcctcgtggacctctacctttagtacgcttagttggatggagcgtcgggtcccgccgagggcctaccggaggggaacggggcgtgggaggtggggtcggaccaaagaaagtaaaaggganagtaggaaacgtacaagaaaacacttagtcggtcggtacttcgtagtacgggaaacggggccctaatttcccaaaccgtatcccgtaacgaagggaacaaacccgaaaccgaccgtaaaataacgttcgaagttagtaaattccgtagaaacttaaaanacgaaaccgacacgtaggaaacggaccggacggaaacggccgaaaccgggtcgtttagttaacttttacggnggtaggtaacgaacggaacgtaactacggtaaacgaaaccggtaaacggtaacggtaaaaccggggtaacgggggttaggggtttacgaacgg

SEQ ID NO: 370203 - DNA, 777 bp, Homo sapiens
  misc_feature: GZ8MTXP02HK821.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaggtgtccagtgcgaggagcagcgtggtggagtcgtgggggagccgtggtccgagggccggggggtccctggagactctcctgtcgccgcctcgtggactctacctttagtagctagttggatgagcgtcgggtcccgccgaggcctaccggaggggaaggggctaggggcggtggggtacgaccaaacgaagtaaaaggaagtatagggaaatacgaaagaaaacctagttagtggtacgggacctttcgtaggtagggaaaccgggggtcctaactttcccaaacccttactaccccgaacgaaacggaaccgaaacccgtaaacccgtaaccgtaaaagttaacttcggaagtttagttaaaccttacgtaaacgtaaacttaaaagtaccggaaaccgtacgtaccgtaagggaaacggtacccgggacccggtaaacgggacccgtaccgggttaacgtttacggtttaacgtttacgtagggtaaacggtacggaaaacggtaacgtaaccgtaacggtaaccggggtaaaaccggttaaggggttaaccggaaaaccggggtttacgggggttaacggggttttagacgggg

SEQ ID NO: 370204 - DNA, 599 bp, Homo sapiens
  misc_feature: GZ8MTXP02IKIAI.15.23.C01.1.454.CMB.2.raw
  modified_base (291)..(291): a, c, t, g, unknown or other
  modified_base (474)..(474): a, c, t, g, unknown or other
  modified_base (537)..(537): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagtggggctgagctgggttttccttgttgctattttagaaggtgtccagtgcgaggagcagctggtggagtcgtgggggagccgtggtccgaggcccgggggggtccctgagactctcctgtgcccgcctcgtggacctctaaccttagtanctagttggatgagcgtgggtccgcgaggctccgaggggaggggctggagtgggcgaccaaacgaataaagggaagagtaggaacgtcaaagaaacactagtggtggacttcgtggtagaacggggcctagttccaaccgattccacccgaaggaacgacccaaacgccaaagtacttcgagtnattcaagacaaatcgaactagccctaggacgacgcggagaccctacgggcctagttagttccnggttgagtacgacgtcaaagtcggacctaaagggtcgaaaggtaacccggaggggttataag

SEQ ID NO: 370205 - DNA, 726 bp, Homo sapiens
  misc_feature: GZ8MTXP02JPG4P.15.23.C01.1.454.CMB.2.raw
  modified_base (302)..(302): a, c, t, g, unknown or other
  modified_base (639)..(639): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgttgggttttccttgttgtcttattttagaaggtgtccagtgcgaggagcagcgtggtggagtcggtgggggacggccgtggtccgacgggcccggggggtccctgacgtactcctccgtgtcgccgcctctggacctctacctttagngtcttattggatgagtcgtcgggtcccgccagggcctaccggaagggggaaggggcgtaggggaggttggggtaccggaaccaaacgaaagtaaaagggaagtagtagggaaacgtacgaaacgaaaactacgttagtagggtcggtaacttcgtagggtagggtaaaccggggtccctattcccaaccctagtccctaccgagaaccgtaaccaaacgtacccaaagttaacttcgagttcgtatccgtagaaccaaattcgaaacctacggacctagggaaccgacggacccggtaacgggaccggaccggtaccgggtttattacgtttaccgnggtaggtacggaagaacgtacgtagtaaccggaacggttaaaccgggttaggaaccgggttaaccggggtagggggttgttaacggg

SEQ ID NO: 370206 - DNA, 584 bp, Homo sapiens
  misc_feature: GZ8MTXP02HMAMS.15.23.C01.1.454.CMB.2.raw
  modified_base (313)..(313): a, c, t, g, unknown or other
  modified_base (354)..(354): a, c, t, g, unknown or other
  modified_base (581)..(581): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtggagtcgtgggggaggccgtggtccgaggcccggggggtccctggacgactctcctgtcgccgcctctggactcacctttagtagctattggatgagctgggtccncgaggcctccgaggggaagggctgggagtgggtgaccaaanagtaaaaggaagatacggaaatcaagaaaactctaagtgtggactcgtgtagaacggggccattcaccatctaccaagagaacacgaccaaagtaacttcagtagtatcgtagaactaaaatcgaaacacgcctagaggacgacgaacggtacgacggtacgtgtaacttacgtgtagtagagacgacagtaagaacgaacggtcgaaagtaaccggaggggtttanagg

SEQ ID NO: 370207 - DNA, 664 bp, Homo sapiens
  misc_feature: GZ8MTXP02JCDNT.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggcccgggggggtccctgagactctcctgtgccgcctctggacctctacctttagtagctattggatgagcgtggtccgcaggctccgaggggaaggggctgggagtggggtgaccaaacgataaaggaagagtaggaagtcaagaaaactactagtgtcggtactcgtggtacggaaaggggtcccgtattaccgaacctacttaccctacccgaaggaaacgaaccaaaacccggtacccgaaaagtaacgtttaccgaggttagtaactttaccacggaacctaaaagtggaaaccagcccgtaggaacgacggacccggaaggaccgaacgggccgttagttaacgttatcggtgtacggagaacgacgtaagaacgaaacgtaaccggggtagaaacgttaaccggggtagggggtttactaaggg

SEQ ID NO: 370208 - DNA, 600 bp, Homo sapiens
  misc_feature: GZ8MTXP02F7JBX.15.23.C01.1.454.CMB.2.raw
  modified_base (311)..(311): a, c, t, g, unknown or other
  modified_base (340)..(340): a, c, t, g, unknown or other
  modified_base (558)..(558): a, c, t, g, unknown or other
  modified_base (591)..(591): a, c, t, g, unknown or other
  modified_base (598)..(598): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtgggtccgagggccgggggggtccctggagactctcctgtcgccgcctctggactcacctttagagctattggatgagctggtccncaggctccgagggagggctggagtggggngaccaaagagtaaaaggaagatggaagtcaagaaaacactatgtggactcgtagtagaacggggccatttccaaccatcctaccaagacgaaccaaacgccaaaagtaacttcaagttgtaaatcctagaaccaaaagtcgaaaacacgaccctaggaacgacggaccggaaggtaaccgaccgggccgttagttacttagtggtagtagagaacganagtaagaacgaacggtacgaacggtaacggggngggttanag

SEQ ID NO: 370209 - DNA, 695 bp, Homo sapiens
  misc_feature: GZ8MTXP02JZZXD.15.23.C01.1.454.CMB.2.raw
  modified_base (310)..(310): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtccctgagactctcctgtcgccgcctcgtggacctcacctttagtagctattggatgagcgtgggtccnccaggctcgaggggaaggggctgggaggtggggtcggaccaaacgaagtaaaagggaagaagtacggggaaagtacgaagaaacactagttggtcgggtactcgtggtaggaacgggtccgtattcaaccctagtccctaccaaggaacgaaacccgaaaccgacccgaaaagtaactttaccgaaggttacgttaattccttaggaacctaaaagtacgaaaacgtcgacccgtaggaacggacggaccccgggaagggaacccgaccgggggtccccgttaggttaaacgtttccgtaggttaggtcggaaaggaacgaccgaagtaacggaaaccgtaaccggggtagaaacggtaaccgggggtaaggggttagtaacggg

SEQ ID NO: 370210 - DNA, 641 bp, Homo sapiens
  misc_feature: GZ8MTXP02G5NF1.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggcccggggggtccctgagactctcctgtcgcccgcctctggactcacctttagagctattggatgagctcgggtccgccaggcctccgaggggaaggggctgggaggtgggtgccaaacgaagtaaaaggaagataggaagtcaagaaacactaatgtgggactcgtggtagaacggggcccgattcccgaaaccatccctacccgaagaacgaaccaaacggacccaaaagaacttcagtagtaactcgtagactaaaagtgaaaccaggcctaggacgacggacccgaagggtaaccgaccgggtccgttagtaacgttacgtggttaggacgaaggtaacgacctaagtaacggaaacgaaccggggtagaaacggttaaaccgggggtaggggtttacgaagg

SEQ ID NO: 370211 - DNA, 617 bp, Homo sapiens
  misc_feature: GZ8MTXP02GTHR1.15.23.C01.1.454.CMB.2.raw
  modified_base (457)..(457): a, c, t, g, unknown or other
  modified_base (497)..(497): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggaggttgggctgagcgttgggttttccttgttgcttattttagaaggtgtccagtgcgaggagcagcgtggtggagtcggtgggggacggccgtggtccgacgggccggggggtccctggagactccgtccgtgtcgcccgtcctcgtggactctacctttagtagctagttggatgagctgggtcccgccagggcctaccggaaggggaacggggcgtgggaggtgggtcggaccaaacgaagtaaaaggaagagtaggaagtacaagaaacactagtgtggacctgtgagaacgggcctagtcaccatccacaaganaacacgacaagtaatcagtgtatcagactaaagtgaaacngaccgtagaacgacggaccggaaggtaccgacgggtccgtaggttacttacgtggttacgaagagtacgaacgtagaacgaacgtacgggtagaacggtaacggggtgggttacgtaagg

SEQ ID NO: 370212 - DNA, 607 bp, Homo sapiens
  misc_feature: GZ8MTXP02FURAH.15.23.C01.1.454.CMB.2.raw
  modified_base (314)..(314): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtgggtggagtcgtggggggaggcctgggtccagggcccgggggggtccctggagactctcctgtcgcccgcctctggctcacctttagtagctatggatgagctgggtccncaggctccgagggaaggggctggaggtgggtggccaacgaataaaggaagagtaggaagtcaagaaaacactaatggtggactcgtagtaggaacggggcgatttcacccatcctccaagagaacaacgccaaaagattcagtgtatctagacaaatcgaaacagcccgtagaacggacgaccggaggaacgaccggggaccgtaggttacttacgttggtagttacggaaagacggaacataaggaaacgtaacgggtaggaaggttaaaccggggagggggtttagaacgg

SEQ ID NO: 370213 - DNA, 730 bp, Homo sapiens
  misc_feature: GZ8MTXP02GBARB.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggaggcctgggtccgacgggcccggggggtccctgagactctcctgtcgccgcctcgtcggactcacctttagagctattggatgagtcgtgggtcccgcgaggctaccggagggaaggggctgggaggtggggtcggaccaaacaagtaaaaggaagtagtagggaaacgtcaaagaaaaccattaagtggtgggaaccttcgtaggtacgggaaacggggtcccgtaaatttcccaaaccctagttcccctaccgaaaggaacaaacccgaaacgacccgtaaaagtaaactttcgaaaggttcttaacgtactaagaaactaaaagtacgaaaccgacgtaccgtaaggaacggtaacggaacccgggaacggaaccggttaccgggtacgtttaacgttaactttacggtaggttaggaacggtaacgaaacgaacgtaaggtaacgaaaacggtaaaacggggttacggtaaaacgggttaaccgggggtaggggttaacgtaacgg

SEQ ID NO: 370214 - DNA, 731 bp, Homo sapiens
  misc_feature: GZ8MTXP02F7Z2N.15.23.C01.1.454.CMB.2.raw
  modified_base (555)..(555): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgacgggccggggggtccctgagactctcctgtcgcccgcctcgtcggactctaccgtttagagtctagttggatggagcgtgggtcccgccgaggtccgtacccggaagggggaacggggcggtagggagggtcggggtcggacccgaaacgaaagtaaaagggaaagtagtaggaaacgtacgaaaggaaacacgttagtggtcgggaactcgtggtacgggaacggggtccgatttaccaacctattcccaccaaaggacaaaccgaaccggccaaaaggtacttcgagttcgtaaactcgtagacctaaaagtcgaaaacncgaccctagggaaacgaccggaaccgggaaggaaacccggtcggggtacccgtttagttaaacgtttaccgttagggttacggaaacggacgtaacgacggtaaagtcggtaaaaacccgggaaggggttaacgggaaaacgtttaaccggggggtagggggtttactaaacgggg

SEQ ID NO: 370215 - DNA, 704 bp, Homo sapiens
  misc_feature: GZ8MTXP02JL5ON.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctcctgtcgccgcctctggactcaccttagtagctagttggatgagcgtcgggtcccgccgaggcctccgaggggaaggggctgggaggtggggtcggaccaaacgaagtaaaagggaagagtaggaagtacaagaaacactagtggtggaccttcgtggtaggaacggggtccgtattccgaaaccctattccctacccgaaaggaacgaaacccgaaaaccgaccccgaaaagttaaacgtttccgaaagggtttcgttaaactccgttagggaaacctaaaagttacgaaaaccgtaacggtccctagggaacggacgggacccggaacgggtaccgaaaccgggttcccgttaaggttaacttacggttggtaggtacgaagaccggaaacaggtaacgaaacggtaacgggtaggtaaccggttaaacgggggtgggttacgtagg

SEQ ID NO: 370216 - DNA, 766 bp, Homo sapiens
  misc_feature: GZ8MTXP02JX5FU.15.23.C01.1.454.CMB.2.raw
  modified_base (337)..(337): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggaggttgggctgagcgttgggttttcctttgttgcttattttagaaggtgtccagtgcgaggagcagcgtggtggaggttcggtgggggacggccgtgggtccgacgggtcccggggggtccctggacgactcctccgtgtcgcccgtcctcgtggactcctacctttagtagctagttggatggagtcgtgggtcccnccgaggcctccggaaggggaggggctaggggaggtggggtcggaccaaacgaagtaaaaggagacgtagggaaagtcgaaagaaaactacgtagttgggtggtaaccttcgttaggtagggaaacgggggtcccgtaatttacccgaaaccctattaccccgacccgaaagaaccggaaacccgaaaaccgcccaaaaggtaactttcgagttagtaaatccgtaggtaacaaaagttacgaaacccgagacccgttggaaacggaccgacccggggaaacggtacccgtaccgggggcccgtttagtttaacgttaccggtcgggtttaaggacggaaaggaacggtaaacctggttaaaccggaaacgtaaaaccggggtcggtaaaaccgggttaaaacccgggggttggggttaggttaaccggg

SEQ ID NO: 370217 - DNA, 627 bp, Homo sapiens
  misc_feature: GZ8MTXP02F22Z9.15.23.C01.1.454.CMB.2.raw
  modified_base (520)..(520): a, c, t, g, unknown or other
  modified_base (591)..(591): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgctattttagaggtgttcagtgcgaggagcagcgtggtggagtcgtgggggaggcctggtccgagggccggggggtccctggagactctccgtgtcgcccgctctggactcacctttagagctattggatgagcgtggtccgccgaggcctccgaaggggaagggctgggagtggggtgacccaaacgaagtaaaagggaacgagtagggaaacgtcaaagaaacgactaagtgtcggactcgtaggtacgaacggggcctatttacccaacctacgtacctaccgaaaggacgaaaccgaaaccgtacccgaaaaggttaaacttcgaagtgttaaactcgtagaactaaanacgaaacaggcctagagacgcggaaggaccgtacgggccgttgtaacttacgtggtgtacgagacgactangaacgaaggtacgaacgtaacggtagggtacgtaag

SEQ ID NO: 370218 - DNA, 646 bp, Homo sapiens
  misc_feature: GZ8MTXP02HQ71U.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccgaggccggggggtccctgagactctcctgtcgccgcctctggactcaccttagtagctattggatgagcgtgggtccgccagggcctccggaaggggaacggggctggggaggttggggtcgggacccaaaacgaagtaaaaggggaagagtaggggaaagtcgaagaaaaccataagttggtgggaccttgtggtaggaacgggggtcccatttcccaacctatccctaccaaggacgaacgaaaccgaccgaaaagtaaacttcgaagttcgtaattccgtagaacttaaaagaggaaacacgaccgagacggacgaccggagaaccgtacggaccggttagtactttaacgtgtaggtagacgagactagaacgacgtaaacggtgaaggtaaccggggagggtttacgtagg

SEQ ID NO: 370219 - DNA, 598 bp, Homo sapiens
  misc_feature: GZ8MTXP02JQN8K.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtgggtccgagggcccgggggggtccctggagactctcctgtcgccgcctctggactcaccttagtagctattggatgagctgggtccgccaggctccgaggggagggctgggaggtgggtcggaccaaacgaagtaaaaggaagatagggaaagtcaaagaaaacacgtaatggtggaccttgtggtaggaagggccgtattccacctatccaccagacgacaaacgccaaagtaattcagtagtatctagacaaaatcgaaacacgcctaggaaggacgaccgaagggtaccacgggccttagtattacgtgtggtagacgagacagtaacggaacgaacgggtagaaacggtaacggggtaggggtatagg

SEQ ID NO: 370220 - DNA, 573 bp, Homo sapiens
  misc_feature: GZ8MTXP02HCMEC.15.23.C01.1.454.CMB.2.raw
  modified_base (307)..(307): a, c, t, g, unknown or other
  modified_base (392)..(392): a, c, t, g, unknown or other
  modified_base (400)..(400): a, c, t, g, unknown or other
  modified_base (425)..(425): a, c, t, g, unknown or other
  modified_base (444)..(444): a, c, t, g, unknown or other
  modified_base (452)..(452): a, c, t, g, unknown or other
  modified_base (454)..(454): a, c, t, g, unknown or other
  modified_base (457)..(457): a, c, t, g, unknown or other
  modified_base (459)..(459): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggccgggggggtccctggagactctcctgtcgcccgcctctggactcaccttagagctatgatgagctggtccnccgaggctccgaaggggaagggcgtgggagtggggtcgaccaaacgaaagtaaaaggaagagtaggaaacgtcaagaaaacatangtgactgngtagaaggccattcacatcacaganaacacgacaaagatcagtntatcgtananaananacagacgagagacgacgacgacgacgacgtacgtattacgtagtagtagacgaacgaacgaagtaacgaacgaaacggtaacggtaaacggtaacgggtaacgggttacggtag

SEQ ID NO: 370221 - DNA, 618 bp, Homo sapiens
  misc_feature: GZ8MTXP02HTH54.15.23.C01.1.454.CMB.2.raw
  modified_base (268)..(268): a, c, t, g, unknown or other
  modified_base (284)..(284): a, c, t, g, unknown or other
  modified_base (306)..(306): a, c, t, g, unknown or other
  modified_base (352)..(352): a, c, t, g, unknown or other
  modified_base (387)..(387): a, c, t, g, unknown or other
  modified_base (503)..(503): a, c, t, g, unknown or other
  modified_base (541)..(541): a, c, t, g, unknown or other
  modified_base (552)..(552): a, c, t, g, unknown or other
  modified_base (614)..(614): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcgtgggggagcctggtccgaggccggggggtcctgagctctcctgtcgccgcctnggactcaccttagtanctattggatgagctcgggtccnccgaggcctccggaaggggaggggctgggaggtgggtcgaccaaanaagtaaaggaagagtaggaatacgaagaaaacctntaagtgcggtactctggtagaacggggccattccactatcctacgaagacgaaaccaaaccgtccaaagtaaacttcgaagttcgtaaatttccagaaacctaaaattcgaaaacngtaccgaggaagacgcggaaggtaccgacgggtacctntaacgtttacnggttagaccgagaacgatagtaacgaacgaacgggttgaaacgtaaaccgggggtggtttanaagg

SEQ ID NO: 370222 - DNA, 567 bp, Homo sapiens
  misc_feature: GZ8MTXP02JX3G1.15.23.C01.1.454.CMB.2.raw
  modified_base (385)..(385): a, c, t, g, unknown or other
  modified_base (429)..(429): a, c, t, g, unknown or other
  modified_base (437)..(437): a, c, t, g, unknown or other
  modified_base (468)..(468): a, c, t, g, unknown or other
  modified_base (470)..(470): a, c, t, g, unknown or other
  modified_base (473)..(473): a, c, t, g, unknown or other
tcagtctacgtagccacgaccggtgctcgatttagtacacgtgattagggattgggaggtctcagagaggagccttagccctggactcccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccgggggggtccctggagactctcctgtcgcccgcctcgtggactctacctttagtagctattggatgagctgggtccgccaggctccgaggggaggggctgggagtggggtggccaaagagtaaaaggagatggaacgtcaagaaaacnctatggtcggacctgtggtgaagggccgaattcaacccattccnccgaaganaacaacgcctaaagaacttgagtagtatcananaanagacacgacgagagacgacgacggacgacgacgtacgtatagtgtgtagagagagagaagacgaacggacgaacggtaacggtacggtaggtag

SEQ ID NO: 370223 - DNA, 610 bp, Homo sapiens
  misc_feature: GZ8MTXP02JS2PJ.15.23.C01.1.454.CMB.2.raw
  modified_base (297)..(297): a, c, t, g, unknown or other
  modified_base (377)..(377): a, c, t, g, unknown or other
  modified_base (398)..(398): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgacggcccggggggttcccctggacgacctccgtccgtgtcgccgcctctggactctacctttagngctattggatgagctgggtccgccaggctccgaggggaaggggctgggaggtggggtggaccaaacgagtaaaacggganagtaggaaagtcaagaaaacngtaatggtggacctcgtggtacgaaggggcccattccacccatcctaccgagagacaaacgccaaagaattacagtcgtaatcgtagacaaagtacgaacagcctaggacgacgccggaaggaccgacgggcccgtaggtactttacgtgtaggtgaagacgacagtaagaacgaacggtagaaacggtaaccgggtagggggtttacaagg

SEQ ID NO: 370224 - DNA, 611 bp, Homo sapiens
  misc_feature: GZ8MTXP02IRHTP.15.23.C01.1.454.CMB.2.raw
  modified_base (578)..(578): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccaggccgggggtcctgagactctcctgtgccgcctctgactcacctttagtagctatggatgagcgtgggtccgccgaggcctccggaggggaaggggcgtggaggtggggtcggaccaaacgaagtaaaggaaagagtaggaagtcaagaaacatagtgtggtactcgtggtagaacggggcagttccaccatacctccgagacgaacaacgtaccaaagtaactacgagtgtaatcgtgaactaaatacgaacacgacgtagaggacgaccggaggacgacgggccgttagtacgtttacgtgtacggtagtaacgacgtacgaagtaacggacgtaaaacggggtanaacggttaaaccggggtagggggttaactaggg

SEQ ID NO: 370225 - DNA, 636 bp, Homo sapiens
  misc_feature: GZ8MTXP02HPDDR.15.23.C01.1.454.CMB.2.raw
  modified_base (503)..(503): a, c, t, g, unknown or other
  modified_base (570)..(570): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgagggccggggggtccctggacgactctcctgtcgccgcctctggactcacctttagtagcttattggatgagcgtcgggtcccgccaggtcctaccgaaggggaaggggtctggggaggtggggtcggaccaaacgaagtaaaaggaagagtggaaacgtcaagaaaaccatagtgtggaccttgtgtaggaaacggggccatttaccactattccgaccgaagacaaccgtaacgacccgtaaaatacgttcgagtagtaattccgtaanaaactaaagtcgaacgagcgaggacgacggccgtaaggaccgtacgggtacttagttacgtttacgngttggacgaacgaacgactaagaacgaacggtaacggtcgaaaacggtaacggggtgggtttagag

SEQ ID NO: 370226 - DNA, 710 bp, Homo sapiens
  misc_feature: GZ8MTXP02IJHTU.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccgaggccggggggtcctgagactctcctgtcgccgcctcgtggactctacttagagtctatggatgagtcgtcgggtccgccgaggcctaccggaaggggaacggggcgtaggggaggttggggtacggaacccaaacgtaaagtaaaagggaaagtagtacgggaaaagtaccgaaagtaaaacctaacgttacgttggtacggggtaccttacggttaggtaacggggaaccggggtcccgtaaattcccgaaaccgtactacccgttacccgaaggaaccgtaaacccgtaaaccgacccgtaaaaggtaactttaccgaaagttacgttaacttcgtagaaactaaagtcgaaacgacgcgtagaacgagaccggaaggaccgacggtaccgtgtaacgttacgtggttacgaggtacgaacgacgagtaacggaacgtaacggtagtaaacgtaaccgggggtaggttacgtacgg

SEQ ID NO: 370227 - DNA, 664 bp, Homo sapiens
  misc_feature: GZ8MTXP02HOIZ2.15.23.C01.1.454.CMB.2.raw
  modified_base (586)..(586): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctcctgtcgccgcctctggactcacctttagtagctattggatgagcgtgggtccgccgaggcctccggaaggggaaggggctaggggaggtggggtcggaccaaacgaagtaaaagggaagagtggggaaagtcaaggaaaacacgttaatggtcgggacttcgtgggtacggaaacggggtcccgtaaatttccaactttatcccttacccgaaggaacgaaccaaaaccgcccgaaaagaactttcgagttagtatcgtagactaaaatgaaaccagccgtagacgacggaccgaagggaccgacgggtcccgttagttaacgtttacgnggttggtacgaaggacgaacgagtaacggaaccgaaaggggttacgaaacggtttaaccggggagggggtttagacgg

SEQ ID NO: 370228 - DNA, 631 bp, Homo sapiens
  misc_feature: GZ8MTXP02I7QAX.15.23.C01.1.454.CMB.2.raw
  modified_base (376)..(376): a, c, t, g, unknown or other
  modified_base (381)..(381): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccgaggccggggggtccctgagactctcctgtcgccgcctctggactcacctttagagctagttggatgagcgtgggtcccgccaggctccgaggggaggggctgggagtgggtggccaacagtaaaggagataggaagtcaagaaacnctagngtggactcgtgtagaaggggccattccacatctccagagaccaacgaccaaagtaattcgagtgtaatccgtagacctaaaatacgaaacagaccctaggaacgacggacccggaaggaaccgaccggggtacccgttagttaacgtttaccgtcggttggttaacggaggtaacgaacgttagtaacggaaaaccgtaacggggtacggtaaaacggtaacccgggggtaagggggtttacgtaagggg

SEQ ID NO: 370229 - DNA, 636 bp, Homo sapiens
  misc_feature: GZ8MTXP02GLR6R.15.23.C01.1.454.CMB.2.raw
  modified_base (285)..(285): a, c, t, g, unknown or other
  modified_base (304)..(304): a, c, t, g, unknown or other
  modified_base (569)..(569): a, c, t, g, unknown or other
tcagtctacgtagccacgaccggtgctcgatttagtacacgtgattagggagttgggaggtctcagagaggagccttagccctggactccaaggcctttccacttggtgatcagcactgagcacagaggactcaccatggagttgggctgagctgggttttcctgtgctattttagaaggtgtccagtgcgaggagcagctggtggagtcgtgggggagcctggtccgaggcccggggggtccctgagactctccgtgtcgccgcctctggactcacctttaganctatggatgagctggtccncaggctccgaggggaagggctgggagtgggtgaccaaacgagtaaaaggaagatagggaaagtcaaagaaaacacgtagtgtgggactcgtggtaggaaacggggccgtaattcccaaacctattccctacccgaaggaacgaaacccgaaaccgacccaaaagtaacttcgaaagttgtaaatccttagaacctaaaagtcgaaacctagacccgtagaacggacggacccggaaggaccgaccggtccgttagtactttacgnggtggtagacgagacagtaagaaaccgaagggttacgaaacggtaaccggggtggggttacgtaagg

SEQ ID NO: 370230 - DNA, 972 bp, Homo sapiens
  misc_feature: GZ8MTXP02GZ7UD.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgcttattttagaaggtgtccagtgcgaggagcagcgtggtggagtcggtgggggacggccgtgggtcccgacgggtcccgggggggtccctggacgacctcctccgtgtcgcccgcctcgtggactctacctttagtagctagttggatgagtcgtcggggtcccgcgagggcctaccggaggggaacggggcgtgggaggtcggggtacggaccgaaacgaaagtaaaaggggaaacgtagttaaggggaaaagtacgaaaacggtaaaaccaacgttaagttagggtacgggtaccttacggttagggtaacggggaaaccgggggtacctaaacttttacccgaaaccctagtttccccctaaacccggaaacgggtaaacggaaaaccccgaaaaccccgggaaccccgtaaaaaagtttaaaccgttttaacccggtaaaggggtttaaccggtttaaactttacccgttaaacggaaaacccgttaaaaagttacccgggaaaaacccgttaccgggaacccccgtttaaggggaaacccggggtaaacccgggtaacccccgggggtaaaccggggaaaaccccggggtaacccccgggggtttaccccggtttttaaaagggtttaaaaccgttttaaaccggggtttgggttaacggggtaaacgggttaaacgggaaaacccggttaagtttaaaaccgggaacggggtaaacccggttaaaaaccggggggtttaaggtaaaaccccgggtttaaaaccgggggggtaagggggttttaccgtttaaacggggg

SEQ ID NO: 370231 - DNA, 617 bp, Homo sapiens
  misc_feature: GZ8MTXP02JWQZB.15.23.C01.1.454.CMB.2.raw
  modified_base (385)..(385): a, c, t, g, unknown or other
  modified_base (563)..(563): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctggagactctcctgtcgccgcctcgtggactcacctttagtagctattggatgagcgtgggtccgcaggcctccgaggggagggctgggaggtggggtgccaaagagtaaaaggagtagaggaagtcaaggaaaacctntaatggtcggactcgtgtaggaacggggccgaattccgaaccctatccgaccaagggacaaccgaaccgaccaaaggtaactttaccgagttgtaaacttcaggactaaaatcggaaaccacgaccgtaggacgacggaccggtaacggaaccgacgggtaccgttagttacgttagnggtagaggacgacagagtaacgaacgacggtacgaacggtacggggaggtgacg

SEQ ID NO: 370232 - DNA, 658 bp, Homo sapiens
  misc_feature: GZ8MTXP02GFPHT.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcgtgggggaggccgtggtccgagggcccggggggtccctggagactctcctgtcgcccgtcctctcggactcaccctttagtagctattggatgagctggtccgcaggctccgaggggaaggggctgggagtggggtcggccgaaacaagtaaaagggaaagagtagggaaagtaccgaaagaaaacacttagtaggtcggactcgttggtaggaacggggccgtattaccaaccattccctaccgaagaacgaacaaaccgaccaaagtaattcagtgtactctagacaaagtagaaacagcccgtagacgacgaccggaggaccgaaccggtccgtagttaacgtttaccgtggttagtaggaacgaacggtaacagtaacggaaccgaaaacggggttacggaaaacggttaaaccgggggtaagggggtttacgtaaaggg

SEQ ID NO: 370233 - DNA, 650 bp, Homo sapiens
  misc_feature: GZ8MTXP02F7IWQ.15.23.C01.1.454.CMB.2.raw
  modified_base (310)..(310): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctgagactctcctgtgccgcctctggactcacctttagagctattggatgagctggggtccccncgaggctcggaggggagggcgtgggaggtgggcggaccaaagaagtaaaaggaagagtacggaagtacaaagaaacacgtagtgggtcgactcgtaggtacggaacggggtaccgtattacccaacctatcccgtaccaaaggaacgaaacccgaaccggaccaaaagttaacttcgaaggttcgttaacgtcgtagaaactaaaagtacggaaaaccacggacctaggaacgacggaccgaaggacccgtacgggcgttagtacttacgtggtgagacgaacgacagtaacgaaacgtaacggggtacgtaaacggtaaccggggtaggggttacgaag

SEQ ID NO: 370234 - DNA, 716 bp, Homo sapiens
  misc_feature: GZ8MTXP02IVST1.15.23.C01.1.454.CMB.2.raw
  modified_base (321)..(321): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggaggccgtggtccgagggccggggggtccctggagactcctcctgtcgcccgcctcgtcggactctacctttagagtctagttggatggagcgtcgggtccnccgagggcctccggaaggggaaggggtcgtggggaggttggggtcgaccaaacgaaagtaaaagggaaagtagtacgggaaacgtacgaaagaaaacctacgttaagttcggtacgggtacttcgtagggtacggaacggggtcccgtaatttacccaacccgtattcccgtacccgaaaggaaccgaaacccaaaccggaccctaaaaggtaactttcgaaagttgtaacttccgtagaaacctaaaagtccgaaacgacgaccgtaggaacggacgacccgggaaggacccgacgggtccgttaggttactttacggtggttagagaacgaacgactaagtaacggaaaacgtaacgggtacgaaacggttaaacgggggtgggttactacgg

SEQ ID NO: 370235 - DNA, 745 bp, Homo sapiens
  misc_feature: GZ8MTXP02I22K3.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctgagactctcctgtcgccgcctctggacctcaccttagtagctattggatgagcgtcgggtccgccaggcctaccggaaggggaacggggcgtaggggaggttggggtcggacccgaaacgaaagtaaaagggaaagaagtagggaaacgtacgaaagaaaaccacttaagtggtggggaaccttcggtaggtaggaaacgggggcccgtaatttacccgaaccctattccctaccgaaggaaacgaaaccgaaacccggacccaaaaggtaaactttaccgaaggttagttaacttaccgttaggaaacctaaaagttacggaaaaccgaaggtaccccgttaagggaaacggacggggacccggaaacggggtacccgacccggggtacccgtttaggttaacgtttaaccggtggttaggttacggaagaacgactaagtaacggaacgtaaacgggtaggaaacggtaaaccgggggtaggggtttagtacggg

SEQ ID NO: 370236 - DNA, 675 bp, Homo sapiens
  misc_feature: GZ8MTXP02JS6QH.15.23.C01.1.454.CMB.2.raw
  modified_base (511)..(511): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggaggcctggtccgaggccgggggggtccctgagactctctgtcgccgcctcgtggactctacctttagtagctagttggatgagctgggtccgccaggctccgaggggaaggggctgggaggtggggtacggccaaacgaagtaaaagggaagtagtacgggaatacaagaaacactagtggtggactcgtggtagaacggggccattccactactccctaccgaaggacgaacccgaacgtaccgaaaagtaactttcgaagttgtaactctagactaaaatcgaaaaccncgtaccgtaggaacggaccggaccggaaaggtacccgacccggggtaccgtttagttacgttcggagggttacgtacggaaacggtacaactaaggtaaccggaaccggttaaaacggggtagtaaaacccgggggttaacgggggttagggtttacgtaacgg

SEQ ID NO: 370237 - DNA, 672 bp, Homo sapiens
  misc_feature: GZ8MTXP02H4GT7.15.23.C01.1.454.CMB.2.raw
  modified_base (630)..(630): a, c, t, g, unknown or other
  modified_base (662)..(662): a, c, t, g, unknown or other
tcagtctacgtagccacgaccggtgctcgattttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctgagacctctccgtgtcgcccgcctcgtggacctctacctttagtagcttagttggagtgacgtcgtcgggtcccgccgagggcctaccggaagggggaacggggcgtaggggtacggtggggtacggaaccaaagtaagtaaaaaggggaagaagtagggaaaacgttacgaaacgaaaactacttaagtagggttcggaccctttagtaggttaggaaacgggtcccgtaatttacccgaaccctagtcccaaccgaaggaacgaccaaacgaccaaaagtaacttacgagtagtatcgtagaactaaaagtcgaacagacctagaggaccgaccggtaggactaccggacgttataacgtttcgagtgtagaagacganagtaacgaacgtaacggtagacgtaacggggnggtttacagg

SEQ ID NO: 370238 - DNA, 620 bp, Homo sapiens
  misc_feature: GZ8MTXP02I0PW2.15.23.C01.1.454.CMB.2.raw
  modified_base (379)..(379): a, c, t, g, unknown or other
  modified_base (420)..(420): a, c, t, g, unknown or other
tcagtctacgtagccacgaccggtgctcgatttagtacacgtgattagggattgggaggtctcagagaggagccttagcccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccaggccgggggggtccctgagactctcctgtgccgcctctggactcacctttagtagctattggatgagctgggtccgccagggctccgaggggaaggggctgggagtggggtgccaaacagtaaaggaaagatggaaagtcagaaaacnctatgtgggactcgtgtagaaggggccagttcaaacccgtntccacgagacaacaacgacaaagtattacgagtgtatcgtagactaaagtcgaaacacgacgtaggacgacggaccggaaggaccgtaccgggtaccggttagtaacgtttaccgtggtacggtaggaaacggaccgtacaagtaacggaacggtaaacggtacggtaaacggttaaccgggggtagggggtttacgtag

SEQ ID NO: 370239 - DNA, 654 bp, Homo sapiens
  misc_feature: GZ8MTXP02JUOXH.15.23.C01.1.454.CMB.2.raw
  modified_base (380)..(380): a, c, t, g, unknown or other
tcagtctacgtagccacgaccggtgctcgatttagtacacgtgattaggggattgggagggtctcagagaggagccttagccctggactccaaggcctttccacttggtgatcagcactgagcacagaggactcaccatggagttggggctgagctgggttttccttgttgctattttagaaggtgtcccagtgcgaggagcagctgtggagtcgtgggggaggcctggtccgaggccggggggtccctgagctctcctgtgccgcctctggctcacctttagtagctagttggatgagctgggtccgccaggctccgagggggaaggggctagggagtggggtaggaccaacaaagtacgggaaagagtaggaagtacncgaaaaacacgttaatggtggtaacttctcgggtagaaacgggccaatttaccaactcttccacgaggaccaaacgaaccgttaaaccgtaaagtaaacttcgaaaggttactactacttacgaaactaagttaacgaaaccgcgttacccgtaggaaggaccggaacccggttaagggaaacccggtccggtacggttttagtaacgttttgaggttaggacaaaggacactagaacgaacgaacggtgaaacggtacggttagggtactagg

SEQ ID NO: 370240 - DNA, 688 bp, Homo sapiens
  misc_feature: GZ8MTXP02JTKEU.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcgtgggggaggccgtggtccgaggccggggggtccctgagactctcctgtcgcccgcctcgtggactctaccttagtagctattggatgagctcgggtccgccaggcctccggaggggaacggggctggggaggtggggtcgaccaaacgaagtaaaaggaagagtagggaaagtacaagaaaacactaagtggtgggaccttcgtggtaggaacgggtcctattccgaaccctagtaccctaccgaaggaacgaaacccgtaaacgacccaaaaggtaacttaccgagttagttaatcgtaggaacaaagtaggaaacacggacctaggaacggacggaccggaaggacccgaccgggtaccgttagttacgttacgtcgggttaggtcggaaggtaacgtacgtaagtaacggaaaccgtaaacggggtacggaaaaccgggtttaaccgggggtagggggtttataacgggg

SEQ ID NO: 370241 - DNA, 753 bp, Homo sapiens
  misc_feature: GZ8MTXP02JSAKM.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctggtttccttgtgctatttagaggtgtccagtgcgaggagcagctggtggagtcgtgggggaggccgtggtccgagggccgggggggtccctggacgactctcctggtcgccgcctcgtggactcctacctttagtacgctagttggatggagtcgtggggtcccgccgaggcctaccggaagggggaacggggccttaggggaggtggggtcggacccaaacgaaagtaaaagggagtaagtaggggaaagtacgaaagaaaacctactagttggtcggtactcgtaggtagggaacggggtccctaatttccaacccattccctaccgaagaacgaaccgaaaccggaccctaaaggtaaacttcgaaggttacgttaaatccggttaaacaaacgtaaagtacggaacgtacgtaccgtaagggaacggaccggaccggggaacggaaccggttacccggggtccgtttaacggtttaacgtttacggtagggttacggtaacggaaccggtaacgtaccgtaagtaacggtaaaacccgggtaaacggggttacggtaaaaccggggttaaccgggggttaggggttaacgtacgg

SEQ ID NO: 370242 - DNA, 637 bp, Homo sapiens
  misc_feature: GZ8MTXP02GNXZX.15.23.C01.1.454.CMB.2.raw
  modified_base (309)..(309): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggaggcctggtccgaggccgggggtccctgagactctcctgtgcccgcctctggactcacctttagagctattggatgagcgtgggtcccnccgaggcctccgaggggaaggggcgtgggaggtggggtcggaccaaacgaagtaaaaggaagagtagggaaagtcaaagaaaactactagtgtggactcgtgtaggaaggggcccgtaattccacctactcctaccgaagacgaaccaaacgaccaaagtaattcagtatactctagacaaaagtcgaaacagacccgtgaacggacggacccggaaggaacccgacggggtacccgttagttaacgttacgtggttaggtacgagtaacgataagtcggaaaccgtaacggggtacgaacggttaaaccggggaggggttagtaggg

SEQ ID NO: 370243 - DNA, 615 bp, Homo sapiens
  misc_feature: GZ8MTXP02GFTTS.15.23.C01.1.454.CMB.2.raw
  modified_base (348)..(348): a, c, t, g, unknown or other
  modified_base (376)..(376): a, c, t, g, unknown or other
  modified_base (485)..(485): a, c, t, g, unknown or other
  modified_base (493)..(493): a, c, t, g, unknown or other
  modified_base (611)..(611): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgctattttagaaggtgtccagtgcgaggagcagctggtggagtcgtgggggaggcctggtccgagggcccggggggtccctggagactctcctgtcgcccgcctctggctcacctttagtagctattggatgagcgtggtccgccaggcctccgaggggaggggctggagtgggtgccaanaagtaaaggagatggaagtcagaaaacnctaatgtggactcgtggtagaacggggccgattacgaccctattcacccgaagagaacccaaacggacccaaaagaactttcgagtcgttaaactctagaaccttaaancgaaaacncgacctaggacggacgacccggaggaccgtaccgggtcgtacgttaattacgtgttaggacgacgaagaccagtaaggaaacccgtagggttagaacgtaacggggtacggggtttanaagg

SEQ ID NO: 370244 - DNA, 549 bp, Homo sapiens
  misc_feature: GZ8MTXP02FSOUN.15.23.C01.1.454.CMB.2.raw
  modified_base (415)..(415): a, c, t, g, unknown or other
  modified_base (497)..(497): a, c, t, g, unknown or other
  modified_base (525)..(525): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggcccggggggtccctgagacctctcctgtgcccgcctctggactcacctttagagctattggatgagctggggtcccgcaggctccgaggggaaggggctggagtggggtggccaaacgagtaaaggaagatcggaagtcaagaaacactatgtgactctgtagaagggcaattcaccatccnccagagacaacgccaaagaacttcagtgatcagacaaatgaaacagcctagagacgccgagacacgggccgtagtacttacngtgtagagacgacatgaacaacgggttnacgtaaaccggggagggtttcgag

SEQ ID NO: 370245 - DNA, 702 bp, Homo sapiens
  misc_feature: GZ8MTXP02I6JCN.15.23.C01.1.454.CMB.2.raw
  modified_base (307)..(307): a, c, t, g, unknown or other
  modified_base (458)..(458): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtcctgagactctcctgtcgccgcctctggactctacctttagagctatggatgagcgtcgggccnccgaggcctaccggaggggaacggggctgggaggtggggtcgacccaaacgaagtaaaagggaagtacgtagggaaacgtacgaaagaaaaccgtactagtggtcgggtaccttcggtggtaggaacggggtcccgtaacttcccaaaccnttcccaccaaggacgaaccaaacgcccaaaagtaacttccgagttgtaactcctagaacctaaagtacgaaacgcgtaccctaggaacggacggacccggaaggggaacccgtaccggggtccgtttaaggttaacctttacggtcgggttaggtaggaaccggtaaaacgcgtaaaggtaacggaaaacccggtaaaaggggttcggtaaaacgggtaaaccgggggtgggggtttactaagg

SEQ ID NO: 370246 - DNA, 977 bp, Homo sapiens
  misc_feature: GZ8MTXP02GZKFB.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgttgggttttccttgttgcttattttagaaggtgtccagtgcgaggagcagcgtggtggagtcggtgggggaggccgtggtccgacgggcccggggggtccctggagcctctcctgcgccgcctcgtcggactcctaccgtttagtacgtcttagtttggagtggagtcgtccggggtcccgcccgacgggcccgtaccgggaagggggaacggggtcggtaggggtagggttcggggtaccggaacccgtaaaacgtaaaagggttaaaaagggaaaggttaaggtaacggggaaaacgtaacgaaaacgtaaaactaacgtaagttacgggtacgggtaacctttgggtacgggtaacgggggtaaacccgggggtacccgttaaactttacccgaaaccccttagttaacccccgttaaacccggaaacgggaaaacccgggttaaaaaccccgaaaacccccggggtaaacccaaaaaaccggggttttaaactttaaccccgggtaaacggtttagtttaaacccgtttaccgttaaagggtaaaaccctaaaaaaggttaccggaaaaaccccggtaaacgggttccccggtaaagggaaaaccgggtacccggtaaccccgggggaaacccggtaaaccccggggtaccccggggtacccggtttttaaaacggttaaaaccgggtttggttacggggtttaaaggggaaccgggttaaaacgaaccgtaaaccgttaaggaaaccggtaaaacccgggtagggttaaacgggtaaaacccgggggtttaacgggggtagggttttaccggtaaggg

SEQ ID NO: 370247 - DNA, 699 bp, Homo sapiens
  misc_feature: GZ8MTXP02FPU43.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcttgggttttccttgttgcttattttagaaggtgtccagtgcgaggagcagctggtggagtcgtgggggaggccgtggtccgagggcccggggggtccctggagactcctccgtgtcgcccgcctctggactcacctttagtagctattggatgagcgtgggtcccgccgaggcctccggaggggacgggcgtgggaggtggggtcgaccaaacgaaagtaaaaggaagagtagggaaacgtacgaaagaaaacctacgtaagtgggtaggtaccttcgttgggtacgggaaacggggtcccgtaaatttcccaaaccctattcccgtacccgaaaggaacgaaacccgaaaccggacccaaaagtaactttcgaaagttgtaacttccgtagaacaaaagttgaaaaccgagtacccgtagggaacgacggaccggaaggaaccgacgggtacgttagttacttacgtggtggtacggagtaacgactaagtaacggtaaacgaacgggtacgtaaacggtaaacggggtagggggttacgtaaggg

SEQ ID NO: 370248 - DNA, 566 bp, Homo sapiens
  misc_feature: GZ8MTXP02J1RV3.15.23.C01.1.454.CMB.2.raw
  modified_base (310)..(310): a, c, t, g, unknown or other
  modified_base (355)..(355): a, c, t, g, unknown or other
  modified_base (371)..(371): a, c, t, g, unknown or other
  modified_base (382)..(382): a, c, t, g, unknown or other
  modified_base (424)..(424): a, c, t, g, unknown or other
  modified_base (427)..(427): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtcccaggccgggggggtccctgagactctcctgtgcccgcctctggactctacctttagtagctatggatgagctgggtccnccaggctccgaggggagggctggagtgggtgcaaacataaagganatggaagtcagaaacnctatgtgactntgtgaagggcatcacatctcagagacacgacaagtatcagtntanctgactaaatgaaacacgctaggaagacgccggaaggaccgacgggtcccgttagtaacttacgtggtagtcgaacgtagaacgtagtcgaaacgtaacggggtagaaacggttaaccgggggtaggggtttacgaagg

SEQ ID NO: 370249 - DNA, 671 bp, Homo sapiens
  misc_feature: GZ8MTXP02GLJQZ.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtgggtccgaggccggggggtccctgagactctcctgtcgccgcctctggactctacctttagtagctattggatgagcgtgggtccgccgaggcctccggaggggaaggggcgtggggaggtggggtcggaccaaacgaagtaaaagggaagagtagggaaagtacaaagaaaccactagtggtggactcgtggtaggaacggggccgtattccaaccctattccctaccgaaaggacgaacccaaaccggcccaaaagtaacttcgaaggttgtaattccgtaggaactaaaagtcggaaaactacggccctaggaacggacggacccggtaaggacccgacggggtccgttagttaacgttacgtggtacgtaggaagacgtacgtagtaacggaaaccgtaaggggttacgaaacggtaaccggggtggggtttacgtaacgg

SEQ ID NO: 370250 - DNA, 682 bp, Homo sapiens
  misc_feature: GZ8MTXP02HBYIC.15.23.C01.1.454.CMB.2.raw
  modified_base (326)..(326): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcgtgggggaggcctggtccgagggcccggggggtccctggacgactcctccgtgtcgcccgtcctcgtggacctcctacctttagtatcttagttggatgagtctcgggtccnccgaggctaccggaggggaagggctgggaggtggggtcggaccaaagaaagtaaaggaagagtaggaaagtccgaaagaaaaccacgttatcggtggaccttagtggtaggaacggggtcccgtatttacccgaacctatccctaccgaaaggaccgaaacccgaaaccgaccctaaaaggtaacttccgaagttggtaactccgtaggaactaaaagtggaaaacacgtccaggaacgacggcccgaaggtaccgaccggtcgttagtacttacgcggtagtaggaagagtaaccgagttaaggaacccgtaaagggtacggtaaacgtaaccgggggttagggggtttacaggg

SEQ ID NO: 370251 - DNA, 613 bp, Homo sapiens
  misc_feature: GZ8MTXP02GA7I5.15.23.C01.1.454.CMB.2.raw
  modified_base (343)..(343): a, c, t, g, unknown or other
  modified_base (348)..(348): a, c, t, g, unknown or other
  modified_base (366)..(366): a, c, t, g, unknown or other
  modified_base (379)..(379): a, c, t, g, unknown or other
  modified_base (385)..(385): a, c, t, g, unknown or other
  modified_base (399)..(399): a, c, t, g, unknown or other
  modified_base (407)..(407): a, c, t, g, unknown or other
  modified_base (418)..(418): a, c, t, g, unknown or other
  modified_base (422)..(422): a, c, t, g, unknown or other
  modified_base (426)..(426): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggcccgggggggtccctgagacctctcctgtcgcccgcctcgtggactctacctttagtagctattggatgagctgggtccgcaggctccgagggagggctggagtgggngcaanagaaaggagataggaatnaagaactacatgngactgngtgaggcatcaacntcacaganacacgacaaanactnagtntatcgagaacaaatacgaaacgcgtacgaggaacgacggaccggaagggaaccgtaccgggtccgttaagtaacgtttacggtaggttaggtacggtaagaacgtaacgtaaggtaacggaaaaccgtaaaacgggggttacggtaaaaccgggttaaaaccggggggttagggggtttagtaaggg

SEQ ID NO: 370252 - DNA, 607 bp, Homo sapiens
  misc_feature: GZ8MTXP02GEV46.15.23.C01.1.454.CMB.2.raw
  modified_base (309)..(309): a, c, t, g, unknown or other
  modified_base (575)..(575): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtggagtcgtgggggaggcctgggtccgaggccggggggtccctgagactctcctgtgccgcctctggctctacctttagtagctattggatgagctgggtccncaggctccgaggggaaggggctgggagtggggtggaccaaacgaagtaaaaggaaagagtagggaaagtcaaagaaaacactaatggtggacctcgtgtacggaaaggggtccctaatttccaccctatcccgtacccgaaggaacaacctaacgacctaaaaggtattacgagttagtaactccgtagaacctaaaatacgaacgaacgaccgtacgagacggaccggacggacgacggcgtacgtacgtatgtgtagagacganatgacgaacggtagagtacggtagggtagtag

SEQ ID NO: 370253 - DNA, 638 bp, Homo sapiens
  misc_feature: GZ8MTXP02JY9ZO.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggaggcctgggtccgaggcccgggggggtccctgagactctcctgtcgccgcctctggactcacctttagtagctattggatgagcgtgggtccgccaggctccgaggggaaggggctgggaggtggggtggccaaacgagtaaaggaagatacggaagtcaagaaaacactatgtgggacttcgtgtagaaggggccgattccgacccattcctacccaagacgaacaaaccggaccaaaggtaacttcaagttgtattctagacaaagtacgaaacagaccctaggacgacggacccggagggaaccgaccgggtccgttagtaacgtttaccgtggttaggtgaaagacgaaccgtaagtcggaaaccgtaacggggtacggtaaacggtaacccgggggtagggggtttataaggg

SEQ ID NO: 370254 - DNA, 728 bp, Homo sapiens
  misc_feature: GZ8MTXP02JQS8K.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccgaggccggggggtccctgagactctcctgtcgccgcctctggactcacctttagtagctagttggatgagcgtgggtccgccagggctccgaaggggaacggggctgggaggtggggtggccaaacaagtaaaaggagtagtagggaagtacaaggaaacctactaatggtacgggacttgtaggtggaacgggggcctaattccaaacccgtatacccttacccgaaggacgaacccgaaaccggacccaaaaggtaaactttcaaggttcgttaaatccgtagaccgtaaaaagttcggaaaacacgtacccgtggaaacggtaccggacccggaaaggggacccgtaaaacccgggggtccgttacggggtttaaaatttacccgtacggggttcggttacggaagggtaacccgacgaaagttaaccggaaacccgtaaaacggggtttacggaaaaccggttaacccgggggtaagggggtttacttaacgggg

SEQ ID NO: 370255 - DNA, 652 bp, Homo sapiens
  misc_feature: GZ8MTXP02FNI3E.15.23.C01.1.454.CMB.2.raw
  modified_base (310)..(310): a, c, t, g, unknown or other
  modified_base (517)..(517): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgcttattttagaaggtgtccagtgcgaggagcagcgtggtggagtcgtgggggagccgtggtccgaggcccggggggtccctgagactctcctgtcgcccgcctcgtggactcacctttagagctagtggatgagctggtccncaggctccgaggggagggctgggagtggggtcgacccaaagaagtaaaaggaagagtagggaaagtacaaagaaaacacgtagtggtcgggaaccttgtgggtaggaacggggaccctaagtttacccaaacccaattccctacccgaaagaacgaacccaaacggacccaaaagtaaactttcaaagttcgtaactaccccgaaanaaacgtaacgaacgacgaccgtacgaaggacgaccggaacggaccgacgtcgtagttacttacgtgtacgtaggaagacgacagtaacgaacggtaaacggtaacggaacggtaacgggtaacggggttgaggtg

SEQ ID NO: 370256 - DNA, 685 bp, Homo sapiens
  misc_feature: GZ8MTXP02GRFNX.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggaggcctggtccgagggcccggggggtccctgacgactctcctgtcgcccgcctcgtggacctctacccttttagtagctagttggatgagtcgtggtcccgcgaggcctccgaggggaaggggctgggagtggggtggaccaaacgagtaaaaggagagtaggaagtcaagaaacactagtggtcgactcgtggtagaacggggtcccatttaccgaaccctatccctaccgaaggacgaaacccaaaccgacccgaaaggttaaacttaccgtaagttgttaaacttcgttaacaacgtaaaacgttacgaaaaccgtacgacccgtaggaacgggacggtaacccggaacgggaaccgaccgggtcccggttagttaacgtttacgtggttagtaggaaccgagtacgtaagtaacgaacgaacgggtagaacgggtaaaccggggtagggggttactaggg

SEQ ID NO: 370257 - DNA, 789 bp, Homo sapiens
  misc_feature: GZ8MTXP02JRAG4.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggaggccgtgggtccgagggcccggggggtccctggacgactctcctgtcgcccgcctcgtcggactctaccttagtacgctagttggatgagtcgtcgggtccccgccgaggcctccggaaggggaacggggtctaggggaggtcggggtcggaccaaacgaaagtaaaagggaaagagtacgggaaacgtacaaagaaaaccacgtaagttgggtacgggtaccttcgttggtaacgggaaacgggggtcccgtaactttaccccaaacctactttacccgtaacccgaaggaaaccgtaaacccgaaaaccggaaccccgaaaaggttaaactttaccgaaacgtttagtaacttacccgttagaaacctaaaagtacggaaaacaccggttaccgaggaacggaaccggacccgggaaacgggtaaccgtaacccggggtcccgtttaagggttaaactttccgggtagggttacgacggaaacgtaacggaacctaaggtaaccggtaaacgaaaccggggttagggtaaaacggtaaaccgggggtttagggggtacttaagggg

SEQ ID NO: 370258 - DNA, 640 bp, Homo sapiens
  misc_feature: GZ8MTXP02HT34L.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccgaggccggggggtccctgagactctcctgtcgccgcctctcggactcaccttagtagctattggatgagtctgggtcccgccaggctccgaggggaaggggctgggagtggggtggccaaacgaagtaaaaggagagtagggaaagtcaagaaaacactagtggtgggaacttctaggtaggaaagggggcccaattccaactatcctaccagacgaacaacgacccaaagaacttcgagtatatctgaactaaaagtcgaaacacgtcccgtagaacggaacggacccggaaagggtaacccgaaccgggtcgttacgggtaacttttacgtggtaggtacggaagacgaacaagttaacgaaacgtaaacgggttgaaaacggtaaaaccggggtaggggttagtaagg

SEQ ID NO: 370259 - DNA, 560 bp, Homo sapiens
  misc_feature: GZ8MTXP02FWR7W.15.23.C01.1.454.CMB.2.raw
  modified_base (343)..(343): a, c, t, g, unknown or other
  modified_base (416)..(416): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccgaggccggggggtccctgagactctcctgtcgccgctctggctcacctttagtagctattggatgagcgtggtccgccaggctccgagggagggctggagtggggtcggccaanaagtaaaggaagagtaggaagtcaagaaaactctaagtgtggactcgtgtagaagggcattcacatcacaganacacgcaaagatcagtgatctagacaaatcgaacagccgtagagacgtaccgaggacgtacggcgtagtactactggtagtgaggtacgacaagtaacggacgaaacgggtagaacggtaaaccggggtaggggttacgtaagg

SEQ ID NO: 370260 - DNA, 683 bp, Homo sapiens
  misc_feature: GZ8MTXP02JS876.15.23.C01.1.454.CMB.2.raw
  modified_base (319)..(319): a, c, t, g, unknown or other
  modified_base (461)..(461): a, c, t, g, unknown or other
  modified_base (528)..(528): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgtctattttagaaggtgtccagtgcgaggagcagctggtggagtcgtgggggaggccgtgggtcccgagggcccgggggggtccctggacgactcctcctgtcgcccgcctcgtggactcacctttagtgctattggatgagctgggtccnccaggctccgaggggagggctgggagtcggggtggaccaaacgaaagtaaaagggaagtagtaccgggtaaagtaccgaagaaaactacgtagtaggtcggtaacctgtggtaggaacgggggccctatttcccaaaccctntaccctcccaaggaacaaccaaaccggtacccaaagtaactttcagttgtaactcctagaactaaancgaaacagccaggaacgtacgcccggaaggacctaccgggtccgttaggttaactttacgtcgggtagtacgggacgtaaaggaccttaagtccgaaaacggttaaacggggtacgaaaacggtttaaaaccggggggaggggttttcgaaacgg

SEQ ID NO: 370261 - DNA, 655 bp, Homo sapiens
  misc_feature: GZ8MTXP02HSVQT.15.23.C01.1.454.CMB.2.raw
  modified_base (605)..(605): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctggagactctcctgtgccgcctctggactcctacctttagtagctattggatggagcgtgggtccgccgaggcctccgaggggaggggctggggaggtggggtcggaccaaacgagtaaaaggaagagtagggaaagttaccaggaaaacacttaagtggtggggacttcgtaggtaggaaacgggggcctatttccgaaccctatcctacccaaggacaccaaacgccctaaaagtacttcagttgtaactcgttagacctaaaatcgaaaacgacgacccgtagaacggagggaccccgagggtaaaccgcccgggaccggttagttaacgttacgtggttgtacggacgacgaangtaagaacgaaccggttaggaaacggttaaccggggaggggtttagacgg

SEQ ID NO: 370262 - DNA, 761 bp, Homo sapiens
  misc_feature: GZ8MTXP02FKFFZ.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggaggtcggtgggggggacgtccgtcggtccggacgggggtcccgggggtcctggacgtctcctccgtgtccgcccgtcctcgtcgactcctacgtttagactcttagtggatggacgtcggtcgggtccccgacgacgggcccgtaccggggaagggggtacggggtcggtaggggtaggggtcggggtaccgaacccgaaaacgtaaagggtaaaacggaaggtacggtaagggaacgtacgaaaacgtaaactacgtaaggttgggtacgtaccttcggtaggtaacggggaccgggtcctacttacccaacgtacttcccgacgaaagaccgaaacccgaaccgaacgtaaaagttacttacgaggttactacttcgaacgaaactaaagtacgaaacgcgtaccgaggaacggccggaaccgggacggaaccggtacccgggtcgttaagttacgttacggtggtacgaggaacgaacgtacaaggtaacggaaacggtacggggtaacggtaaaacgggttaaaccgggggtgggttagttacgggg

SEQ ID NO: 370263 - DNA, 688 bp, Homo sapiens
  misc_feature: GZ8MTXP02HVNDT.15.23.C01.1.454.CMB.2.raw
  modified_base (272)..(272): a, c, t, g, unknown or other
  modified_base (284)..(284): a, c, t, g, unknown or other
  modified_base (529)..(529): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggcccggggggtccctgacgactctctgtcgccgcctcngactcacttagnctatgatgagtcgtggtccgcaggctccgaggggaggggctgggaggtgggtcggaccaaacgaagtaaaaggaagacgtaggaaagtacaaagaaaactacgttaagtggtgggaacttcgtagggtaggaaacgggggcctaattacccaacctaattccctaccgaagaacgaaacccgaaaccgacctaaaagtaacttcgaaagttacgttataccgtagaactaaaagtacggaaaacncgaccgtaggaggtaacggcccgggaacggaccggaaccgggtcccgttaggtttaaacgtttacggtgttaggagaacggtacgaacgtaaggtaacggaaaaccggtaacggttacgggtaaacggttaaacccgggggtaggggtttaacgtaggg

SEQ ID NO: 370264 - DNA, 634 bp, Homo sapiens
  misc_feature: GZ8MTXP02FP0EK.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgctattttagaaggtgtccagtgcgaggagcagctggtggagtcgtgggggaggccgtggtccgaggcccgggggggtccctggagactctcctgtgcccgcctctggactcacctttagtagctattggatgagcgtgggtcccgccaggcctccgaggggaaggggctgggacggtggggtcggcccgaaaacgaagtaaaaggaaggtaataggggaaagtcaaagaaaacacgttaagtgtgggacctcgtaggtaggaacggggcctaagtttcaaaccgttattccctaccgaaagaggaaccaaaaccggcccaaaagtaacttcaaggttataattcagaccaaatggaaacagcctagagacggacccgaggacacgggtccgtagtacgttactgtagtcggaagagacagtaaggaacaaacggtagaacggtaaaccgggtaggggttagtaagg

SEQ ID NO: 370265 - DNA, 642 bp, Homo sapiens
  misc_feature: GZ8MTXP02IZESH.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccggggggtcctgagactctcctgtgccgcctctggactcacctttagtagctattggatgagcgtcgggtccgccagggtcctccggaaggggaaggggcgtgggaggttggggtcggacccaaacgaagtaaaagggaagaagtaggggaaagtccgaaagaaaacctacttaagtgtcgggtacttcgtggtaggaaacgggggcctatttcccaaccctattcccaccaaaggacgaaaccaaacggcccaaaagtacttaccgaagtgtaatctgaactaaatggaaacacgccgtaggaagacgacccggaggtaaacccgcgggtaccgtagtaactttacgtggttagaggacgagacagtaagaacgaacggtgaaccgtaaacggggtgggttactagg

SEQ ID NO: 370266 - DNA, 703 bp, Homo sapiens
  misc_feature: GZ8MTXP02IWN0Y.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgacgggcccggggggtccctgagactctcctgtcgcccgcctcgtggcctctacctttagtacgtcttagttggatgacgcgtcggggtcccgccgacggcctaccggaagggggaacggggcgtggggaggttggggtcggacccaaagaaagtaaaaggaaagagtaggaagtacaaactaaactacttacgtggtggtacttcgtggtacggaacgggccgtattaccgacctattacccaccaaggacaaccgaaccgacaaagtaacttcgagttgtattctagactaaagacgaacaagccgtaggacgaaccggaccggaacggtaaccgtaccgggaccgtttagttaacctttagggttacgtaggtaacggaaacgaggtaaaccctaaggttaaccggaaacggtaaaacggggttacggaaaaccggtttaaaaccggggggtagggttttacggaaagg

SEQ ID NO: 370267 - DNA, 650 bp, Homo sapiens
  misc_feature: GZ8MTXP02JABQS.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgagggcccgggggggtccctggagactctccgtgtcgcccgcctctggactctacctttagtagctagttggatgagcgtgggtccgccaggcctccggaggggaaggggctggggaggtggggtcgacccaaagaagtaaaagggaagagtagggaaagtcgaaagaaaactactagtggtgggacttcgtaggtaggaacggggccgtatttcccaacctagtccctaccgaagaacgaacccaaaccgacccaaaagtaattccaagttgtactctagaactaaagtacgaaacacgaccgtaggaacgacggacccggaggaaccgacggtccgttagtacttacgtggtagtacggaacgagtacagtaacgaaacgtaacgggtagaaacggtacggggtaggggttataagg

SEQ ID NO: 370268 - DNA, 712 bp, Homo sapiens
  misc_feature: GZ8MTXP02JJTJH.15.23.C01.1.454.CMB.2.raw
  modified_base (309)..(309): a, c, t, g, unknown or other
  modified_base (350)..(350): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggaggcctggtccgaggccggggggtcctgagactctcctgtcgccgcctctggactcacctttagtagctattggatgagctgggtccncaggcctccgaggggaagggctgggagtgggtcgaccaaanaagtaaaggaagagtagggaaagtcaaagaaaacactagtgtggacttcgtaggtaggaaggggcccgaatttcccgaacctattacccgtacccgaaggaacgtaaacccgaaaccgacccaaaaggtaaactttccgaaaggttcgttaaacttcccgttaaggaaccctaaaagttacggaaaacctaacggtacccctagggaaacggacgggacccgggaacggtaacccgaccggggtacccgtttaggttaactttaaccgttggttaggtacggaacggaagaaccgaagttaacggaaacgtaaacgggtaggaaacggttaacccgggggtaagggggtttacgttaacggg

SEQ ID NO: 370269 - DNA, 855 bp, Homo sapiens
  misc_feature: GZ8MTXP02J26F6.15.23.C01.1.454.CMB.2.raw
  modified_base (285)..(285): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggaggtcggtgggggaggccgtgggtcccgacgggccggggggtccctggacgacctctcctgtcgcccgcctcgnggacctctacctttagagcttagttggatgagcgtcgggtcccgccgaggcctaccggaggggaacggggccgtaggggaggtggggtcggaccaaacgaaagtaaaaggagaagtagggaaacgtcgaaacgaaaactacgtagttacgggtcgggaaccttcggttacggagggtaacggggacccgtaaacttcccaaaccctactcacccgaagaaaccggaaaccaacccgaacccgtaaaaggtaactttacgagggtttacttacttacgtacggaaactaaagttaacggaaaaccgttaccggtacccgtaggggaaaacgggacccggaaacccccggggaagggggtttaaacccccgaaaacccgggggtccccgtttttaaaacggggttaaactttttaaacgggggtacggggttaaacgggtaaacggaaacgggtaaaacggtaaaccggttaaacggtaaacccggggttaaaaacccggtaaacgggggttaaacgggttaaaaaccgggggtttaaccggggggttaaacgggggtttaacgtaccgggg

SEQ ID NO: 370270 - DNA, 756 bp, Homo sapiens
  misc_feature: GZ8MTXP02JGA62.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctggttttccttgttgctattttagaaggtgtccagtgcgaggagcagctggtggagtcgtgggggaggcctggtccgaggccggggggtccctggacgactctcctgtcgccgcctcgtcggactcctacctttagtacgctagttggatggagtcgtcggggtcccgccgtacgggccctcccggaagggggaaacgggggtccgtggggtaacgggttcggggttcgggaccccgaaaacgtaaaggtaaaagggaaaaggtagtaaccggggaaagttacgaaacggtaaaaacctagtaaagttgggtgggtaacccttggttaggtaggaaacgggggccctattacccaaccctatacccgtacccgaaggaacgaacccgaaaaccggtcccaaaagttaactttccgaaggttagtaaatcccgtaaggaaccctaaaaagtcgaaaacgtacggcctaaggggaacgacggaccggaacgggaacgttaccgggccgtttaagtaactttaccgttgggtacggtagacgaacgacgtaagaacggtaaaccgaacgggtacggaaaccgggtaccggggtaggggttacgacgg

SEQ ID NO: 370271 - DNA, 683 bp, Homo sapiens
  misc_feature: GZ8MTXP02JX5Q9.15.23.C01.1.454.CMB.2.raw
  modified_base (299)..(299): a, c, t, g, unknown or other
  modified_base (320)..(320): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggaggccgtggtccgagggccggggggtccctggacgacctctccgtgtcgcccgcctcgtggacctctacctttagacncttattggatgagcgtggccncgagcctacggaggggacggctgggaggtgggtacggaccaaacgtaaagtaaaagggagtaagtagggaaactacgaaagaaacctataagtggtcggacttcgtaggtaggaacgggtaccctaattcccaaccgtacttcccgaccgaagaacgaaccgaaaccgaaccaaagttacttacgagttactaactcgtaacgacgaaaattacgaaacccgagtcccgaggaacgacggcccgaaaggtaccgtaaacgggccgtttaagttaaccgtagtcgggtaagacggaacgagaacgttagtaacggaaaccgtaacgggtaagaacggtaaaccggggtagggtttacgtaaggg

SEQ ID NO: 370272 - DNA, 695 bp, Homo sapiens
  misc_feature: GZ8MTXP02JS3RE.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggccgggggggtccctggacgactctccgtgtcgcccgcctcgtggacctctacctttagtagctagttggatgaggcgtgggtccgccgagggcctaccggaggggaaggggtcgtaggggacggtggggtacgaccaaacgaagtaaaagggagagtagggaagtcaaggaaacacgtagtggtggacttctaggtggaacggggtcctaacttccaaccctagttcccacccgaaagaccgaaaccgtaccgaccaaaagtaacttcgaagttcgtactcgtagaacaaacgtcgaaaccaggccctaggaaacggcccgaccgggaacggtaccgtacgggtaccgtttaggttaaacgttcgaaaaggtttggaagaccgaacggttaaccaacggttggaaaacccggtagggtacggtaaaacggttaccggggtagggggtttccaaaaacggg

SEQ ID NO: 370273 - DNA, 616 bp, Homo sapiens
  misc_feature: GZ8MTXP02IMR4E.15.23.C01.1.454.CMB.2.raw
  modified_base (304)..(304): a, c, t, g, unknown or other
  modified_base (479)..(479): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagtgggctgagctgggttttcctgttgtctattttagaaggtgtccagtgcgaggagcagctggtggagtcgtgggggagcctggtccgagggccggggggtcctgagactctcctgtcgccgcctctggactcacctttagagctattggatgagcgtggtccncaggcctccgaggggaaggggctgggaggtcggggtggacccaaacgaaagtaaaaggggaaagagttaggggaaaagtcaaaggtaaaacacttagtgtcggggaacttcgtggtagaacgggggcctattacaccagtcctacaggacaacaacgaccaaagtaattcagttnatcctagactaaagtacgaacagccgtaggaacgacgacccggaaggtaccgacggacccgttagtaacttccgtgtagtgaacgtaacactagaacgaacgtaacggtacggaacggtacggggtagggttacacg

SEQ ID NO: 370274 - DNA, 713 bp, Homo sapiens
  misc_feature: GZ8MTXP02JGTXK.15.23.C01.1.454.CMB.2.raw
  modified_base (514)..(514): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcttgggttttccttgttgcttattttagaaggtgtccagtgcgaggagcagcgtggtggagtcggtgggggagccgtggtccgagggccggggggtcctggagctctccgtgtcgccgcctcgtggacctctaccttagagctagttggatgagtcgtcgggtcccgccagggcctccggaagggggaacgggcgtgggaggtggggtcggacccaaagaaagtaaaagggaagtagtaacgggaaagtacgaaagaaaactacttagtagtcgggacttcggtaggtaggaaacgggcctaagttccaaacctattccgaccaagacgaaccaaacgccaaaagtacttacgagtacgttancgtagaacgtaaatcggaaaccagacccgttaggaaacgaccggtaacccgaaagggtaccccgaaccggggttcccgttaaggtttaaactttcgggtggtacggtaaacggtaaggaaaccgtactaaaggtaacggaaaacccgaacgggggtttaaagaaccggggttaaaaccgggggtgggggtttacaaggg

SEQ ID NO: 370275 - DNA, 692 bp, Homo sapiens
  misc_feature: GZ8MTXP02FLJVZ.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggaggccgtggtccgagggcccggggggtccctgacgactctcctgtcgccgcctcgtggactctacctttagagctagttggatgagcgtggtccgccgaggcctccggaggggacggggctgggaggtgggtcggaccaaagtaaagtaaaaggaagagtagggaaagtcaaaggaaaacctacgtagtggtggacttcggtaggtacggaaacggggtccgtaaattcccaaacctattcccctaccgaaggaacgaaaccctaaaccgacccgaaaagtaactttcgaaagttacgttaaacttccgtagaacctaaaagtaccgaaacgtacgacccgtaggaacgacggtacccggaaaggtaccgaccgggtcccgttagtaactttacggtggttagaggaacgtacgactaagttcggaaaacgtacgggtaggaaccggtaacgggggtaggggttacgtaagg

SEQ ID NO: 370276 - DNA, 772 bp, Homo sapiens
  misc_feature: GZ8MTXP02I3D8Q.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgttgggttttccttgttgcttattttagaaggtgtccagtgcgaggagcagcgtggtgggagtcggtgggggacggtccgtgggtcccgacggggccggggggtccctggacgctcctcctggtcgcccgcctcgtggacctctacctttagagtcttagttggatggagcgtcgggtcccgccgaggcctccggaagggggaacggggcgtggggaggttgggggtcgaacccaaagtaaagtaaaaaggggaaagaaggtacggaaaacggtaacgaaagaaaaacctacgttaagtcggtggtaaccttgtagggtaggaaacgggggtccctaaatttacccgaaccctatttcccgaaccaagggaaaccgaacgaaaccgaacccgtaaaagaaaacgtttcgaaaggtttagttaaacgttaccgtaacgaaaactaaaacgtacggaaaacgtacggtacccgtaagggaacggaaccggaaccgggaacggtaaccggccggggtaccgttaacgttacgttacgtgggtagtaacggacgaaagtactaaggaacggaaacgtaacgggtacgtaaaccgggtttaacgggggagggtttacgtaacgg

SEQ ID NO: 370277 - DNA, 673 bp, Homo sapiens
  misc_feature: GZ8MTXP02GZBCU.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgacgggcccggggggtccctgagctctcctgtcgccgcctcgtggactctacctttagtagtctagttggatggagtcgtcggggtccgccgagggtcctaccggaagggggaacggggcgtggggaggtggggtacggaccaaacgaagtaaaagggaagagtagggaaagtacgaaagaaaactactagtggtggtaccttcgtaggtacgggaacggggtaccgtagttacccaaactatccctacgaagacgaacccaaacgacccaaaagtaacttcgaagttcgtaactccgtagaacttaaaagtcgaaaccgtacgacccgtaggaacgaccggaccggtaaggacccgacggtccgtagttacttacgtgggtagacggagactactagaacgaacgtaagggtacgaaacggttacggggaagggtttgtag

SEQ ID NO: 370278 - DNA, 712 bp, Homo sapiens
  misc_feature: GZ8MTXP02IRJTM.15.23.C01.1.454.CMB.2.raw
  modified_base (255)..(255): a, c, t, g, unknown or other
  modified_base (262)..(262): a, c, t, g, unknown or other
  modified_base (279)..(279): a, c, t, g, unknown or other
  modified_base (287)..(287): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggttttcctgttagctattttagaaggtgtccagtgcgaggagcagctggtggagtctgggggagcctggtccagccgggggggtcctgagctctctgtnccgcctntggactcaccttagtanctagtgangagcgtcggccgcgacgcacggaggggaggtcgtggaggtgggtacggacgaaacgaaagtaaaggaaagaagtacggaagtacgaagaaacaacgtagtagtcgtacgtacgtaggtaggtaacgggacgtactacctacctacgtaccgtaccgaacgaacgaaccgaaaccgaaccgtaaacgtaaacgttaacgtacgttacgttaacgttaccgtaacgtaacgtaaacgtaacgtaaacgtaacgtaaccgtaacggaacggaacggaccgggaaccggtaaccggaaccgggtaccggttacggttaacgtttacgttacggttaggttacggtaacggtaacgaacgtaacgtaacggtaaacggtaaacggtaacggtaaaccgggtaaaccggggtaacggggttacgggtacgg

SEQ ID NO: 370279 - DNA, 693 bp, Homo sapiens
  misc_feature: GZ8MTXP02JJ6W9.15.23.C01.1.454.CMB.2.raw
  modified_base (312)..(312): a, c, t, g, unknown or other
  modified_base (315)..(315): a, c, t, g, unknown or other
  modified_base (391)..(391): a, c, t, g, unknown or other
  modified_base (579)..(579): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggagccgtggtccgaggccggggggtcctgagactcgtcctgtcgccgctctggactctacctttagacgtctagttggatgagctcgggtccncgnggctccgaggggaaggggctgggaggtggggtcggaccaaacgagtaaaggaaagcgtaggaagtacaagaaaacncgtaatgtcgggactcgtaggtagaacggggtacctacgttaccgaaccctagtaccctacccgaaggacgaaacccgaaaccgaccgaaaagtaacgtttaccaagggtttataaacgttcgttaggaaacctaaagttaccgaaacgtacgtacccgtaggaacgacgggaaccgtacgggaaccncgggaaccggtttagtacctttacggtggtcggttagaacgacgtacgagttaacggaaaccgtaaacggggttacgggaacgttaaaaccgggggtacggggtttagttacgg

SEQ ID NO: 370280 - DNA, 809 bp, Homo sapiens
  misc_feature: GZ8MTXP02JI8CZ.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccagggccggggggtccctgagactctcctgtcgccgcctctggacctcctacctttagtagctagttggatggacgcgtcggggtccccgccgagggtcccgtaccggaaggggaaggggctaggggaggttcggggtcggacccaaacgaaagtaaaaggggaagtaagtacggggaaaagtaccgaaaggaaaaacctacgttaagttagggtcggggtaaccttcgttaggggtacgggaaagggggtacccccgtaatttaccccgaaaccctaacttcccgtacccgaaggaaccggaaacccgaaacccggaacccgtaaaaggtaaacgtttaccgaaggttacggttaaattcccgttaacggaaacctaaaagttacggaaaaccgtacggtacccctagggaaacgaccggacccggaagggaacccgacccggggacccgttagttaactttaccgggtaggttaggtaggtaacggaacggtaaccgtaaagtaaccggtaaaaccggtaaaaccggggttaggaaaccggggttaaaccgggggttaagggggtttagtaaacggg

SEQ ID NO: 370281 - DNA, 584 bp, Homo sapiens
  misc_feature: GZ8MTXP02IKE5L.15.23.C01.1.454.CMB.2.raw
  modified_base (423)..(423): a, c, t, g, unknown or other
  modified_base (428)..(428): a, c, t, g, unknown or other
  modified_base (434)..(434): a, c, t, g, unknown or other
  modified_base (512)..(512): a, c, t, g, unknown or other
  modified_base (520)..(520): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgagggcccgggggggtccctggacgactctcctgtcgcccgcctctggactcacctttagtagctatggatgagcgtggtccgcaggctccgaggggaggggctggaggtgggtcggaccaaacagtaaaaggaagagtggaaagtcaagaaacactatgtggactcgtaggtgaagggcgattcaccatcncaganaacacnccaaagacttcagtgtatcagacaaatgaacacgcctagagacgaccgaggaacgacggccgttaggtactttaacgnggttacgngtacgaagcctaagtcggaaaccgaacgggtagaaccgtaaacgggggtagggtttaggaacgg

SEQ ID NO: 370282 - DNA, 562 bp, Homo sapiens
  misc_feature: GZ8MTXP02FYBAX.15.23.C01.1.454.CMB.2.raw
  modified_base (340)..(340): a, c, t, g, unknown or other
  modified_base (384)..(384): a, c, t, g, unknown or other
  modified_base (420)..(420): a, c, t, g, unknown or other
  modified_base (445)..(445): a, c, t, g, unknown or other
  modified_base (479)..(479): a, c, t, g, unknown or other
  modified_base (527)..(527): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctggggggaggcctggtccagccggggggggtccctgagactctcctgtgccgcctctggactcacctttagagctatggatgacgctggtccgccaggctccgaggggaaggggctgggaggtggggnggccaaacgagtaaaaggaagatacggaagtacagaaacactanggtgactctagtgaaaggggccattcaaccattccncagagaccaacgccaaagtaacttnaagttgtaactctagccaaaatagaacgagcccngagagcgacggacgacgacccgtacgtattatagtgtggagagacaanaagacgaacgacgacgtaacggtacgggtaggtag

SEQ ID NO: 370283 - DNA, 618 bp, Homo sapiens
  misc_feature: GZ8MTXP02HTKMN.15.23.C01.1.454.CMB.2.raw
  modified_base (504)..(504): a, c, t, g, unknown or other
  modified_base (557)..(557): a, c, t, g, unknown or other
  modified_base (574)..(574): a, c, t, g, unknown or other
tcagtctacgtagccacgaccggtgctcgatttagtacacgtgattagggattgggaggtctcagagaggagccttagccctggactccaaggcctttccacttggtgtatcagcactgagcacagaggactcaccatggagttggggctgagcgtggttttcctgttgctattttagaaggtgtccagtgcgaggagcagctggtggagtcgtgggggaggcctggtccgaggccggggggtccctgagactctccgtgtcgccgcctcgtggactcacctttagagctattggatgagcgtgggtccgccaggcctccgaggggagggctgggagtggggtgaccaaacaaagtaaaagggaagagtacgggaaatacaagaaaacacgtaatgtggacttctggtagaaacggggtccaattccaaccctatccctaccgaagacgaacaaaccgaccaaagtaattcgagtgtaatccgtagaactaaaatcgaaaacgngtaccgagacggacggaccgaaggacgtacgggacccgttgtactttaccggngtagtacgacgacgaanagtaacgaacgaacggtacgtaaacggtacgggtaggttatagg

SEQ ID NO: 370284 - DNA, 665 bp, Homo sapiens
  misc_feature: GZ8MTXP02F2TT0.15.23.C01.1.454.CMB.2.raw
  modified_base (661)..(661): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcgtgggggaggccgtgggtccgagggcccgggggggtccctggacgactctcctgtcgccgctctggactctacctttagagctagttggatgagcgtcgggtccgccgaggcctaccggaagggggaaggggcgtggggaggtggggtacggacccgaaacgtaaagtaaaagggaaagaagttgggaaaacgtacaaaggaaaacctactagttggtcggacttcgtaggtacgaacgggggcctagttccaaccgtatccctaccgaaggacgaactaaaccgaccaaagtaactcgaaggttctaaactcgtacgaacgtaaaagtcgaaaaccgacgaccctagggaacgaccggacggaacggaccgtaacgggtccgttaagttactagtcggtagagagtacgactagcggaaagaacggtgaacgtacggggagggttntagg

SEQ ID NO: 370285 - DNA, 650 bp, Homo sapiens
  misc_feature: GZ8MTXP02G6EA1.15.23.C01.1.454.CMB.2.raw
  modified_base (292)..(292): a, c, t, g, unknown or other
  modified_base (319)..(319): a, c, t, g, unknown or other
  modified_base (580)..(580): a, c, t, g, unknown or other
  modified_base (613)..(613): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggagccgtggtccgagggccggggggtccctggagactctccgtgtcgcccgcctcgtggactctacctttagngctattggatgagcgtcgggtccgccnggcctcggaaggggaggggctggggaggtggggcgaccaaagaagtaaaaggagtagtaggtaagacaagaaaacgactaagtggtcggacttcgtaggtacggaaggggtccctaagttacccacctattcccgaccaagaacaacaacccggacaaagtaaacttgagttagtaaacttcgtaaacgactaaaagtcgaaaactcgccgtaaagaggaacgcccggaaggtaaccgcggtaccgtagttacgtttacgnggttggaacagaaaccgttagagaaccggtaanacggggttaagacggtaaaacgggggtggtaaagtgg

SEQ ID NO: 370286 - DNA, 705 bp, Homo sapiens
  misc_feature: GZ8MTXP02IIRJ2.15.23.C01.1.454.CMB.2.raw
  modified_base (543)..(543): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccgaggccggggggtcctgagctctctgtcgccgcctctggactcacctttagtagctattggatgagtcgtgggtccgccgaggcctaccgaggggaaggggcgtgggaggtggggtacggaccaaacgaaagtaaaagggaacgagtagggaaagtacgaaagaaaacacttagtgtcgacttcgttaggtacggaaacggggccgtaatttcccgaaccctaatccctacccgaaagacgaaaccctaacgaccaaaaggtaactttccgagttacgtaaacttccgtagaaacctaaaagtacgaaaaccngtcccgtaaggaaccggacggaccggaaggtaacccgaccgggtacccgtttagtaaaccgttttcgaggtttaggtacggaaggaactaacgaaggtaacggaaacgtaaaccggggttaggaaaaccggtttaacccgggggaggggttttacgaacggg

SEQ ID NO: 370287 - DNA, 735 bp, Homo sapiens
  misc_feature: GZ8MTXP02HRY9Z.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggcccggggggggtccctgagactctcctgtgcccgcctctggactctacctttagtagctagttggatgagcgtgggtccgccgaggcctccgaggggaagggcgtgggaggtggggtggaccaaacgaagtaaaaggagagtagggaaagtacaagaaaacactaagttggtcgggacttcgtagtagggaaggggcccgtaatttccacccatccctcccaaggaacgaaccaaacgacccaaaggtaattccgaagttgttatctgaactaaaagtagaaacctagtcccgtaggaacggacggaccccgggaaggggacccgttaaaccggggccccggtttagggtttaaaacttttaccccggttaggttacggggttacgggtaaacggaggtaaaaccccgtagttaaccgggaaaaacccggttaacgggggttacgtaaaaccggggtttaaaacccgggggggtaagggggtttttacggtaaacggggg

SEQ ID NO: 370288 - DNA, 699 bp, Homo sapiens
  misc_feature: GZ8MTXP02HHO0Z.15.23.C01.1.454.CMB.2.raw
  modified_base (406)..(406): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccgaggccggggggtccctgagacctctccgtgtcgccgcctcgtggactctaccttagtagcttattggatgagcgtcgggtccgccgaggcctacgagggggaaggggcgtgggagggtggggtcggaccaaacgaagtaaaagggaagtagtacgggaaagtccgaaggtaaaacncgtaagttggtcgggtaacttcgtaggttacggggaaacggggtacccgtaaagtttcccaaacccttagtacccttacccgaaggaacgtaaacccgaaacccggtaccaaaaggtaattttaccgaagttcggtaaactttcgtacggaataaaacgtcgaaaccgagtacccgagacggaaacgccgggtaacggaccgtaaccgggccgtttaagtacgttaccgttgggtagtgaagtacgacaagtgaaacgtacggtgaaacggtaccggggtagggtttacgagg

SEQ ID NO: 370289 - DNA, 693 bp, Homo sapiens
  misc_feature: GZ8MTXP02F845B.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtgggtccgagggccgggggggtccctggacgactcctcctgtcgccgcctctggactcacctttagagctattggatgagctgggtccgccgaggctccgaggggaacggggctgggaggtggggtcggaccaaacaagtaaaagggaaagtatagggaagtacaagaaaacctactattggtgggaacttcgtaggtaggaaagggggccctaagtttacccaacccattccctacccaagaacggaaaccaaaccgacccaaaaggaaactttaccgaaagtacgttaattccgtaggaacaaaacgtaggaaaaccacggaccccgtaggaacggaacggaaccccggaagggaaccgtaaccggggccccgttaggttaactttaacggtggttaggttacggaagacgaacgtaagtgaaacgaacggttagaaacggtaaccggggtaggggttacgtaagg

SEQ ID NO: 370290 - DNA, 622 bp, Homo sapiens
  misc_feature: GZ8MTXP02GE7O6.15.23.C01.1.454.CMB.2.raw
  modified_base (301)..(301): a, c, t, g, unknown or other
  modified_base (569)..(569): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccaggccggggggtcctgagactctcctgtcgccgctctggactcaccttagagctatggatgagctgggtccncaggctccgaggggaggctgggagtgggtcgaccaaacaagtaaaggaagtagtagggaaagtcaaaggaaaacctacgtaagtgggtcgggacttcgtagggtaggaacggggtccgtagttacccaacgtattcccgaccaaggaccgaaccaaaccggcctaaaggtaacttcgagtagtatccgtagacctaaagtcgaaacagtcccgtaggaacgcgtacgaggacgacggccttagtacttacgtgtagtacgaagacganagtaacgaacccggtaaacgggtgtaaaggtacccgggggtaggtttacgagg

SEQ ID NO: 370291 - DNA, 693 bp, Homo sapiens
  misc_feature: GZ8MTXP02GNBHF.15.23.C01.1.454.CMB.2.raw
  modified_base (306)..(306): a, c, t, g, unknown or other
  modified_base (332)..(332): a, c, t, g, unknown or other
  modified_base (335)..(335): a, c, t, g, unknown or other
  modified_base (615)..(615): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtgggtggagtcggtgggggaggccgtggtccgacgggcccggggggtccctggacgacctcctccgtgtcgcccacctcgtcggactcctacctttagacncttattggatggagtcgtcggtcccncgnggctccggaggggacggggcgtggggaggtggggtcgaccaaacgaaagtaaaaggaagtaggtaggaagtacgaaagaaactacgttagtggtcggtactcggtaggtacgggaacggggacctacttaccgaaccctacgttaccctacgaaaggacgaaacccgaaaccgtaaccaaagttaacttacgagttacgtaatcgtacgaaactaaagtcgaaacgcgtaccgaggaaggccggaccgggaggaccggtacggtcgttacttagttacgnggtttacggagtaggacacgaagtaacggaaacggtacggtacgggtaacggtaacgggggtaggggttactaagggg

SEQ ID NO: 370292 - DNA, 698 bp, Homo sapiens
  misc_feature: GZ8MTXP02FODDX.15.23.C01.1.454.CMB.2.raw
  modified_base (284)..(284): a, c, t, g, unknown or other
  modified_base (309)..(309): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccgaggccggggggtccctgagactctcctgtgccgctctggactcacctttaganctattggatgacgcgtcgggtcccnccgagggcctccggaaggggaacggggcgtgggaggtggggtcggacccaaagaagtaaaagggaagagtacggaaagtaccgaaagaaacactagtggtcggactcgtaggtagaaacggggtccgtattccgaaaccctattcccgacccgaaaggaacgaacccgaaaaccggtacccaaaaaggtaaactttcgaaaggttcgtaaattcctaggtaacaaaattacgaaaacccgtagcccgttaggaacggacggaaccgggaaggaaccgcccggggtaccgttagttaacgtttacgtggtagtaggaagtaacgactaaagtaacggaaaccgaaaacggggttgaaaacggttaaccgggggtaggggtttagtaacgg

SEQ ID NO: 370293 - DNA, 648 bp, Homo sapiens
  misc_feature: GZ8MTXP02I24CG.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtggagtcgtgggggacgccgtggtccgaggcccgggggggtccctgacgactctctgtcgccgcctcgtcggactctaccttagagctagttgatgagcgtcggccgccgacggctaccggaggggagggcgtaggggaggtggggtcgaccaacgaagtaaaaggaaggtagtaggaacgacaaaggaaacctagtagtggtcgtaactcgtaggtaggaaacggtccgtacttcccgaacctacttacccgaccgaagtaacccgaacccgaaaacggtcccctaaaagtaccgttacgtaggttactaacgttcctaaggaaccttaaaagaacgaacgacgaccgaggacggacgaccggacggacgacggaccgtagtacgtagtcgtagagacgaaagacgagaacgacgtacgacgaggtacggtaggtagtagg

SEQ ID NO: 370294 - DNA, 709 bp, Homo sapiens
  misc_feature: GZ8MTXP02JSGZW.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccgggggggtccctgagactctcctgtgccgcctctggactcacctttagtagctattggatggagcgtcgggtccgccaggcctccgaggggaacggggctagggaggtggggtcggaccaaacgaagtaaaaggggaagagtacgggaagtcaaaggaaaaccactatgggtggacctcgtaggtaggaacggggcccgtaatttcccaaaccctattcccgtaccaggacgaaaaaaaaaccgccgaacccgaaaaggtaaactttaccgaagtttagtaaacttccgttaggaacctaaaagttacgaaaacgacggtacccgtaggaaacggacggaccccgggaagggaaccccgaaccgggggtccgttacgttaaacgtttacgtaggttaggttaggaacgaagacctaagtaacgaacgtaaacggggtagaacggtaaaccgggggtagggggttagtaacggg

SEQ ID NO: 370295 - DNA, 708 bp, Homo sapiens
  misc_feature: GZ8MTXP02HR4BD.15.23.C01.1.454.CMB.2.raw
  modified_base (626)..(626): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgctattttagaaggtgtccagtgcgaggagcagctggtggagtcgtgggggaggccgtggtccgaggccggggggtccctggagactctcctgtcgcccgcctcgtcggactcctacctttagtagtctagttggatgacgtcgtcgggtcccgccgacggccgtaccggaagggggaacggggtcgtaggggagggttggggtacggaccaaaacgaaagtaaaaggaagagtaggaaagtacgaaagaaaactacgttagtcggtaggtactcgtaggtacgggtaacggggaccgtacgttacccaaccgtattcccgaccgaagaacgaaccaaccgacctaaaagtacttacgagttacgtacttacgtagaaacctaaagtacgaaacgtacgacccgtaggaacggacggaccggaagggacccgacgggtaccgttagttaacgtttacgnggttaggtagacgtacgaacgagtaacggaaccggtaaagggtacggtaaacggtaaccgggggttaggggttacgtaaggg

SEQ ID NO: 370296 - DNA, 599 bp, Homo sapiens
  misc_feature: GZ8MTXP02IM58C.15.23.C01.1.454.CMB.2.raw
  modified_base (376)..(376): a, c, t, g, unknown or other
tcagtctacgtagccacgaccggtgctcgatttagtacacgtgattagggattgggaggtctcagagaggagccttagcccctggactccaaggcctttccacttggtgatcagcactgagcacagaggactcaccatggagttggggctgagctgggttttccttgttgctattttagaaggtgtccagtgcgaggagcagcgtggtggagtcgtgggggagcctggtccgaggccggggggtccctgagactctcctgtgccgcctctggactcacctttagagctattggatgagctgggtccgccaggctccgaggggaaggggctggagtggggtgccaaacagtaaaggaagatcggaagtcagaaaacnctaatgtggacttcgtgtgaaaggggcccgatttccaccatcctaccagagaccaaacgcccaaagaaacttcagtgtaatctggactaaaatgaaacgacgcctaggacgacggaccgaaggtaccgaacgggtcccgtagttaacttacgtgtggttagaagacgaactagtaagaacgtaaaccgggtagaacggtaaccgggtaagggggtttcgaagg

SEQ ID NO: 370297 - DNA, 688 bp, Homo sapiens
  misc_feature: GZ8MTXP02HSB9J.15.23.C01.1.454.CMB.2.raw
  modified_base (579)..(579): a, c, t, g, unknown or other
  modified_base (625)..(625): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggaggtcgtgggggaggccgtgggtccgagggccggggggtccctggacgactctccgtgtcgccgcctcgtcggacctctacctttagtagctagttggatggagcgtcgggtcccgccgagggcctaccggaggggaaggggcgtgggaggtggggtcggaccaaacgaaagtaaaagggaaagagtagggtaaacgtacgaaacgaaaactacgttaagttgggtcgggtaaccttcgtaggtaacggggaaacggggcccgtaatttcccgaaaccctaatccctaacccgaaaggaacgaaacccaaaaccgaccaaaaggtaacttcgagttagtaactttccgagaactaaaagtacgaaaacgnggacctaggaacgacgaccggagaccgacgggtctagtacttacgnggtgagacgtagacagaacgaaacgagggttacgaaaacgtaccggggtagggtttacgacgg

SEQ ID NO: 370298 - DNA, 624 bp, Homo sapiens
  misc_feature: GZ8MTXP02FRYTM.15.23.C01.1.454.CMB.2.raw
  modified_base (472)..(472): a, c, t, g, unknown or other
  modified_base (558)..(558): a, c, t, g, unknown or other
  modified_base (576)..(576): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctcctgtcgcccgcctctggactctacctttagtagctatggatgagcgtggtcccgccaggcctccgaggggaaggggctgggaggtggggtcgaccaaacgaagtaaaggaagagtaggaagtcaaagaaacactagtgtggactcgtggtaggaacggtccgaattccaaccatccctacaaagacgaaccaaacgccaaaagtacttacgagttntacttcgagactaaaagtcggaaaactcggcctaggaacgacggacccgaagggacctacggggcctaggttaacttctgggttancggaaagtcgaacttagngaaaaccgtagggtacggaaacgtaaccgggggtaggggtttagaagg

SEQ ID NO: 370299 - DNA, 608 bp, Homo sapiens
  misc_feature: GZ8MTXP02IWN3Q.15.23.C01.1.454.CMB.2.raw
  modified_base (565)..(565): a, c, t, g, unknown or other
tcagtctacgtagccacgaccggtgctcgatttagtacacgtgattagggattgggaggtctcagagaggagccttagccctggactccaaggccctttccacttggtgatcagcactgagcacagaggactcaccatggagttggggctgagcgtggttttccttgttgctattttagaaggtgtccagtgcgaggagcagctggtggagtcgtgggggaggccgtgggtccgagggcccgggggggtccctggacgactcctcctgtcgcccgcctctggactctacctttagtagctattggatgagcgtgggtccgccaggctccggaggggaacggggcgtgggaggttggggtggacccaaacgaagtaaaaggaagataggaagtcaagaaaccatatgtggactcgtgtagaacggggccgattccaccgattccaccaagacgaacaaacgtccaaagtacttcgagtcgtatcctagactaaaagtcggaaacacgcctaggaagcgacccggtaggaccgacggccgtagttacttacgtgttaggagacgganacagtcgaaccgaacggtagaacgtaacggggtgggttatagg

SEQ ID NO: 370300 - DNA, 684 bp, Homo sapiens
  misc_feature: GZ8MTXP02FF9IA.15.23.C01.1.454.CMB.2.raw
  modified_base (531)..(531): a, c, t, g, unknown or other
  modified_base (537)..(537): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcgtggtttcttgtgctatttagaggtgtcagtgcgaggagcagctggtggagtcgtgggggagcctggtccaggccgggggggtccctgagactctcctgtcgccgcctctggctctacctttagagctagttggatgacgcgtcggggtccgccgaggcctacccggagggggaacggggtccgttggggaaggttggggacggacccgtaaaacgaagttaaaaagggaaaggagtaagggaaacggttacaaaaggaaaaccacgttaaattgggtacgtaccgttacggtggtaggaaacgggcccgtattacccaaacctattcccgtaccgaagaacgaacccaacgacctaaagaaatttcagttcgttaacncgtaanacaagtaacgaacgacgacgacgacgacggacggacggaccgacggtacgtacgttacgttacgtacgtaggtacggaacgacgaacgtaacgtaacggaacggtaacggtacggtaacggtaacggggtaacggggttaggtacgg

SEQ ID NO: 370301 - DNA, 711 bp, Homo sapiens
  misc_feature: GZ8MTXP02GG910.15.23.C01.1.454.CMB.2.raw
  modified_base (454)..(454): a, c, t, g, unknown or other
  modified_base (662)..(662): a, c, t, g, unknown or other
  modified_base (680)..(680): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggaggttggggctgagctgggttttccttgttgcttattttagaaggtgtccagtgcgaggagcagcgtggtggagtcgtgggggagccgtcggtccgagggccggggggtcctggagtactctcctgtcgccgtctcgtggctcacctttatacgctagtggatgagcgtcgggtccccgacgaggtccgtaccggaagggggaacggggtccgtaggggacggttcggggtcggaacccaaaacgaaagtaaaaaggggaagaacgtaggggaaacgtacgaaaacgaaaaacctgtaaagtcggtaggaccttntagggtacggaaacggggtcctattccaaactaactccctaaccgaagaaccgaaacaaaccgaccgaaaaggtaacttcgaagtacgttaaactcccgagtaaaacctaaaagtccgaaaacgttcgaacccgtggaacgaccggacggtaacggacacggggtacccgtgttaaacgttacgtggtaggtagaacggaacagaagngtaaaacgaacgggttanaaaacggttacggggtaggggttctaaaggg

SEQ ID NO: 370302 - DNA, 733 bp, Homo sapiens
  misc_feature: GZ8MTXP02GPOH6.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtggagtcgtgggggaggccgtggtccgaggccggggggtccctggagactctcctgtcgcccgctctggactcacctttagagtctagttggatgacgcgtgggtcccgccgaggccgtaccgaggggaaggggcgtggggaggtggggtacgaccgaaacgaaagtaaaagggaaaggagtagggaaacgtacaaaaggaaaaccacttaagtgggtggacttcgtgtaggggaaacgggtccgtaattcccgaaacctattaccctaccgaaacggaacgaaacccgaaaaccgaccctaaaaggtaaacttaccgtaagttagttaagttaccttacggaactaaaaagtcgaaaaccgacgacccgtacgggaacgacggacccgggaagggaacccgtaaccggggtcccgttagttaacgttagttcggttagggttacgaacgtacgaaccgtagtaacgtaaccggtaaaaccgggtagtaaaccgggtaaaccgggggttagggggttacttaagggg

SEQ ID NO: 370303 - DNA, 618 bp, Homo sapiens
  misc_feature: GZ8MTXP02GF64C.15.23.C01.1.454.CMB.2.raw
  modified_base (309)..(309): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccgggggggtccctggagactctcctgtgccgcctctggactcacctttagtagctattggatgagctgggtccncaggctccgaggggagggctgggagtgggtgccaaacataaaggagagtggaaagtcaagaaacactatgtggactcgtgtagaacggggccattccgacctatcccaccaagacgaacaacggccaaagtaacttcagtgtatctagactaaaagtcgaaactaggccctaggaaaggacggaacccggaaggaaccgaaccggggtcccgttaggttaactttaccgtgggttagacggagtaaccgagtaacgtggaaacccgaaaggggtgtaaaacggtaaaccgggggtggggtttagaacgg

SEQ ID NO: 370304 - DNA, 723 bp, Homo sapiens
  misc_feature: GZ8MTXP02G2S7L.15.23.C01.1.454.CMB.2.raw
  modified_base (489)..(489): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtcccgaggcccgggggggtaccctggagacttctccgtgtcgcccgccctcgtggacctctacctttagtagctattggatgagcgtcggtccgccgaggcctccggaggggaacggggctgggaggtggggtcggaccaaacgaaagtaaaaggaaagagtaggaaagtaccgaaagaaaccacgttagtacgtcgggaacttcgtaggttacggaaacgggggtccctaatttcccaaacctactccctaccaaggaanaaccgtaacgacccgtaaaagaccctttcgaaaggttgtaaactccgttaggaacctaaaaagttcgaaaaccgtaacgccctagggaaaggacggacccgaaggggaacccgttacgggcccgtttaggtaaaacctttaccggtgtagggttaccgaaagtaccggaataaggtcggaaaaccgtaaacgggttaggaaaccgttaaaaccgggggtcgggttaagtagggg

SEQ ID NO: 370305 - DNA, 651 bp, Homo sapiens
  misc_feature: GZ8MTXP02JJICB.15.23.C01.1.454.CMB.2.raw
  modified_base (415)..(415): a, c, t, g, unknown or other
  modified_base (602)..(602): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggaggccgtgggtccgagggcccgggggggtccctggacgacctcctccgtgtcgcccgcctctggacctctaccctttagtagctatttggatgagcgtgggtccgccaggctaccgaggggaaggggctgggaggtgggtggaccctaaacaagtaaaagggaagatagggaaagtacaaagaaaacacttaagngtgggacctcgtggtaggaagggggcctaaattccgaacccaatccctacccgaagaacgaacgaaacccgaccgaaagtaacttacagttgtaactctagactaaagcgtaaacgagccgtagacgacgaccggagggaaccacgggcccgtaggttacttacggtgtggtacggacgaacgtaanacgtcgaaacgaacggttaggaacgtaacccggggtagggttagtacgg

SEQ ID NO: 370306 - DNA, 797 bp, Homo sapiens
  misc_feature: GZ8MTXP02GA16U.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcttgggttttccttgttgcttattttagaaggtgtccagtgcgaggagcaggcgtggtggagtcggtgggggacggccgtgggtccgacggggcccgggggggttccctggacgctctccgtgtcgcccgtcctcgtggtacctctacctttagacgtctattggatgagtcgtgggtcccgcgaggccgtaccgagggggaacgggcgtgggaggtggggtacgaccaaacgaagtaaaaggaagagtaggaaagtaccgaaagaaactacttagtaggtcggactcggtaggtacggaaacgggccgtaattccaaacccgtactttcccaaccgaaaggaacgaaacccaaaccggaccctaaaaaggtaacctttccgaaagttacgttaaactccgttaaggaaaccctaaaatccggaaaaacgttacggacccgttaagggaaaccggaaccggggacccggttaaaacgggacccggaaacccgggggtttcccttagggtttaaaacccttttaacggtcgggtttaggtaaaccggacgtaaaaggaccctttaaagaacccgggtaaaaccgtaaaaagggggtttacggaaaaccggggtttaaaccgggggtagggggtttaacttaacgggg

SEQ ID NO: 370307 - DNA, 734 bp, Homo sapiens
  misc_feature: GZ8MTXP02I7D5Y.15.23.C01.1.454.CMB.2.raw
  modified_base (318)..(318): a, c, t, g, unknown or other
  modified_base (638)..(638): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcgtgggggagccgtggtccgagggcccggggggtccctggacgactctccgtgtcgcccgcctctcggacctcacctttagtagctattggatgagctgggtccncaggcctaccgaggggagggctgggagtggggtcgacccaaacgaagtaaaaggaaagagtagggaaacgtacgaaaggaaaacctacgttaagttcgggtacggggaaccttcgtaggtagggaaacgggggtcccgtaatttacccaaccgtaagtttcccacccgaaaggaaccgaaacccgaaaaccgccccaaaaaggtaacttttaccgagggttataaacttccgttaggaacctaaaagttcggaaacgtaacgcccgtaggaacggacggaccggaggaaccgtccgggtcccgttaagttacctttacgnggttacgtaggaaaacgtacggactaaagtcgggtaaacctaaacgggggttacgaaaacggtttaaacccgggggaggggttttacgtaacgggg

SEQ ID NO: 370308 - DNA, 656 bp, Homo sapiens
  misc_feature: GZ8MTXP02FJES2.15.23.C01.1.454.CMB.2.raw
  modified_base (314)..(314): a, c, t, g, unknown or other
  modified_base (610)..(610): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgagggccggggggtccctggagactctcctgtcgcccgcctcgtggactcacctttagagctattggatgagcgtgggtcccncaggcctccgaggggaggggctgggaggtggggtgaccaaacgagtaaaaggaagagtaggaaagtcaaagaaaacactaagtggtcgggaccttcgtaggtagggaaacgggggtccctaagtttacccgaaccctattcccccgtacccaaagggaacgaaacccgaaacccgggacccaaaaaggtaactttccgaaagttcgttaaatccgtaggaacctaaaagtcgaaacagccctagacgagcccgaggacctaccgggcttagtacgttacgtggtgtaggagtacgntagtgaaacgaaacggttgaaacggtaaccgggaggggttactagg

SEQ ID NO: 370309 - DNA, 644 bp, Homo sapiens
  misc_feature: GZ8MTXP02GC79K.15.23.C01.1.454.CMB.2.raw
  modified_base (630)..(630): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggccgggggggtccctgagactctcctgtcgccgcctctggactcacctttagagctattggatgagctgggtccgcaggctccgaggggaaggggctggaggtggggtggaccaaacaagtaaaggaagagtaggaagtcaagaaacactatggtggactcgtagtacgaacggggccgtattaccaacccgtattccctacccgaaaggacgaacgaaaccgccaaaaggtaacttcgaagtgtaaactctaggaaccaaaagtggaaacagtcccgtaggacggacggaccggtaaggaccgtaaccggggtccgttaggttatttaaccgtgggttgaggacgtaagacaagtaagaaccgtaaacggggttagaacggttaaaaccgggggnggggttacgtaagg

SEQ ID NO: 370310 - DNA, 704 bp, Homo sapiens
  misc_feature: GZ8MTXP02JUA8D.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctggagactctcctgtcgccgcctcgtggactcaccttagtagctattggatgagcgtgggtccgccgaggcctccgaggggaaggggctgggaggtggggtcggaccgaaacgaagtaaaacgggaagagttacggggaaagtcgaaaggaaaaacctacttaagtggttggggaaccttcgtgggttacggaaaggggtccccgtaaatttccgaaccctaattccctacccgagaacgaaccaaacgacccgaaaagtaacttccgaagtagttaaacttccgtagaacctaaaagtacggaaaccagaccccgtagaacgaacgacccggaaggaccgaacgggcccgttaggttaactttaccgtaggtaggttgaggtacgaaccgagtaacggaaaccgtaaaacggggtacgtaaggtaaaaccccggggtagggggtttacgttaaggg

SEQ ID NO: 370311 - DNA, 832 bp, Homo sapiens
  misc_feature: GZ8MTXP02JC543.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggcccggggggtccctgacgactctcctgtcgcccgccgtctggacctcacctttagtagctattggatgagtctgggtcccgcaggctccggaggggaaggggctggggaggtggggtcgaccgaaacaagtaaaagggaaagagtacgggaaagttcgaaagaaaactacgtaagttggtacggggtaccttacgttgggaacggtaaccgggggtacccttaaacgtttaccccgaaaccctaacgtttccccgtaccccgaaagggaaccggtaaaaccccgaaaacccggttaccccgaaaaagttaaaacgtttacccgaagggtttaacccggttaaacttacccgttaacggggtaaacccttaaaaaagttacggtaaaacccgaacgttaccccggtagggaaaccgggtaacggaccccggaaggggtaaacccccgtaccgggggtacccgtttagggttaaacttttaaaccggcggggttttaggaaccggaagtaaacgggacctaacggttaacgggaaaccccttaaagggggttaccgaaacggggtttaaaacccggggggtaggggttaccggttaacgg

SEQ ID NO: 370312 - DNA, 623 bp, Homo sapiens
  misc_feature: GZ8MTXP02IAUN5.15.23.C01.1.454.CMB.2.raw
  modified_base (310)..(310): a, c, t, g, unknown or other
  modified_base (354)..(354): a, c, t, g, unknown or other
  modified_base (468)..(468): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgctattttagaaggtgtccagtgcgaggagcagctggtggagtcgtgggggaggccgtggtccgaggccggggggtccctgagactctcctgtcgcccgcctctggactctacctttagtagctattggatgagctgggtccnccaggcctccgaggggaagggctagggaggtggggtgacccaanaaagtaaaaggaagagtacggaaagtcaagaaaacactaatggtggactcgtgtagaacgggcgtattcaccatcctacagacaacacgccaaagaattcagtgtaaatcgtanaccgtaaatcgaaacgacgaccgtaggacgacggaccggagggaacccgacggtcccgttaggttacttacgtggttaggtacgaggaaacgactaagtaacggaacgtaaacgggttacgaaaacggtaacccggggtaggggtcggttaaagg

SEQ ID NO: 370313 - DNA, 645 bp, Homo sapiens
  misc_feature: GZ8MTXP02GLFS9.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctggagctgggttttccttgttgctattttagaaggtgtccagtgcgaggagcagctggtggagtcgtgggggaggccgtggtccgaggccgggggggtccctgagactctcctgtgccgcctctggactcacctttagtagctattggatgagctgggtccgccaggctccgaggggaaggggctgggaggtggggtggaccaaacgaagtaaaaggaagagtagggaaagtacgaagaaaacactaatggtcgggtactcgtggtgaaggggccgtattccgacctatccgtaccgaagacgaaccaaccgccaaagtaacttcaaagtgtaatcgtagaactaaatacgaaactaggaccctaggaacggacggaccggaaggaaccggaccgggtacccgtagggttaacttacggttagtcgggtagaaacgacgacaaggtcggaaaccgtaagggtcggaaacggtaaccggggtagggggtttacgaagg

SEQ ID NO: 370314 - DNA, 666 bp, Homo sapiens
  misc_feature: GZ8MTXP02JDNSZ.15.23.C01.1.454.CMB.2.raw
  modified_base (653)..(653): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctgagactctcctgtgccgcctcgtggactcaccttgagctatggatgagctgggtcccgcaggcctccggaggggaacggggctgggaggtggggtcggaccaaacaagtaaaaggaaagagtagggaagtacgaaagaaaactacgtaattagggtcggactcgtggtaggaaacggggcccgtaattacccaaccgtattccgtacccaagaacgaaccaaaccgacccaaaagtaacttcgaagttgtaaagttcctaggaacctaaaagtcgaaaaccaggtacccgtaggaaacggacggacccggaaggaacccgtaccgggcccggtagtttaacgttacgtggtagtaggaacgaacgacacgtgaaaccggtaaacggtcgaacggtaaaccggggnggggtttaatagg

SEQ ID NO: 370315 - DNA, 653 bp, Homo sapiens
  misc_feature: GZ8MTXP02HHK0N.15.23.C01.1.454.CMB.2.raw
  modified_base (294)..(294): a, c, t, g, unknown or other
  modified_base (539)..(539): a, c, t, g, unknown or other
  modified_base (547)..(547): a, c, t, g, unknown or other
  modified_base (598)..(598): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcgtgggggaggccgtggtccgagggccggggggtccctggagactcctccgtgtcgccgcctctggactctacctttagtnctattggatgagcgtcgggtccgccgaggcctaccggaggggaagggcgtggggaggtggggtacggacccaaagaagtaaaagggaagtagtaagggaaagtaccgaaagtaaactacgttagtcggtgggaaccttgtaggtaggaacggggtccgtaattcccaaacgtactaccctacccgaagaacgaaacccaaccgaccaaaaggttacttcgaagttgttaactcgtagaactaaanacgaaacncgtacaggacgacggcgaggttaccgacgggtcttagttaacgttgtggtntacggagacgactagtaacgacgtaagggcgaaacggtaccggggtaggggtatg

SEQ ID NO: 370316 - DNA, 630 bp, Homo sapiens
  misc_feature: GZ8MTXP02IFDDF.15.23.C01.1.454.CMB.2.raw
  modified_base (348)..(348): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctgggtggagtcgtgggggaggcctggtccaggccggggggtccctgagactctcctgtgccgcctctggactcacctttagtagctattggatgagctgggtccgccaggctccgaggggagggctgggagtggggtggaccaaanagtaaaaggagatagggaaatcaagaaaacacgtaatgtcgggactcgtggtaggaaacggggcccgaatttcccactatcctaccaggacgaaccaacgaccaaagaacttcgagttgtaattcgtagactaaaagtcgaaacgtagaccctaggaacgacggaccggaaggaaccgaccggtaccggttagttactttacgtgttaggagacgagtacagttaacggaaacgtaaacgggttagaaacggttaacccgggggtagggggtttacgaacgg

SEQ ID NO: 370317 - DNA, 641 bp, Homo sapiens
  misc_feature: GZ8MTXP02JZTPC.15.23.C01.1.454.CMB.2.raw
  modified_base (293)..(293): a, c, t, g, unknown or other
  modified_base (316)..(316): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggaggccgtgggtccgagggccggggggtccctgagactctcctgtcgcccgcctcgtggactctacctttaganctattggatgagcgtcgggtccnccgaggctccggaggggaaggggctgggaggtgggtcggaccaaacgaagtaaaaggaagagtagggaaagtcaaagaaacactagtgtggactcgtaggtaggaacgggccctattccaacctatccctacgaagacgaacccaaacgacccaaagtaacttcgaagttagtaactcgtagaactaaagtacgaaacgacgtccaggaacggacggacccggaggtaccgaccggggtacccttagtaacgttacgtcgggtacgtacggaagacacagtaagaacccgaaggtacgaacggtaccggggtagggtacgtaagg

SEQ ID NO: 370318 - DNA, 703 bp, Homo sapiens
  misc_feature: GZ8MTXP02HNQXA.15.23.C01.1.454.CMB.2.raw
  modified_base (540)..(540): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagcgtggtggaggtcgtgggggaggccgtgggtccgagggcccggggggtccctgacgacctcctcccgtgtcgccgcctcgtcggacctcctacctttagtagtcttagttggatggagtcgtcggggtccccgccgagggcctaccggaaggggaaggggcgtggggaggtggggtacggaccaaagaaagtaaaagggaaagagtagggaaagtacgaagtaaaactacttaagttggtgggacttacggtggtagggaacggggtcccgtaagtttcccaccgtactcctacccgaaggaacgaacccgaaacgaccaaaagtaacttcgaagttntaactctagaactaaaagtcgaaacacgtcctagggaacgaccggtaccgaagggaccgtaccgggtaccgttagttaaccgtttagtaggtgtaaggaggactaacgagtaacgaaacggtaacggtacggtaaacggtacgggggttaggggttactacgg

SEQ ID NO: 370319 - DNA, 678 bp, Homo sapiens
  misc_feature: GZ8MTXP02HR6ZA.15.23.C01.1.454.CMB.2.raw
  modified_base (530)..(530): a, c, t, g, unknown or other
  modified_base (611)..(611): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctgggtggagtcgtgggggaggcctggtccgaggccggggggtccctggacgactctcccgtgtcgccgcctcgtcggactctaaccttagtagctagttggatgacgtcgtcgggtccgccgaggcctaccggaagggggaaggggcgttagggagggttagggggtacggacccaaagaaagttaaaaaggggaagtaagtaggggaaacgtaccaaaaggaaaacctagttaagtggtcggtaccttcgtaggtacggaaacggggcccgtaattcccacctaatcctacaagacggaacaaacgaccaaaagtaacttccaagtntaaattcaggaactaaaagtcggaaactagaccgttgaacgacgaccggaaagaccaacggggccttaagttaacgtttgnggttacgaacgtagaacgacacgtaagaacgtaacggtacggaacggtaacgggtacgggtaggtag

SEQ ID NO: 370320 - DNA, 625 bp, Homo sapiens
  misc_feature: GZ8MTXP02H3GXM.15.23.C01.1.454.CMB.2.raw
  modified_base (314)..(314): a, c, t, g, unknown or other
  modified_base (442)..(442): a, c, t, g, unknown or other
  modified_base (448)..(448): a, c, t, g, unknown or other
  modified_base (494)..(494): a, c, t, g, unknown or other
tcagtctacgtagccacgaccggtgctcgattttagtacacgtgattagggattgggaggtctcagagaggagcccttagccctggactccaaggccttttccacttggtgatcagcactgagcacagaggactcaccatggagttggggctgagctgggttttccttgttgctattttagaaggtgtccagtgcgaggagcagctggtggagtcgtgggggagcctggtccaggccgggggtccctgagactctccgtgtcgcccgcctcgtggacctctacctttagtagctattggatgagcgtgggtccnccaggctccggaggggagggctgggaggtgggtcgaccaaacaagtaaaaggaagagtaggaaagtacaaagaaacacgttagtggtcggtactcgtgggtagaacggggccgtattcccactatccncaaganacaacgacaaagtacttcgagtgtactctagactaaatacgaaacngtaccgaggaacggacgacccggaaggaccgtaccgggtacccgtttagttaaaccgtttgtaggtagtacgaagacgaacctagaacgaaccgaaagggtacgaaacggtaacggggtagggttagtagg

SEQ ID NO: 370321 - DNA, 598 bp, Homo sapiens
  misc_feature: GZ8MTXP02FUVOL.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgagggcccggggggtccctgagacctctcctgtcgcccgtcctctggctctaccgtttagagctattggatgagcgtggtcccgcaggcctccgaggggaacggggctgggagtggggtgacccgaaacgagtaaaagggaagacgtagggaaagtcaaagaaacactagtgtggtctgtgtagaacggcgtattccaccatcctaccaagacgaccaacgaccaaagtacttcagtgtatctgaacaaataggaacagtccagagcgaccggagaccgtccggcgtagttacgttactaggtgtagaacgagacaagtaacgtaacgaacgggttagaacggtaaccgggggtagggttagtaaggg

SEQ ID NO: 370322 - DNA, 666 bp, Homo sapiens
  misc_feature: GZ8MTXP02JZIVU.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggaggccgtggtccgagggccggggggtccctgagactctcctgtcgccgcctctgctctaccttagtagtctattggatgagtcgtggtcccgcgaggctccggaaggggacggggctgggaggtgggtcggaccaaacgaaagtaaaaggaagagtacggaagtacaaagaaacactagttgtggacttcgtaggtaggaacggggtcgtaacttcccgaacctaactcccgtacccgaaaggaaccgaaacccgaaaacccggtacccaaaaggttaaactttaccgaaggtttacgttaaacttcccgtagaaacctaaaagttacgaaactacgtcctaggaacgaacgggaccgaaggaccgaccgggtcttaggtacttacgtcggtagtgacgaagtacagtaacgaacgtaggacgtaacggtacggggtaggtgtacg

SEQ ID NO: 370323 - DNA, 644 bp, Homo sapiens
  misc_feature: GZ8MTXP02FXDLX.15.23.C01.1.454.CMB.2.raw
  modified_base (312)..(312): a, c, t, g, unknown or other
  modified_base (614)..(614): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtggagtcgtgggggagccgtggtccgaggccggggggtccctgagactctccgtgtcgcccgtcctcgtggactcacctttagagctattggatgagcgtggtccncaggcctccgaggggagggctgggagtgggtgaccaaagaagtaaaaggaagagtaggaaagtccaaagaaactactagtgtgggactcgtaggtaggaaacggggtcctaagtttcccaaccgtatccctacccgaaggacaaaccgaaaccgccctaaaagtaacttcgaagttgtaaactctaggaactaaaagcggaaaaccaggccctaggaacgacggtacccggaaggtacgaccgggccgttaggtaacttacgtggttagaggaccgaagactagtaacgaacgtaacggtanaaaccggtaaacggggtgggttacgtaagg

SEQ ID NO: 370324 - DNA, 770 bp, Homo sapiens
  misc_feature: GZ8MTXP02J1DUY.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcggtgggggacggccgtggtccgacgggcccggggggtccctgagacctctcctgtcgcccgcctcgtcggacctcctacctttagtacgtctagttggatggacgtcgtcgggtccccgccgacgggcctcccggaaggggaacggggtcgtaggggagggtcggggtcggaacccaaacgaaaggtaaaagggaaaggagtacggggtaaacgtacgaaaagtaaaactacgtagttggtcggtacttcgtaggtagggaacggggtccctacgttcccaacccgtacttcccacccgaaaggacgaaacccgaaaccgaccaaaagttaacttcgtaagttacgttacttccgtaggaaactaaagtaccggaaaacgtacgtaccgaggaacggacgggaaccgggaacgggacccgtacccggggttaccgttaggttaaacgtttcggtacggttacggtaggaaggaacgtaacgtaggtaacggaaaccgggtaaacgggttaaggtaaaccggggttaaacgggggttaggggtttacgttaagggg

SEQ ID NO: 370325 - DNA, 708 bp, Homo sapiens
  misc_feature: GZ8MTXP02GQ8LE.15.23.C01.1.454.CMB.2.raw
  modified_base (281)..(281): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcgtgggggaggcctggtccgagggcccggggggtccctggacgtactcctccgtgtcgccgcctcgnggacctcaccctttagagcttattggattgagtcgtcggggtccccgccacgggcctacccggaaggggaacggggcgtggggaggttggggtcggacccaaacgaaagtaaaacgggaaggtatacggggaaatacaaataaaccacgtaatgggtcgaccttcgtggtacggaacggggtcctattacccacctacttcctaccaagacgaaccaaaccggaccaaaggtaaactccgtaagtagttaaactccgttagaactaaagtacgaaacgtacgaccgtaggaacgacggaccggacggtaacgaccgggtccgttaagtacgtttacgtagttggtacgacggaagtaaccgaagttaaccggaaacgtaacggggtacggaaacggttaaaccgggggtaggggtttacggttaagg

SEQ ID NO: 370326 - DNA, 657 bp, Homo sapiens
  misc_feature: GZ8MTXP02GER3P.15.23.C01.1.454.CMB.2.raw
  modified_base (548)..(548): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctgagactctcctgtcgccgcctcgtggactctacctttagagtctagttggatgagtcgtgggtcccgccgaggcctaccggaagggggaaggggcgtgggaggttggggtacggacccaaacgaaagtaaaagggaaagagtagggaaagtacaaagaaaacacttagtggtcggactcgtaggtaggaacgggccgtattacccaacctattccctaccgaaaggacgaaacccaaacggaccctaaaaggtaacttcaaggttcgttaaactcctaaggaactaaaaagtcgaaaacncgaccctaggaacggcgacccggaaggacccgacgggtcttagttacttacgtggtgagagacgacagtaacgaaacgtaaggtagaacgtaacggggtgggttatagg

SEQ ID NO: 370327 - DNA, 645 bp, Homo sapiens
  misc_feature: GZ8MTXP02IR45P.15.23.C01.1.454.CMB.2.raw
  modified_base (312)..(312): a, c, t, g, unknown or other
  modified_base (346)..(346): a, c, t, g, unknown or other
  modified_base (355)..(355): a, c, t, g, unknown or other
  modified_base (467)..(467): a, c, t, g, unknown or other
tcagtctacgtagccacgaccggtgctcgatttagtacacgtgattagggattgggaggtctcagagaggagccttagccctggactccaaggcctttccacttggtgatcagtactgagcacagaggactcaccatggagttgggctgagctgggttttccttgttgctattttagaaggtgtccagtgcgagagcagctggtggagtcgtgggggaggcctgggtcccgaggcccgggggggtcctggacgactctcctgtgccgcctcgtggactcacctttagtagctattggatgagtctgggtccncaggctcgaggggaaggctggagtgggtgccaanataaagganagtggaacgtcaagaaacactatgtggctctggtaggaagggccgatttccacctagtcctaccagaacggacctaaacggccaaagtaaactttcaaggttcattcgtaanaaacaaagtcgaaacaggacctaggacgaccggaccggaacggtaccggaaccggtcgttaagttaacgtttcgtgggtcggtaagacggtaacgtaactaggtaacgaaccggttaaccggggttaggtaaaaccggggtttaaaccggggggtaggggtttacgacggtttacggg

SEQ ID NO: 370328 - DNA, 688 bp, Homo sapiens
  misc_feature: GZ8MTXP02FFC6V.15.23.C01.1.454.CMB.2.raw
  modified_base (350)..(350): a, c, t, g, unknown or other
  modified_base (611)..(611): a, c, t, g, unknown or other
tcagtctacgtagccacgaccggtgctcgatttagtacacgtgattagggattgggaggtctcagagatgagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccgagggcccggggggtccctgagactctcctgtcgccgcctcgtggactcctacctttagagctatggatgagctgggtccgcaggctcgaggggaaggcgtggagtgggcggacccaaanagtaaaaggaagagtagggaaatcgaaacgaaacacgttaagtcggtacgggtaaccttgtacggtaggaaacgggggtccctaatttcccccgaaaccttaacttcccgaccaaaggtaagaaaccccaaaccggtacccaaaaagtacttacgagggttatactcttacggactaaaagtcggaaaacaccgtaccgtagggaacgaccggacccggaaagggacccgtaaccggggtccgttaggtacttttaacggnggtagtacgaaacgacgaacaacggtaacggaaaccggtaacggtacggtaaaacggggtaacggggtggggttacg

SEQ ID NO: 370329 - DNA, 676 bp, Homo sapiens
  misc_feature: GZ8MTXP02HAJ38.15.23.C01.1.454.CMB.2.raw
  modified_base (315)..(315): a, c, t, g, unknown or other
  modified_base (600)..(600): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgagggcccgggggggtccctggagactctcctgtcgcccgcctctggacctcacctttagtagctattggatgagctgggtccnccaggctccgaggggagggctgggagtggggtggaccaacgaagtaaaaggaagatacgggaagtcaagaaaacactaagttggtcgggtaacctcgttaggtcgggaaacgggggcccgtattaccgaaccctatacccgtcccaaggacgaaccaaaccgacccaaaggaaacttcgagtgttaaactcgtacaacgtaaaatgggaaactacgccctaggaacggacgaacccgggaaggaaccgaccgggtccggttagttaaccgttagtcgtttacggnggaaacgagtacgaagttaacgaaacgtaaacgggttaggaacggtaaaaccggggttaagggggttgtaaacggg

SEQ ID NO: 370330 - DNA, 652 bp, Homo sapiens
  misc_feature: GZ8MTXP02I5TDM.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtgggtccagggcccggggggtccctggacgactcctcctgtcgcccgcctcgtggactcacctttagtagctattggatgagcgtgggtcccgcaggcctccgaaggggagggctgggagtggggtcgaccaaacagtaaaggaagagtaggaagtcaaagaaaccactagtcgtggaccttcgtggtacggaaacggggcctaatttcccgaaccctagtccctacgaaggaccgaaactaaaccgccctaaaagaacttccgaagttgtaacttaccgtgaaacctaaaagtcgaaactagaccccgtagacgacggaccggacggtaacgaccgggtccgttagtagtttaccgtggtgtaggacgaaagtaccaagtaacgaacgtaacgggtaacgaagtaaccgggggtagggttataaggg

SEQ ID NO: 370331 - DNA, 614 bp, Homo sapiens
  misc_feature: GZ8MTXP02IUEQ3.15.23.C01.1.454.CMB.2.raw
  modified_base (446)..(446): a, c, t, g, unknown or other
  modified_base (526)..(526): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtcctgagactcctcctgtcgcccgcctctcggactctacctttagtagctagttggatgagccgtgggtcccgccaggcctccgaggggaaggggcgtgggaggtggggtcggaccaaacgaagtaaaagggaaagagtagggaaagtcgaagaaaacactaagtggtggacctctggtaggaacggggtccgattccgaaccntcctaccagacgaacaacgaccaagtaacttcagtatatctgaactaaatgaacagcctaggagacggaccgaggaaccncgggtaccttaggtaacttacgtggtgtagagacgtacgagtaacgaaacgtaacggtacgtaacggtaacgggaggggttagtaagg

SEQ ID NO: 370332 - DNA, 732 bp, Homo sapiens
  misc_feature: GZ8MTXP02H5LR5.15.23.C01.1.454.CMB.2.raw
  modified_base (200)..(200): a, c, t, g, unknown or other
  modified_base (280)..(280): a, c, t, g, unknown or other
  modified_base (324)..(324): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggancagctggtggagtcgtgggggaggccgtgggtccgaggcccgggggggtccctggagacctctcctgtcgccgccttcgnggacctctacctttagtagcttagttggatgagctcggggtccnccgaggcctaccgaggggaagggctggggaggtggggtcggaccaaagaagtaaaaggagtataccgggaagtacgaacgaaaactcttaagtcggtgtaaaccttcgtaggttacgggaacggggacccgtatttacccaaacccgtttcaccgtaacccgaagtaaacccggaaccctaaacgaaacctaaaacgttataccgtaagttacgttaaacttcgtaacgtaaataaaacgaacgaacgacgtacgtacggacggaacggaccggaacggaaccggtaccggtaccggttacgttacgttacgttacgttaggtacggaacgaacgtaacgtaacgtaacggtaacggtaaacgggtaacggtaaacgggtaaacggggttaacggggttacggtacgg

SEQ ID NO: 370333 - DNA, 628 bp, Homo sapiens
  misc_feature: GZ8MTXP02H1JQL.15.23.C01.1.454.CMB.2.raw
  modified_base (505)..(505): a, c, t, g, unknown or other
  modified_base (507)..(507): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctgggtggagtctgggggaggcctggtccgaggcccggggggtccctggagactctcctgtgccgcctctggactcacctttagtacgcttagttggatgagcgtcgggtccgccagggctccgaggggacggggctgggagtggggtggaccaaacgaagtaaaaggaagatagggaaagtcgaagaaacactaatgtgggaccttcgaggttagaaacgggggccctaattccaaccctatcctacccgaaggaacggaacccaaacggaccctaaagaaatttcgagtcgtaatccgtaananaaatagaacacgacgagagacgacggacggacgacggaccgtacgtacgttacgttagtgtagacgaacgaactataagaacgaacgtacggtaggtaacggtaacggggtaaggggtagg

SEQ ID NO: 370334 - DNA, 615 bp, Homo sapiens
  misc_feature: GZ8MTXP02G8IEB.15.23.C01.1.454.CMB.2.raw
  modified_base (309)..(309): a, c, t, g, unknown or other
  modified_base (383)..(383): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccgggggggtccctgagactctcctgtgccgcctctggactcacctttagtagctattggatgagctgggtccnccaggctccgagggaaggggctgggagtggggtgacaaacaataaaggaagatggaaatcgaagaaacacgtangtgggactcgtgtagaagggcccgtaattccacccatcctacccaaggagaaaccaaacgacccaaagtaaactttacgagttacgtaaatcgttagacctaaaaagtggaaaacacgaccctaggagaacggccggaaggtacgaaccgggccgttagtacttacgtgtagtagaagacggacagtaacgaacgaaccggtagtaagtaacccggggtaggggttagtagg

SEQ ID NO: 370335 - DNA, 661 bp, Homo sapiens
  misc_feature: GZ8MTXP02G6O1X.15.23.C01.1.454.CMB.2.raw
  modified_base (659)..(659): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtggagtcgtgggggaggcctggtccgaggccggggggtccctgagactctcctgtcgccgcctctggactctacctttagtagctattggatgagcgtcgggtccgccgagggcctccgaggggaaggggcgtgggaggtggggtcggaccaaacgaaagtaaaagggaaagtagtagggaaacgtacgaaagaaaacctacttaagtgggtacgggtaacttcgtaggtacggaaaggggcccgtaaattcccaaaccctaatcctaccaagaacgaacaaacggaccaaaagtaacttcaagttctaaatctagaacaaaatcggaaaactcgaccgtaggaacgaacgacccgggaaggtaacccacgggcccgttaggtaaaccttagtggtagttacgagaacagagtaacgaacgaaggtgaaacgtaaccggggtagggggtttanag

SEQ ID NO: 370336 - DNA, 670 bp, Homo sapiens
  misc_feature: GZ8MTXP02FKLKH.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggaggccgtggtccgagggcccggggggtccctgacgactcctcctgtcgcccgcctctggactcacctttagagctagttggatgagcgtgggtcccgcaggcctccgaggggaggggctgggaggtggggtcggaccaaacgaagtaaaagggaagagtagggaagtacgaaagaaaacactaagtggtggacctcgtaggtacggaaacggggtcctaattcccaaccagtcctacccaaggaacgaacccgaaaccgaccaaaggtaaactttacaggttagtaacttccgtagaacctaaaagtcgaaaaccagacccctaggacggacgaccggaaggtaccgaccgggtccgttagtacttaacgtggtagtacgacgaagactaagtaacgaaacgtaaacgggtacggtaaacggtaaaccgggggaggggttacgtaacgg

SEQ ID NO: 370337 - DNA, 641 bp, Homo sapiens
  misc_feature: GZ8MTXP02FWP8A.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgagggccgggggggtccctggagacctctcctgtgcccgcctctggactcacctttagtagctattggatgagcgtgggtcccgccgagggcctccggaaggggaaggggcgtggggaggtggggtcggacccaaacgaaagtaaaagggaaagagtaggggaaacgtcaaagaaactacgtatggtgggacctcgtggtagggaaggggccgtattacaccctatacctacaagacgaaccgaaacgaccaaaagtaacttacagtgtaatctagactaaaatagaaccagccctagaaggacgccggaaggaccgaccggggaccgtgttactacgtggtagaggtagacgaacagtaacggaaacgaacgggtacggaacggtaaaccggggtagggggttagtaagg

SEQ ID NO: 370338 - DNA, 725 bp, Homo sapiens
  misc_feature: GZ8MTXP02FNNZI.15.23.C01.1.454.CMB.2.raw
  modified_base (307)..(307): a, c, t, g, unknown or other
  modified_base (346)..(346): a, c, t, g, unknown or other
  modified_base (424)..(424): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctggggggagcctggtccaggccgggggggtccctgagactctcctgtcgccgctctggactcacctttagagcctattggatcgagctgggtccnccaggctccgaggggagggctgggagtggggtgccaaanaagtaaaggaagagtaggaaagtcaagaaaccagtagtggtggactcgtgtagaacggggtccaatttccaaaccctntacccacgaagacgaaccgaaaccgcgttaaaagtacttcgaaagttcgttaaagtcccgttaacgaaacgtaaacgtaacggtaaacgtaaacggtaccgtacggaacgggaaccggaccgggaaccgggtaaccgggtacccgggtaccggttaacggtttaaaccggtttaccggttacggttacgggttaacggtaacggtaacggtaacggtaaacgtaaacggtaaaccggtaaaccgggtaaacgggtaaaccggggtaaaccgggggttaacgggggtttaacgggttaacgg

SEQ ID NO: 370339 - DNA, 725 bp, Homo sapiens
  misc_feature: GZ8MTXP02F67NJ.15.23.C01.1.454.CMB.2.raw
  modified_base (317)..(317): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgagggcccggggggtccctgagactcctcctgtcgcccgctcgtggactcacctttagtagctagttggatgagtcgtgggtcccncgacgggcctccggaaggggaacggggctaggggacggttggggtcggacccaaaagaaagtaaaaggggaaagtagttacgggaaacgtcgaaaggaaaactacttaagtcggtgggtaacctgtaggtacggaaacggggtcctagttaccaaccctattcccacgaaggaacgaacccgaaacgacccgaaaagttaacgttaccgaagtcggttaaatccgtaagaacctaaaagttacggaaaaccgagacccgtagaacggtacggacccggaaggttaacccgacgggggtcccttaaggtttactttaagtcgggttacgtagggaacgtaaacgtacgtaagtaacggaaaacggtaacggtaaggtaaccggttaaacgggggtaggttacttaaggg

SEQ ID NO: 370340 - DNA, 611 bp, Homo sapiens
  misc_feature: GZ8MTXP02GHJJO.15.23.C01.1.454.CMB.2.raw
  modified_base (553)..(553): a, c, t, g, unknown or other
  modified_base (565)..(565): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtggagtcgtgggggaggcctgggtccaggccgggggggtccctggagactctcctgtcgcccgcctcgtggactccacctttagtagctagttggatgagcgtgggtcccgcaggcctccgaggggaaggggctgggagtggggtgaccaaacagtaaaaggaagagtaggaaagtcaaataaaacactatgtcggactctaggtagaaggggccctaattccacctaatcctaccgaaagaacgaacaaacgacccaaaagaaacttcaaagtgtaatctagaactaaaatcgaaaacagcctaggaacgacgaccggaggaacgacggcgtacgtaattacgtgngtagagaacganaagtcgaaacgaacggtagaaacggtaaacgggaggggttctaagg

SEQ ID NO: 370341 - DNA, 897 bp, Homo sapiens
  misc_feature: GZ8MTXP02JIWJU.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcgtgggggaggccgtggtccgagggcccggggggtccctggacgactcctccgtggtcgcccgcctcgtggactcctacctttagtagtctagttggatggagccgtcgggtcccgccgaggccgtccggaaggggaaggggcgtaggggagggtggggtcggacccaaacgtaaagtaaaagggaagacgtagggaaagtaccaaagaaactacgtatgggtcggtacgtcgtaggtacgggaaaccggggtccgaactttcccgaaacccgtattacccgcccgaaaacggacccgaaacgaaacccggaccgaaaaagtaacgtttacgaaagttcgtttaaacttccgtaacggaacctaaaaagttccggaaaaccgtaccgggacccgtaagggaacggaacccgggaacccgggtaaaggggtaacccccggtaacgggggttacccccgtttaaaggggtttaaaacccttttttaccgggggtacgggtttacgggttaaaacggggaaaccggtaaaacggggtaacccgtttaaaacggggttaaaaccccgggggtaaaaacccgggggtttaaaaacccggggggttaaaacccgggggttaaaaaacccggggggtttaaaaacccggggggggtttttacggggggttttaaaacgggtttaacggggg

SEQ ID NO: 370342 - DNA, 609 bp, Homo sapiens
  misc_feature: GZ8MTXP02G6MFU.15.23.C01.1.454.CMB.2.raw
  modified_base (551)..(551): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagactctcctgtgccgcctctggactcacctttagtagctattggatgagcgtcgggtccgccagggcctccgaggggaaggggcgtgggaggtggggtggacccaaacgaaagtaaaagggaagagtagggaaagtacaagaaaacactaagtgtgggactcgtggtaggaacggggccgagttaccacctattcctacccgaagacgaaccaaacgacccaaagaacttcgagtgtaatcgtagacaaagtagaaacagccgtaggagagcccggaagaccgtacggccgtagtattacgnggttgtacgagacgataaagtgaaacgacggtagaacgtaaccgggtaggggtatagg

SEQ ID NO: 370343 - DNA, 834 bp, Homo sapiens
  misc_feature: GZ8MTXP02ISRGC.15.23.C01.1.454.CMB.2.raw
  modified_base (393)..(393): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcggtgggggacggtccgtcgggtcccgacgggtcccggggggtccctggacgacctccgtccgtgtcggcccgtcctcgtcggacctcgtacctttagtagtctagttcggatggagcgtcgggtccgcgaggccgtacggaaggggaggggcgtagggtacggtcggggtacggaaccncgtaaaagaaaacggaaggtagtaaggaaacgtacgaaacgttttaaaccgacgttagtcgggtacgtacctcggttacggtagggaacgggtacccgttaacgttacccaacccgtattacccgtaaccgaacggaaaccgaaaccgaaacccgaaaccgtaaacggttaaaacgttccgttaagtttaacgttaacgttacgtaacggtaaacccgtaaaagaccggtaaaaccgtacggtacccgtaaagggaaaccgggtaaccgggaaacccggggtaacgggaacccggtaaacccggggttacccggtttaacggttaacgtttaaacggtcgggttacggtaaggaaccggtaagaaccgttaaggtaaccgaaaacggtaaacgggacggtaaaaccggggttaaccggggtttacgggtacggtttacggg

SEQ ID NO: 370344 - DNA, 575 bp, Homo sapiens
  misc_feature: GZ8MTXP02JSTII.15.23.C01.1.454.CMB.2.raw
  modified_base (377)..(377): a, c, t, g, unknown or other
  modified_base (511)..(511): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggcccgggggggtccctggagactctcctgtcgccgcctctggactcacctttgtagctattggatgagctgggtccgccaggctccgagggaggggctgggagtggggtgccaaacaagtaaaaggagatggaatcaagaaacnctatggtggactcgtgtagaagggccattcacctatcctccagacgaacaaccgtccaaagaactcagtgtatctagacaaatgaaacagcctagagacgcccggagggaccacgggcccgttagtacttacgnggtgtagagaacggacagtaacgaacgaacgggtagaacgtaaccggggtaggggtttagaagg

SEQ ID NO: 370345 - DNA, 663 bp, Homo sapiens
  misc_feature: GZ8MTXP02GZB57.15.23.C01.1.454.CMB.2.raw
  modified_base (397)..(397): a, c, t, g, unknown or other
  modified_base (527)..(527): a, c, t, g, unknown or other
  modified_base (604)..(604): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcttgggttttccttgttgcttattttagaaggtgtccagtgcgaggagcagcgtggtggagtcgtgggggacggccgtggtccgagggcccggggggtcctgacgactctcctgtcgccgcctctggactcacctttagagctagttggatggacgcgtgggtcccgccaggcctaccggaggggacgggctgggaggtggggtcgaccaaacgaagtaaaggaagagtacggaagtcaagaaacncgtagtgtcggacttcgtggtaggaacggggcctaactttccgaaaccctgttccctacccgaaaggaccaaaccgaaaccgccgaaaagtaacttaccgagttcgttaatccagaaacaagtacgaacncgtacgtaggaacgacggaccggtaggaaccgtcgggtaccgttattacgttacgtgggttagacgaagaaccgtanacgtaacgtaaaccgtaagggtacgtaaacgggtttaacggggtagggttaccgtaggg

SEQ ID NO: 370346 - DNA, 833 bp, Homo sapiens
  misc_feature: GZ8MTXP02IH42S.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagtctgggttttccttgttgtcttattttagaaggtgtccagtgcgaggagcagcgtggtggtagtcggtgggggacggccgtgggtcccgacggggcccgggggggttcccctggacgacctcctccgtggtcgcccgccctcgtcggtacctcctaacctttagtacgtcttagtttgggatggaggtcgtcggggtccccgccgacgggtccctaccggaggggaaggggcgtggggtaggttcgggggtacggaccccgtaaaagtaaagttaaaaggggaagaacggttaggggaaaacgttaccgaaaacgtaaaacctacggttaacgtgggtacgggtaccttcgggttaggtacggggaaacgggtcccgtattacccgacccttagttccctaccgaaagacgaaaccgaacggaccctaaaagtaactttacgaacggttctaaacgttctacggaactaaaagtacgaaccgaacgtccgtaaggaaccgggaaccggaccgggtaaccggaaccggtacccggggtaccgtttaacggtacgtttacgggtagggttacggtaacggaacggtaacgaacggttaacggaacgggtaaaaaccgggttaaacgggggtaaacgtaaaacccgggggttaaaccgggggttacgggggtttacgttaaggg

SEQ ID NO: 370347 - DNA, 677 bp, Homo sapiens
  misc_feature: GZ8MTXP02HG4TX.15.23.C01.1.454.CMB.2.raw
  modified_base (615)..(615): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcgtgggggagccgtggtccgagggccggggggtccctgacgactcctcctgtcgcccgcctcgtggctcacctttagtagtctattggatgagcgtgggtccgccaggctccgaggggaaggggctggaggtgggtcgaccaaacgaaagtaaaggaagatacgggaaatcgaaagaaaactacgtaagtggtgggacttcgtaggtaggaaacggggtccctagttcccacctaatccctacaaggaacgaaccaaaccgcccgtaaaaggtaatttaccgaagttaggttactccgttagaactaaaattcgaaaactacggaccctaggaagaccggtaacgacggggaactacccgggtccgttagttaaccgttagtggtaggttacgaagaaccgngttaagaacggaacgaaaggggttaccgaaaggttaaaccgggggtggggtttacgtaaggg

SEQ ID NO: 370348 - DNA, 722 bp, Homo sapiens
  misc_feature: GZ8MTXP02J10WC.15.23.C01.1.454.CMB.2.raw
  modified_base (568)..(568): a, c, t, g, unknown or other
  modified_base (581)..(581): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgttgggttttccttgttgtcttattttagaaggtgtccagtgcgaggagcagcgtggtggaggtcggtgggggacggccgtcgggtccgacggggcccgggggggttccctggacgaccttcctccgtggtcgcccgtcctcgtggtaccttacctacctttaggtagcttagttggaatggacggtccgtcggggtaccccgccgtacgggccgttaccggaagggggacggggtcgtagggaggtggggtacgaccaaagaaagtaaaaggagtagtacggaaagtacgaaagtaaaaccacttagtggtcggaccttcggtggtacggtaacgggcctaacttcccgaacctactcccgtacccgaaaggacccgaaaaccaccggaccaaaaggtaacttacgaacggttntactcgaactaanaaacgtagaacctcgaccgtagggaacggaccggccggtaacggacccgtacgggtacgttagttacgttgagggtataggacgacgactacggaacggaaaccgtaagggtacgtaacgggtacggggtaggttacgacg

SEQ ID NO: 370349 - DNA, 616 bp, Homo sapiens
  misc_feature: GZ8MTXP02JWDK1.15.23.C01.1.454.CMB.2.raw
  modified_base (269)..(269): a, c, t, g, unknown or other
  modified_base (306)..(306): a, c, t, g, unknown or other
  modified_base (383)..(383): a, c, t, g, unknown or other
  modified_base (551)..(551): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccaggccgggggggtccctgagactctcctgtcgccgcctntggactcacctttagagctattggatgagctggtccncaggctccgaggggaaggggctgggaggtggggtcggaccaaacgaagtaaaggagagtagggaaagtcaagaaacnctaagtgtgggaactcgtggtagaacgggggcctaattccgaacctattcccaccgaagacgaaccaacggtcccaaaaggactttgagttataactcgtgaactaaagcggaaacagtccctaggagacgaccggtaaggacctaccgggccgttagtacgttacgnggttagacggaggaacacagtaacgaacgtacggtagaaccggtaacgggggtagggtataaggg

SEQ ID NO: 370350 - DNA, 713 bp, Homo sapiens
  misc_feature: GZ8MTXP02HSRY3.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggtttttccttgttgcttattttagaaggtgtccagtgcgaggagcagctggtggagtcgtgggggagccgtggtccgacggccggggggtccctgagactctcctgtcgccgcctcgtggacctctacctttagtagcttagttggatggagtcgtcggggtccgaccgagggtccgtaccggaagggggaaaggggtccgtggggtaggttggggtacggaacccgaaacgaaaggttaaaaaggggaagagtagggaaacgtacgaaagaaaactactaagttggtgggtaacttcggtaggtacgaaaaccgggggtcctactttacccaaaccctacgttaccctaacccgaaggaaccgaaaccctaaaccggaacccaaaagtaactttcgaaagtttggtaacttaccgttaggaaactaaagtaacgaacgaacgaccgtagaacggaacggacggaacggaccgacggaccggtagttacgttagtcgtgtaggagagaacgagtaagaacgaacggtacgtaacggtaaccggtagggtaggttagg

SEQ ID NO: 370351 - DNA, 722 bp, Homo sapiens
  misc_feature: GZ8MTXP02GR97H.15.23.C01.1.454.CMB.2.raw
  modified_base (446)..(446): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccgaggccgggggggtccctgagactctcctgtgccgcctctggactcacctttagtagctattggatgagcgtgggtcccgccagggcctccgaggggaacggggcgtgggaggtggggtggaccaaacgaagtaaaagggaagagtagggaaagtacaaggaaacacgtagtggtcgggactcgtggtaggaacgggggcctattccaaaccctnttacccacccgaaggaacgtaaacccaaaccggtaccccgaaaaggtaactttccgaaaggttcgttaaacttccgtaggaaaccttaaaatcgggaaaacctacggaccctagggaacgaaccggacccggaagggtaacccgaacggggtcccgttaaggttaactttaccggtaggttcggtacggaaggtaaccgaaacgtagtaaccggaaaacgttaaaacgggggttcggaaaacggttaacccgggggtaagggggttttcaaacggg

SEQ ID NO: 370352 - DNA, 716 bp, Homo sapiens
  misc_feature: GZ8MTXP02IVFRS.15.23.C01.1.454.CMB.2.raw
  modified_base (267)..(267): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccaggccgggggtccctgagactctcctgtcgccgcctgnggactcacctttagagtcttatggatggacgtcgttcgggtcccgccgaggtcctaccggaaggggaacggggtcggttaggggagggtttggggtacggacccgtaaaacgtaaaggtaaaagggaaagtaaggtagggaaaacgtacgaaacggaaaactacgttagttacggcggtactcgtgtagggaacgggtacctagttcccaacccgtatcccgtaccgaagacgaaaccgaaccgaccaaagtaactaccgagttagtactacgtagaactaaaagtacggaaactacgtaccgtaggaaacgacgggaaccccgaaggacccgaaccggtaccggttagttacgtttacgtgggtaggttaagagtaaacgtaactagtaacggtaaaggaccggttaaaggaacggtaaaccggggtaacgggggttacttaacgggg

SEQ ID NO: 370353 - DNA, 685 bp, Homo sapiens
  misc_feature: GZ8MTXP02GGG8H.15.23.C01.1.454.CMB.2.raw
  modified_base (412)..(412): a, c, t, g, unknown or other
  modified_base (423)..(423): a, c, t, g, unknown or other
  modified_base (460)..(460): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccgagggccggggggtccctgacgactctcctgtcgcccgctcgtcggactctaccgtttagagctagttggatgagtcgtggcccgcgacggcctaccggaaggggaacggggcgtaggggaggttcggggtacggaacccaaaagaaagtaaaaggaagagtacggaaagtccaaagaaacncgtaagttggngtactcgtggacggaacgggccctaagttcccaactntccctacgaaaggaacaaaccgaaaccgacctaaaagtaacttaccgaagttcgtaaattccgaagacctaaaatcgaaactagacccgtaggacgacggaaccgaggtaaccgacgggtacccgttagttaaccgtttagtggtacgtagacggaaacctagaacgttaacgaaaccgtaaacggggtagtaaaccggtaaccgggggttaaggggtctaacgg

SEQ ID NO: 370354 - DNA, 740 bp, Homo sapiens
  misc_feature: GZ8MTXP02ISG8B.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgctattttagaaggtgtccagtgcgaggagcagcgtggtggagtcgtgggggaggcctggtccgacgggcccggggggtccctggagactcctcctgtcgcccgtcctcgtggacttcctacctttagtagtcttagttggaattggagtcgtcggggtcccgccgagggtctccggaagggggaaggggtcgtggggaggttggggtacggaccaaaacgaagtaaaaggaaaggtagtacgggaaacgtcaaaagaaaaacctacgttaaggtcgggtacgggaccttcgttaggggtaaggggaaccgggggtcccgtactttacccaaaccctagtacccttacccgaaaggacgaaacccgaaactacccgaaagtaacttacgaagtagttactacgttacgaataaacgtacgtaaacacgtacccgtaggaacgacggtaccgggaggaaacccgacggttacccggttagttaaaccgtttgtaggtacggtaggaacgtaacgacgtaagtaacggaacgtaacgggttagaaacggtaaaaccggggtggggtttaataggg

SEQ ID NO: 370355 - DNA, 788 bp, Homo sapiens
  misc_feature: GZ8MTXP02IK0M6.15.23.C01.1.454.CMB.2.raw
tcagtctacgtagccacgaccggtgctcgatttagtacacgtgattagggattgggaggtctcagagaggagcccttagccctggactccaaggcctttccacttggtgatcagtactgagcacagaggactcaccatggagttgggctgagctggttttccttgttgcttatttagaaggtgtccagtgcgaggagcagcgtggtggagtcgtgggggagcctggtccgaggcccggggggtccctgagactctcctgtcgcccgcctctggactctaccttagtgctattggatgagcgtgggtcccgcgaggctccggaggggaacggggtcgtgggaggtgggtacggacctaaacaagtaaaacgggaagaagtagggaaacgtaccgaaacggaaaaacctacgttaagttcgggttacggacctttcgttaggtaacggggaaacggggtccccgtaatttacccaaaccctaattccgaacccaaggaacgaaaccgaaacccgtacccgaaaaaggtaaacctttccgaaaggtttacgtaacttccgttaagaaacctaaaaagttacggaaaccgttacgaacccgtggaaacgaccgggccccggaaaaggggttaccccgacggggttacccgttaggtttaaaacttttaccggtggttaccgggtaagaaaacggttaaccgaaaagtacgtttaaaccggaaaaccggttaaacgggttaacggaaaacggttaaaaccgggggtgggggttttaacgaacggttttcgggg

SEQ ID NO: 370356 - DNA, 701 bp, Homo sapiens
  misc_feature: GZ8MTXP02ILA59.15.23.C01.1.454.CMB.2.raw
  modified_base (402)..(402): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggaggttggggctgagcgttgggttttccttgttgcttattttagaaggtgtccagtggcgaggagcagcgtgggtggaggtcggtgggggacggccgtgggtccgagggcccggggggtccctggagactctcctgtcgcccgcctcgtcggactcctaccgtttagtagtctagttggatggagcgtggggtcccgccagggcctaccggaaggggaacggggctggggagggtgggtcgaccgaaaagaagtaaaagggaanaagtaggaaatacgaaagaaaacattaagtggtcggtacttcgtaggtaaggaaggggtaccccgtatttacccaaccgaacgttccctacccgaaggaaacgaaacccgaaaccgtaccgaaaaagtaacttacgaagttagtaacttacgtacgaaactaaaagtacgaaacctacgaccgtaggaggaaccggaccggaaggaaccgaccggaccggttagtactttaggtcgtaggtacgagaacgactaagtcgaaacgtaacggagtaacggtaaccggggtagggttacgag

SEQ ID NO: 370357 - DNA, 676 bp, Homo sapiens
  misc_feature: GZ8MTXP02IUEXE.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgagggccggggggtccctgacgactctccgtgtcgccgcctcgtggacctctacctttagagctagtggatagagtcgtcgggtccgccgacggcgtccggaaggggaacggggcgtagggaggtggggtcgaccgaaacgaaagtaaaagggaaagacgtagggtaaagtaccgaaaggaaaactacgtaagttcgtcgggacttcgtagggtagaacggggcctaattccaccatcccgaccgaagaaccgaaccgaaaccgaccctaaaagtacgtactagtacgtaattaccgtgaaactaaagtaacgaaacgaacgccgtaaggaaggacgggaaccggaacggaccggaacggtaccggttagttagttacgtggttagagtacgaacgcgtaaagtggaaaccgtagtacgggaaacgtaacggggtaggtagtagg

SEQ ID NO: 370358 - DNA, 772 bp, Homo sapiens
  misc_feature: GZ8MTXP02JV19N.15.23.C01.1.454.CMB.2.raw
tcagtctacgtagccacgaccggtgctcgatttagtacacgtgattagggattgggaggtctcagagaggagccttagccctggactccaaggcctttccacttggtgatcagaactgagcacagaggactcaccatggagttggggctgagcttgggttttccttgttgcttattttagaaggtgtccagtgcgaggagcagcgtggtggagtcgtgggggagccgtggtccgagggccggggggtccctggacgactctccgtgtcgcccgcctctggacctctacctttagacgtcttagttggatggacgtcgtcgggtcccgccgacggtccgtaccgggaggggaacggggtcgtaggggtagggttggggtacgggaacccaaaacgtaaaggttaaaaaggggaacggtaagtagggaaaccgtacgaaaaggtaaaacctacgtagtaggtacgggtaccttacggttagggttaggggaaacggggtcccgtaacgtttacccgaaacccgtacttacccgtaacccgaaagggaaccgaaaccgaaaacccgggtaccctaaaaggtaaaccgtttacgaagggttagtaacttacgtacgaaacctaaagtacgaaacgacgggtacctaggaacgggaccgaccgggaacggtaaccggaccgggtaccgttagtttaacgtacgtggtacgtaggaagtacgacgtagtacgaacgtaacggtagtaaacgggtacgggtagggtacgtagtttacgg

SEQ ID NO: 370359 - DNA, 630 bp, Homo sapiens
  misc_feature: GZ8MTXP02ISYQE.15.23.C01.1.454.CMB.2.raw
  modified_base (389)..(389): a, c, t, g, unknown or other
  modified_base (486)..(486): a, c, t, g, unknown or other
  modified_base (574)..(574): a, c, t, g, unknown or other
  modified_base (588)..(588): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtgggtccaggccggggggtccctgagctctcctgtcgccgcctctggactcaccttagtagctagttggatgagcgtcgggtcccgccagggctaccggaggggaagggcgtgggaggtgggtgaccaaacgaagtaaaaggaagagtaggaatcaacgtaaacnctaagtgtcgggacttcgtggtaggaaacggggtcctaagttaccacctatccgtaccaaggaacaaacgaacgacctaaaagtaacttcaaagttnttaacgtactggaaactaaaatcggaaaacagacccgtaggaaacgtacgggaccgaaggacccgtaacgggccgttaggtacttagnggtatgaagactanagaacgaacgaacggtgaaacgtaccggggtaggtgtaacgg

SEQ ID NO: 370360 - DNA, 599 bp, Homo sapiens
  misc_feature: GZ8MTXP02I07PV.15.23.C01.1.454.CMB.2.raw
  modified_base (303)..(303): a, c, t, g, unknown or other
  modified_base (337)..(337): a, c, t, g, unknown or other
  modified_base (361)..(361): a, c, t, g, unknown or other
  modified_base (396)..(396): a, c, t, g, unknown or other
  modified_base (420)..(420): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctgagctctcctgtgccgcctctggactcaccttagtagctatggatgagctgggccnccgaggctccgaggggagggcgtgggaggtgggnggaccaaacgagtaaaaggaaganacgggaagtcaagaaaacactagtgtgggacttgngtagaagggccgatccaccatccncagacgacaacgaccaaagaacttcagtgtaactctagaactaaagtacgaaacgcgacccgtaggaacgacgggtaccggaggaaccgacggtaccgttaggtaaccttagtggtgtacggacgaagacagtaacgaacggaacggtacgtaacggtaaccggggtaggggttatagg

SEQ ID NO: 370361 - DNA, 667 bp, Homo sapiens
  misc_feature: GZ8MTXP02IX2PU.15.23.C01.1.454.CMB.2.raw
  modified_base (591)..(591): a, c, t, g, unknown or other
  modified_base (611)..(611): a, c, t, g, unknown or other
  modified_base (623)..(623): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccgagggccggggggtccctgacgtactctcctgtcgccgcctcgtggacctctacctttagtagctagttggatggagcgtcggggtcccgccgaagggtccgtacccggaagggggaacggggcgtaggggagggttggggtcgggacccaaacgaaagtaaaaggggaaagtagtaggggaaatacgaaaaggaaaacctactaagttggtgggaacttcgtaggtaggaaacggggccgtattccaaacccgtattcccacccgaagaacgaaccgaaccgacaaaaggtaacttcgaaggttatacgtcttacggaactaaagtcaaacgtcgccgtaggacgacggacgaggtaccncgggtcgttatactttaggngtagagagacanagtaacgaacgtacggtacgaacggttacggggtaggtagtagg

SEQ ID NO: 370362 - DNA, 717 bp, Homo sapiens
  misc_feature: GZ8MTXP02HVECD.15.23.C01.1.454.CMB.2.raw
  modified_base (272)..(272): a, c, t, g, unknown or other
  modified_base (553)..(553): a, c, t, g, unknown or other
  modified_base (582)..(582): a, c, t, g, unknown or other
  modified_base (705)..(705): a, c, t, g, unknown or other
tcagtctacgtagccacgaccggtgctcgatttagtacacgtgattagggattgggaggtctcagagaggagccttagccctggactccaaggcctttcccacttggtgatcagcactgagcacagaggactcaccatggagttggggctgagcttgggttttccttgttgcttattttagaaggtgtccagtgcgaggagcagcgtggtggagtcgtgggggaggccgtggtccgagggcccggggggtccctgagactctctgtcgcccncctctcggacctctacctttagtagtctagttggatggacgtcgtacggggtccccgcccgaacgggtcctaccccggaagggggaacggggtccgtggggagggtttggggtacgacccctaaaagaaagtaaaaaagggaaggaagtacggaacgtacaaaggaaaccataacgtgggtcggacttcgtaggtaggaacgggaccgtattcccaaccctattacccgtacccgaaagaacgaaccgaaaacccgtaccaaagtaaacttcgaaaggttnaacttcgtaagaactaaaatacgaaaccncgtacccgaggacgaccggaccggaacgggacccgtaccgggtacttagttaccttaagttcgtaggtacgaggacgtactagtaacgaacgtaaacggtacggaacggttaaaaccgggggngggtttacgagg

SEQ ID NO: 370363 - DNA, 828 bp, Homo sapiens
  misc_feature: GZ8MTXP02I2W2P.15.23.C01.1.454.CMB.2.raw
  modified_base (319)..(319): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtgggtggagtcgtgggggagccgtggtccgacggccggggggtccctgagactctccgtgtcgcccgcctctggacttctacctttagtagctagttggatgagtcgtcgggtccncgacggtctaccggaggggaaggggcgtgggaggtggggtcgaccgaaacgtaagtaaaacggaagtaagtaggaaagtcgaaagaaaaccgtagttaacgtgggtacgggtaaccgtttcgtacgggttacgggaaccgggggtacccgtaaacgtttccaaaccccgtatttacccgtacccgaaacggaacggtaaacccgaaaacccggaaccccgtaaaaaggtaacccgtttaaccgaggtttaacgttaacgttacccgtttagggaaaaccctaaagttaaccgggtaaacgttaaaccggaccccgttaaggaaacggggttaccgggaacccgggaacgggaaacccgggaccgggtacccggtttagttacggtttaaaccggttgggttaacggttaacgggaacgaacggtaacgaagttaacgggaaaaccgtaaacggggttaacggaaacccggggtttaaaaccggggtacgggggtttacgtttaaagggg

SEQ ID NO: 370364 - DNA, 697 bp, Homo sapiens
  misc_feature: GZ8MTXP02JSJN9.15.23.C01.1.454.CMB.2.raw
  modified_base (253)..(253): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggacggccgtggtccgacgggccggggggtcccngacgactctcctgtcgcccgcctcgtggactctaccttagagctagttggatgagcgtcgggtccgcgaggcctaccggaaggggaaggggctggggtaggtcggggtacgacccaaagaaagtaaaagggaagtagtagggaactacgaagtaaaccatagtgtaggtacctgtggtagaacggggtcctaacttcccaaccacgtccctacgaacgaacgaacccaaacgaccaaaggtaacttcgaagtgtaactcgtagaacgtaaagtacgaaaccagtaccgtaaggacgaacgggaccggaacggtacccgaccggggtaccgtttaagtacgtttaccggtagtcggtacggtaagaacgacgtaaagttaacggaaaccggttaaacggggtaaggtaaaccggtaaaccgggggttaggggtacggttaacggg

SEQ ID NO: 370365 - DNA, 752 bp, Homo sapiens
  misc_feature: GZ8MTXP02GIV68.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcgtgggggagccgtggtccgagggcccggggggtccctggagcctctcctgtcgcccgtcctcgtggacctctaccgtttagtacgcttagttggatggacgtcgtcgggtcccgccgagggtccctaccggaaggggggaacggggtcgtaggggagggttgggggtacggaccccgaaaagaaaggtaaaaagggaaaggtagtaaggggaaacgtacgaaaacgaaaactacgttaagtgggtacgggtacttcgtagggtacgggaaaccggggacccgtattacccgaaaccctattacccgaccgaaaggaacccgaaaccgaaacccgaaccgaaaagttaacgttaccgaaaggttctaaacgtcgttaagaaacctaaaagtccgaaaacgtaccgtccagggaacgacggacccggaaggaccgtacgggtcgttaagttactttagggtgttaggagaacgtaaggcctaaagtcggaaacgtaaagggtacggaaaacggttaccgggggtggggttactaagggg

SEQ ID NO: 370366 - DNA, 680 bp, Homo sapiens
  misc_feature: GZ8MTXP02GV81O.15.23.C01.1.454.CMB.2.raw
  modified_base (315)..(315): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcgtgggggagccgtggtccgagggcccggggggtccctggagactcgtcctgcgccgcctcgtcggactcacctttagtagctatggatgagcgtgggtccnccaggctccggagggaggggctgggaggtggggtacggaccaaacgaaagtaaagggaaagtagtaccggaatagaaagaaactacgtagtgtcgggtaactcgtaggtagggaaacgggtcccgtaaatttcccaaccgttacttacccgtacccgaaggaaccgaaaccgtaaacccggaacccaaagtaaacctttacgaagtacgttattacctagaaacctaaagttacggaaaccagacccgtaggaacggaacggaccggaacggtacgaaccgggtcgtaacgttagttactcggtggtaacgacgaagacgtaagaagaacgaacggtagaaggtaaccgggtagggtacgtaagg

SEQ ID NO: 370367 - DNA, 579 bp, Homo sapiens
  misc_feature: GZ8MTXP02I8JDR.15.23.C01.1.454.CMB.2.raw
  modified_base (379)..(379): a, c, t, g, unknown or other
tcagtctacgtagccacgaccggtgctcgatttagtacacgtgattagggattggggaggtctcagagaggagccttagccctggactcccaaggcctttccacttggtgatcagcactgagcacagaggactcaccatggagttggggctgagctgggttttccttgttgctattttagaaggtgtccagtgcgaggagcagctggtggagtctgggggagcctgggtccaggccggggggtccctgagactctcctgtgcccgcctctggactccacctttagtagctatggatgagctgggtccgcaggcctcgaggggaggggctggagtggggtggccaaacagtaaaaggaaggatgggaagtcaagaaaacnctaatgtggacttcgtgtgaaacggggccgtattccaaccctatccctaccaagacgaacaaacgcccaaaggaactttacagtataatcctagactaaagagaacaacgacgacgagacgacgacggacgacggccgtacgtagttacgtcgtgtagagagacgataagacgacggagacgtaacggtacgggtagtag

SEQ ID NO: 370368 - DNA, 591 bp, Homo sapiens
  misc_feature: GZ8MTXP02HXBL6.15.23.C01.1.454.CMB.2.raw
  modified_base (318)..(318): a, c, t, g, unknown or other
  modified_base (344)..(344): a, c, t, g, unknown or other
  modified_base (359)..(359): a, c, t, g, unknown or other
  modified_base (383)..(383): a, c, t, g, unknown or other
  modified_base (388)..(388): a, c, t, g, unknown or other
  modified_base (395)..(395): a, c, t, g, unknown or other
  modified_base (495)..(495): a, c, t, g, unknown or other
tcagtctacgtagccacgaccggtgctcgatttagtacacgtgattagggattgggaggtctcagagaggagccttagcccctggactccaaggcctttccacttggtgatcagcactgagcacagaggactcaccatggagttggggctgagcttgggttttccttgttgcttattttagaaggtgtccagtgcgaggagcagcgtggtggagtcggtgggggaggccgttggtccgacggcccggggggtccctggacgactcgtctgtcgccgcctcgtggactcactttagagctattgatgagcgtcggtccnccgaggcctccgaggggaggcgtggngtgggtcgactaaanaagtaaagagagtacgagtacaanaaacntacgtgngactcgtgtaggaacggcctatcccaaccgatacctaccagacaaccaaacgtaccaaagtaactcgagtatatcgagtacaaaagtcgaaacacgaccnggaacgacggacgaagaaccgtacggtaccgtagttaacgttacgtgtagtacgagagaacagtaagaagaacgagagtaacggacggttaggtag

SEQ ID NO: 370369 - DNA, 851 bp, Homo sapiens
  misc_feature: GZ8MTXP02GIZSB.15.23.C01.1.454.CMB.2.raw
  modified_base (782)..(782): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcgtgggggaggccgtggtccgacgggcccggggggtccctggacgactcctcctgtcgcccgcctcgtggacctcctacctttagtgtcttagttggatggacgcgtcggggtccccgccgaggggtcctacccggaagggggaacgggggtcgttaggggtagggttcgggggtacggaccccgtaaaagtaaaggtaaaaaggggaaaggtaggtaggggtaaaagtaccgaaaaggaaaaccctaagttaaggttcgggtagggtaacccttcggttaggggttaaccggggaaacgggggtacccttaacgtttaccccaaacccgtactttacccccgtaaccccgaaaggaaaccggaaaacccgaaaacccgggaaccctaaaaaggttaaactttaccgaaaggtttacgttaacttacccgtaggtaaaaccctaaaagttaccggaaaaccaacgtccccgtaaggaaaccggggacggaccccgggaagggtaacccggaccgggggttacccgtttaggttaaaactttcggtacggtttagggagacgggtaaanacgtaagtaacgggaaaccggtaacggttacgggaacggtaaaccgggggtaggggttacggttaaggg

SEQ ID NO: 370370 - DNA, 740 bp, Homo sapiens
  misc_feature: GZ8MTXP02HO7MZ.15.23.C01.1.454.CMB.2.raw
  modified_base (290)..(290): a, c, t, g, unknown or other
  modified_base (659)..(659): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgcttattttagaaggtgtccagtgcgaggagcagctggtggagtcgtgggggaggccgtggtccgaggccggggggtccctggagactctcctgtcgcccgcctctggactctacctttagancttagtggatgagcgtcgggtcccgccgaggccgtaccggaagggggaacggggcgtggggaggttggggtacggaccgaaacgaaagtaaaagggaaggaagttagggaaaagtacaaaacgaaaacctacgttagtcggtagggtacttcgtaggtacgggaaacgggggccctatttcccgaacctatacccgtaccgaaggaacgaacccaaaccggtaacccaaaaggtaaacctttcgaaaggtttcgtaaatttcccgtaaaggaacctaaaagttacggaaaaccacggtcccgttaaaggaaacgggaccggaccggggaaacggaccggaaccgggttccggttagttaacgtttacgngggttaggtagacgggaactactaggtaacggaacggaaccggttacggaaaccggttaaacggggtggggtttatacggg

SEQ ID NO: 370371 - DNA, 734 bp, Homo sapiens
  misc_feature: GZ8MTXP02JREE3.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtggttttccttgttgctattttagaggtgtccagtgcgaggagcagctggtggagtcgtgggggacgccgtggtccgagggcccggggggtcctggagactcctcctgtcgccgcctcgtggacctctacctttagtagtctattggatggagtcgtggggtccccgcgacggtcctaccggaagggggaacggggcgttggggaggtcggggtcggaccaaacgaaagtaaaaggaagagtacgggaaagtacaaagaaaacctgtaagtggtcgtacttcgtgggtaggaacggggtccgtaacttcccaaaccctacgttcccacccgaaggaacggaaacccaaaccggacccaaaaggtaaactttacgaaggtttcgttaaactcgttaaggaacctaaaagttacgaaaaccgagtacccgtaaggaacggtacggaccgggaacggtaccgaaaccgggtccggtttagttacgttacgttcgggtagaacggacggtaagtaccgagtaaggaaaaccgtaacggggttaaggaaccgggtaaccgggggttaagggggtacgttacgggg

SEQ ID NO: 370372 - DNA, 670 bp, Homo sapiens
  misc_feature: GZ8MTXP02JU1TK.15.23.C01.1.454.CMB.2.raw
  modified_base (325)..(325): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcgtgggggaggccgtgggtccgagggcccggggggtccctggacgactctcctgtcgccgcctctggactctaccttagtacgctagttggatggacgtcgtcggggtcccnccgaggtcctacccggaaggggaacggggtctaggggaggtcggggtcgacccaaacgaaagtaaaagggaagagttacgggaaagtaccgaaagaaaactacgtaagttgtggtaccttcggtaggtaggaacggggcctattaccacctatcctacccgagaacgaaccaaaccgaccgtaaagtaacttagagtagttaactgtacgaactaaagtacgaacgtaacgccgtaggacgacggaccggaacggaccgacgggtcctagttactacgtggagtacgacgacgaactagtaacgaaacgtacggacgtaacggtaacggggtaggggtatacggg

SEQ ID NO: 370373 - DNA, 802 bp, Homo sapiens
  misc_feature: GZ8MTXP02JAHH9.15.23.C01.1.454.CMB.2.raw
  modified_base (194)..(194): a, c, t, g, unknown or other
  modified_base (314)..(314): a, c, t, g, unknown or other
  modified_base (377)..(377): a, c, t, g, unknown or other
  modified_base (521)..(521): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgtgctatttagaggtgtccagtgcgaggancagcgtaggttggacgtcgtgggggacggccgtggtcccgacggggcccgggggggttccctaggacgacctccgttcccgtggtcggcccgtcctacgtcggacccttctaccgtttanacgtaccgttagtaggtatcggagtccgttcgggccacgcggcctccggaaggggacccgggntggggacgtggggtacgacaaacgaagtaaacggaagtagtaacggggaatacccgaaaagtaaaaccctagttacgtagggtcgggtaacccttcggaggttacggggaacgggttccctaatttacgaccctaacgttcccncgaacggacgaaccgaacggaaccctaaaggttaacccttcgaaggttctacgttcctaaggaattaaggaactaacgacccgacgtttaagggacggaccggttaaccggaaccgggtaaacgtacccccggtcgtttaaaggtaaccctttacgggtcggttacgggttaaacgaccggggttaaaaccacggttaaggaacgttaaacgggggtaaacggttaacccgtaaaggggtttaaaaccccgggggtagggggtttaaaacccgtttcgggg

SEQ ID NO: 370374 - DNA, 653 bp, Homo sapiens
  misc_feature: GZ8MTXP02H60NR.15.23.C01.1.454.CMB.2.raw
  modified_base (198)..(198): a, c, t, g, unknown or other
  modified_base (412)..(412): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgcttattttagaaggtgtccagtgcgaggancagctggtggagtcgtgggggaggccgtgggtccgaggccgggggggtccctggacgactctccgtgtcgcccgcctctggactcaccttagtagctattggatgagctggtccgccagggctccgaggggaaggggcgtgggaggtggggtggaccaaacgaagtaaaaaggagagtaggaagtacgaagaaaacataatcggtaggaccttntgttagggaacggggcccgatttaccaacctaatccctacccgaaggaacgaaccaaaccggaacccaaaaggtaaactttccaaggttacgtaaattctaaaacctaaaattaaggaaacagtacccgtagaaacgacgaccggaaggaccgaaccgggccgtagttaacttagttagtgtagagagacagtacgaaccgaacggtagaacgtaaaaccggggtggggttaacgagttgg

SEQ ID NO: 370375 - DNA, 642 bp, Homo sapiens
  misc_feature: GZ8MTXP02JJQRV.15.23.C01.1.454.CMB.2.raw
  modified_base (317)..(317): a, c, t, g, unknown or other
  modified_base (534)..(534): a, c, t, g, unknown or other
  modified_base (588)..(588): a, c, t, g, unknown or other
  modified_base (637)..(637): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccggggggtccctggagacctctccgtgtcgccgcctcgtggacctctacctttagtacgctagttggatgagtctgggtccnccaggcctccgaggggacggctgggaggtgggtcgaccaaacgaaagtaaaagggaagtagtacggaagtacaagaaacctataagtcgtggaccttcgtaggtacgggaaacgggcccgtattaccgaaccctattccctacccgaagtacgaaacccgaaacgtacccaaaaggtaaacttcaaagtttgactcgtagaacgtaaatcgaaaacngtaccctagaacgacggtaccgaaggacccgtacggcgttagtacttcgtaggngtacgagacgtacagtcgaaacgtaggaccgtagtaaccggggtaggtntaagg

SEQ ID NO: 370376 - DNA, 607 bp, Homo sapiens
  misc_feature: GZ8MTXP02GA2ZK.15.23.C01.1.454.CMB.2.raw
  modified_base (315)..(315): a, c, t, g, unknown or other
  modified_base (359)..(359): a, c, t, g, unknown or other
  modified_base (401)..(401): a, c, t, g, unknown or other
  modified_base (473)..(473): a, c, t, g, unknown or other
  modified_base (497)..(497): a, c, t, g, unknown or other
tcagtctacgtagccacgaccggtgctcgatttagtacacgtgattagggattgggagggtctcagagaggagccttagccctggactcccaaggcctttccacttggtgatcagcactgagcacagaggactcaccatggagttggggctgagctgggttttccttgttgctattttagaaggtgtccagtgcgaggagcagcgtggtggagtcgtgggggagccgtggtccaggccgggggggtccctgagactctcctgtcgccgcctcgtggactcacctttagagctagttggatgagtctggggtcccncagggcctccgaggggaaggcgtggaggtgggtggaccctaaanaagtaaaaggaacagtaccggaatcaaagaaaacatagtggngcctgtgtagaacgggccgtaattccgaacattccaccgaagacgactaaaccgcaaagaattccgaagttntaatcgtagacaaaagtgaaaacncgtcgagacgacgcggaaggtaccgacggtcttagtactacgtggtagagaccgaagtctaagtaacggaaactaacgggtacgaaacgggtaacggggtaggttacgag

SEQ ID NO: 370377 - DNA, 678 bp, Homo sapiens
  misc_feature: GZ8MTXP02JLE91.15.23.C01.1.454.CMB.2.raw
  modified_base (275)..(275): a, c, t, g, unknown or other
  modified_base (531)..(531): a, c, t, g, unknown or other
  modified_base (554)..(554): a, c, t, g, unknown or other
  modified_base (653)..(653): a, c, t, g, unknown or other
  modified_base (674)..(674): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgttgggttttccttgttgcttattttagaaggtgtccagtgcgaggagcagcgtggtggagtcggtgggggagtccgtggtccgagggcccggggggtcctgagctctctgtcgccgcctcnggactctacctttagtagctagttggatggagtcgtcggggtcccgccgagggtccctccggaagggggaacggggcgtaggggacgggtcggggtacggacccgtaaagaaagtaaaaggggaagagtacgggaaagtcaaagaaacctataagtggtggactcgtaggtacgaacggggtccctagttacccaacctctacccgtaccaagaccggaaacaacccgaccaaagtaacttcgaaagtcgttaaancgtagtaacaaagtaggaacccngacccgtaggacggacgtaccggaaggaccgaccggtaccgttaacgtttagttacctgggtagtacggacgaagactagaacgacgtaaccggggtanaacggtaacggggtagggttntagg

SEQ ID NO: 370378 - DNA, 700 bp, Homo sapiens
  misc_feature: GZ8MTXP02GQPWU.15.23.C01.1.454.CMB.2.raw
  modified_base (395)..(395): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcgtgggggaggcctggtccgaggccggggggtccctgacgactctcctgtcgcccgcctctcggactcacctttagtagctagttggatgagcgtgggtcccgccgaggctccgaggggaaggggctgggaggtggggtggccaaacgaagtaaaaggaagagtaggaagtacaagaaaacnctagtagtggactcgtggaggaacggggcccgtaagttcccaacccgtattaccctacccgaaggaacgaaacccgaaaccggaccccaaaagtaaccgtttacgaacgttggttaaacttccgaaggtaaccctaaaagttacggaaaccaacggtaccccgttaggaacgggaacgtaacccggggaacggaaccgaccggggtaacccgttggttaaacgtttacgtacgggttgtacgaacggtagaactagtaaggacgtaacggttagaacggttaaaccgggtagggggttcgtaagg

SEQ ID NO: 370379 - DNA, 648 bp, Homo sapiens
  misc_feature: GZ8MTXP02HHXWK.15.23.C01.1.454.CMB.2.raw
  modified_base (294)..(294): a, c, t, g, unknown or other
  modified_base (637)..(637): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcgtgggggaggccgtggtcccgaggccggggggtccctgacgactcctcctgtcgcccgcctctggacctcaccttagtanctagttggatgagtcgtgggtcccgccgaggcctccggaaggggaacggggcgtagggaggtggggtcggaccaaacgaaagtaaaaagggaagtagtaggggaaagtaccaaagaaaactactagtggtcggaccttcgtaggtacggaacggggccgtaatttcccgaccctattcccgacccaagaacgaacaacgaccaaagaattcaagttgtaatccgtagaacctaaagtacgaacgtacgcgtacgagacggaccggaggaaccgacggtccgtagttacttacgtgtagtagaacgagtacagtaagaaccgtacggtagaaacggtacggggngggtttacagg

SEQ ID NO: 370380 - DNA, 786 bp, Homo sapiens
  misc_feature: GZ8MTXP02GKD7B.15.23.C01.1.454.CMB.2.raw
  modified_base (342)..(342): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgtcttattttagaaggtgtccagtgcgaggagcagcgtgggtggaggtcggtgggggacggtccgtgggtccgacggggcccgggggggtccctggacgtactcctccgtgtcgcccgtcctcgtcggaccttctacctttagtagcttagtcggatgaggcgtcgggtcccncgagggcctacccggagggggaacggggtcgtagggtagggtggggtacggaccaaaacgaaaggtaaaagggaagaagtacggggaaactacgaaaaggtaaaaccagttaacgtgggtacggtaccttcggttaggggtaacggggaaccgggggcccgtaaacgtttacccgaaaccctaaagtttcccccgacgaaaacgggaacgtaaacccgaaaacccggacccgaaaaggttaacttaccgagttacgttacttcgaagtaaacgaaatacgaaacgtcgaccgtagggaaccgacgggttaccggacgggtaacccgaccggggtacttaggggtttaaccttaggtggttacggacggaagggtaacgaccttagtaaccggaaaacggtacggtacggtaaaccggggtacggggtaggggtttaacgacggg

SEQ ID NO: 370381 - DNA, 639 bp, Homo sapiens
  misc_feature: GZ8MTXP02FLZZL.15.23.C01.1.454.CMB.2.raw
  modified_base (285)..(285): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatgggagttggggctgagcgtgggttttcctgttgctattttagaaggtgtccagtgcgaggagcagctggtggagtcgtgggggagccgtggtccaggccgggggggtccctgagactctcctgtgccgctctggactcaccttagtanctatggatggagcgtgggtcccgcgaggcctaccggaggggaacggggtctggggagtggggtacggacctaaacgagtaaaagggagactagggaacgtacaaggaaacagtaagtggttggaacctgtaggtaggaaacggggcctaaagttccaaccctatcccgtaccgagacgaccaacgaccaaagtaacttacagttgtacgtctagaacaaatacggaaacacgtccgtaaggacgacggtaccggagaccgacggtacgtagttacgttacgtggtaggtacgagtaacgacgtaagtaacgtaacgtaacggtacggtaaggtaaccgggtgggttacgtaacg

SEQ ID NO: 370382 - DNA, 708 bp, Homo sapiens
  misc_feature: GZ8MTXP02I9U4T.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcggtgggggagccgtggtccgacgggcccggggggtcctgagctctccgtgtcgccgcctcgtggacctctacctttagagtcttatggatggcgtcgtcgggtcccgccgacggtccgtaccggaaggggacggggtcgtaggggacggggtggggtacggaccctaaaacgtaaagtaaaagggaaagtacggtaggaacgtaacaaacgaaactacgtagttcggtgtacctcgtgtaggacgggtactacgttcccaaccgtactcctaccgaagacgaacccaaaccgaccgtaaagtacttacgagttcgtactacgtagaactaacgtacgaaaccgaccgtaccgtaggaacggaccggaaccgggacggaccgtaccggggtacccgtttaggtttacgttacggttaggtaggtaggacgtaacgtacgtaagtaacgaacggtaacggtacgtaacgggtaaaccggggtagggttacgtaggg

SEQ ID NO: 370383 - DNA, 627 bp, Homo sapiens
  misc_feature: GZ8MTXP02FHRWX.15.23.C01.1.454.CMB.2.raw
  modified_base (620)..(620): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggtttcctgttgctatttagaggtgtccagtgcgaggagcagctggtggagtcgtgggggaggcctgggtccgaggccgggggggtccctggagactctcctgtgcccgctctggactctacctttagtagctatggatgagcgtgggtcccgcgaggcctccgaggggaggggctgggaggtcggggtggaccaaacgaagtaaaagggaagtagtaggaagtacaagaaaccactagtaggtggtaactcgtggtacgaacggggtcctattccaacctaatcccgtacccgaagacgaaaccctaaaccgacctaaaaggaactttcgaagggttactaatccgagaactaaaagtcgaaaacctagcccgtaggaacgacggaccggaggaacgtaccggtcgtagtaacttcgtggtgtagaagacgactagcgaaacggagtagaacgtaaaccgggggnggtatag

SEQ ID NO: 370384 - DNA, 624 bp, Homo sapiens
  misc_feature: GZ8MTXP02GU3U2.15.23.C01.1.454.CMB.2.raw
  modified_base (311)..(311): a, c, t, g, unknown or other
  modified_base (590)..(590): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccgaggccggggggtccctggagactctcctgtcgccgcctctggactcacctttagagctattggatcgagcgtgggtcccnccgagggtcctccggaaggggaacggggcgtggggtaaggtcggggtacggacccaaagtaaagtaaaaggaagagtacggggaaagtacaagaaaactcgtaagtgcgggtaactcggtaggtagaacggggcctaaatccaacattaccgacgaagtacgaaccgaacaccgaaagtaacttcgaagtagtaaccttgtacgaacgaaagtacgaacgcgacgaggacgacggacggaggaccgtacggtcgtaagtacgtagtgtgacgagacganagtaacgacgacggtagagtaacggtgggtatag

SEQ ID NO: 370385 - DNA, 707 bp, Homo sapiens
  misc_feature: GZ8MTXP02JGWCE.15.23.C01.1.454.CMB.2.raw
  modified_base (417)..(417): a, c, t, g, unknown or other
  modified_base (433)..(433): a, c, t, g, unknown or other
  modified_base (517)..(517): a, c, t, g, unknown or other
tcagtctacgtagccacgaccggtgctcgatttagtacacgtgattagggattgggaggtctcagagaggagccttagccctggactccaaggccttttccacttggtgatcagcactgagcacagaggactcaccatggagttggggctgagcgtggttttctgtgctatttagaaggtgtccagtgcgaggagcagctgggtggagtcgtgggggacgccgtggcccgagggcccgggggggtccctggaagctccgtcctggtcgccgcctcgtggactcgtactttagacgtctagttggactgacgtcgttcgggccgaccgaggggtcccgtaccgggggaagggtcgtggggaggtggggtccgacctaaaagaagtaaaaggaagtagtaggaaacgtcaaagaaactntaagtggtgacttcgnggtacggaacgggcctattaccactactactacccgaagacaaccgaaacgacctaaaagaacttacgtagggtaccgtttaanacgtagaaacgtaaacgtaaacgacgtacgtccgaaggacggaaccggacggtaacgaaccgggtacgtacgttaagttacgttacggttaggtacggaacggtaacgaaccgtacgttaacgaaacggtaaaaccgtaaacggggtaacgtaaacggggtaacggggtacggggttacgtaaggttcgg

SEQ ID NO: 370386 - DNA, 821 bp, Homo sapiens
  misc_feature: GZ8MTXP02FIZHZ.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcgtggtttcttgtgctattagaaggtgtcagtgcgaggagcagcgtggtggagttcggtgggggacggccgtgggtccgacggggtcccgggggggtccctggacctacctcctccgtggtcgcccgcctctggtacctcgtaccgttttagtagtcttagtttggattgagtccgtgggtcccgccgaggccgtaccggaggggaacggggctaggggtaggtgggggtacggacccaaaacgtaaagtaaaaagggaaaggtagttaaggggaaacgttacgaaaacggtaaaactacgtaagttcgggttacggaaccgttcgtagggtaacgggaacggggtacgtaactttacccgaaacctacgtacccgtaccgaaagaaacgaaacccgaaccgtaacccgaaaagttaacttacggaaagttagttaacgtacgtaaggaaccttaaaagccgaaaaacgggtccgtaaccggtaaggacgggaaaccgggaccggtaaacggggaaccgtaaccgggggttccgtttaaagtttaaccggtttagttaacgggttgggaacggtaaagggaaactaacgtaaagtaacgggaaaccggtaaaacgggggttaaggaaacccggtttaaaaacggggggtcgggggtttagtttaaacggg

SEQ ID NO: 370387 - DNA, 717 bp, Homo sapiens
  misc_feature: GZ8MTXP02G24KZ.15.23.C01.1.454.CMB.2.raw
  modified_base (624)..(624): a, c, t, g, unknown or other
  modified_base (663)..(663): a, c, t, g, unknown or other
  modified_base (690)..(690): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggagccgtggtccgacgggccggggggtccctggacgacctctccgtgtcgccgtcctcgtcggactctacctttagtagtcttagttggatgacgtcgtacggggtccccgccgaggccgtacccggaggggaaggggtcctggggaaggttcggggtacggaccaaaacgtaaagtaaaagggaagtaagtacgggaaagtaccgaaaggtaaacctagttaagttagggtgggtaacctcgttagggtacgggaaccgggaccgtaacttcccgaaactacttccctaaccgaaggaaaccgaaccgaaaccgacctaaaaggtaactttcgaagttgttaaacctgacgaaactaaagacaaccgagtcccgtaagacgacgggtaacccgaggttaacccnccggggtacttacgttaagtacgttggtggagacggaanaacgtagtaacggaaacgtaaggggtntaaacgggtacggggtaaggtgtaagg

SEQ ID NO: 370388 - DNA, 638 bp, Homo sapiens
  misc_feature: GZ8MTXP02GFR9Y.15.23.C01.1.454.CMB.2.raw
  modified_base (311)..(311): a, c, t, g, unknown or other
  modified_base (391)..(391): a, c, t, g, unknown or other
  modified_base (474)..(474): a, c, t, g, unknown or other
tcagtctacgtagccacgaccggtgctcgatttagtacacgtgattagggattgggaggtctcagagaggagccttagccctggactccaaggccctttccacttggtgatcagcactgagcacagaggactcaccatggagttggggctgagctgggttttccttgttgctattttagaaggtgtccagtgcgaggagcagctggtggagtcgtgggggaggcctgggtccgaggccgggggggtccctggagacctctcctgtgccgcctctggactcacctttagagctattggatgagctgggtccncaggctaccgaggggaaggctgggacggtggggtgcccaaagaagtaaaaggaacgagtacgggaaatcgaaagaaaacncgtaatgtgggaacctgttagacgaagggccgattacaaccgatcctacaagacgaaacaaccgaccaaagaaacttcagttntaaactgtacgaactaaatcgaaaacaggacccttaggaacgacggacccgaagggaaaccgtccgggtcccggtagtaacttaacgtggtagtaacggaggaaacgacaaagtaagaacgtaaacggggtaagaacgttaaaaccgggggagggtttagtaag

SEQ ID NO: 370389 - DNA, 717 bp, Homo sapiens
  misc_feature: GZ8MTXP02FUYE5.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtgggggaggccgtggtccgagggcccggggggtccctgagctctcctgtcgccgcctctggactcacctttagtagcttattggatgagcgtgggtccgccaggcctccgaggggaacggggctgggagtgggtggccaaacaagtaaaaggaagagtagggaaagtcaaaggaaaaccactaagtgtgggacctcgtggtacggaacggggtcccgtatttcccaaacctacgttaccctacccgaaagtaaccgaaaccgaaaaccgacccgtaaaaggtaaactttccaaagttcggttaaattccgtagaacccaaaagttacgaaaaccgacggccctaggaacggacgaaccccgggaaggggaacccgaaccggggtcccggttattaacgtttaaccggtcgggttaggtaggtaagaacgtaccgtaagttcgaaaaaccggtagggttaaacgaaacggtttaaaaccgggggtaagggggtttataacgggg

SEQ ID NO: 370390 - DNA, 561 bp, Homo sapiens
  misc_feature: GZ8MTXP02F3BA9.15.23.C01.1.454.CMB.2.raw
  modified_base (464)..(464): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccggggggtccctgagactctcctgtgccgcctctggactcaccttagtagctattggatgagctgggtccgccaggctccgaggggaaggggctgggagtggggtcggaccaaacagtaaaaggaagatagggaaagtcagaaaacactatgtggactctgtgaagggccattccaccatctccagacacaacgccaaagaattcagtgtaatctagcaaaatgaaacngccctagagacgccgaaggacacgggcctagtatactgtgtagacgacgacagtaacgaactaacgggtagaacgtaaccggggagggttagtaacg

SEQ ID NO: 370391 - DNA, 733 bp, Homo sapiens
  misc_feature: GZ8MTXP02GJUJ1.15.23.C01.1.454.CMB.2.raw
  modified_base (183)..(183): a, c, t, g, unknown or other
  modified_base (213)..(213): a, c, t, g, unknown or other
  modified_base (264)..(264): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccatgttgctattttagaaggtntccagtgcgaggagcagctggtggagtcgngggggagcctggtccaggccgggggtccctgagactctcctgtgccgcctntacgtactcctaccgtttagagtctatggatgagctgggtccccacgaggtctaccgaggggaaggggtcgtgggaggtggggtacggaccaaacgaagtaaaaggggaagtagttaggggaaacttaccgaaggtaaaacctcttaagtcggggttaagggacccttacggtagggttaacggggaaacgggggtaccccgtaagttttcccgaaaccctaaacgtttccctaaccccggaaaggttaaaagaaccccttaaaaccccggggccttaaaaagggaaccttttacgaaagtttaggttacccttaggttacggaaaccaaaagttcgggaaaacccacgttccgaggaacggacgacccggggaagaccggttaaaccggccgtttaggttaaacttccgtgtagtcgaaggtacaagaagtaccgagtaaaccggtgaaaactacgggggagtttagg

SEQ ID NO: 370392 - DNA, 614 bp, Homo sapiens
  misc_feature: GZ8MTXP02FMEG5.15.23.C01.1.454.CMB.2.raw
  modified_base (299)..(299): a, c, t, g, unknown or other
  modified_base (500)..(500): a, c, t, g, unknown or other
  modified_base (517)..(517): a, c, t, g, unknown or other
  modified_base (542)..(542): a, c, t, g, unknown or other
  modified_base (560)..(560): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgcttattttagaaggtgtccagtgcgaggagcagctggtggagtcgtgggggaggccgtggtccgacgggcccggggggtccctggacgactcctccgtgtcgcccgcctcgtggacctctacctttagacnctagttggatgagtcgtgggtccccgcaggcctccggaggggaagggtctaggggagtggggtacgaccaaacgaagtaaaaggaaagtagtagggaagtacgaaagaaacctacgtaatggtcggacttcgtaggtaggaacgggccgtatccaacctattcccacgagacaacaacgcaaagtacttcgaagtcgttancgtagaacaagtcaacngaccctgaagcgtacgaggtaaccncgggtactagttatacgngtagacgacgagactagaacgaaacgtaggagaacggtaacgggtggttagacg

SEQ ID NO: 370393 - DNA, 701 bp, Homo sapiens
  misc_feature: GZ8MTXP02I51O1.15.23.C01.1.454.CMB.2.raw
  modified_base (655)..(655): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttccttgttgcttattttagaaggtgtccagtgcgaggagcagcgtggtggaggtcggtgggggacggtccgtgggtcccgacggggcccgggggggtccctggacgacctccgtccgtggtcgcccgcctcgtcggactccacctttagagctagttggatgacgtcgtcgggtcccgccgaggcctccggaaggggacggggcgtggggaggtggggtcgaccaaaacgaagtaaaagggaagtagtacgggaaacgtacgaaaacgaaaactacgtaagtcggtcgggtaacttggtaggtacggaaacggggtccgtaattcccaaccgtacttcccgtaccgaaagaacgaacccgaaacgacccgtaaaagtacgttaacgaggtagttactacgtacgaaccgtaaatacgaaaccgacgtaccgaggaacgacggaccggacggaccgtacggtccgttagtacttacgtggtagtacgagaacgtnagtaacggaacgtaggtacgtaacggtaacgggtagggttactagg

SEQ ID NO: 370394 - DNA, 663 bp, Homo sapiens
  misc_feature: GZ8MTXP02IKBBB.15.23.C01.1.454.CMB.2.raw
  modified_base (217)..(217): a, c, t, g, unknown or other
  modified_base (260)..(260): a, c, t, g, unknown or other
  modified_base (268)..(268): a, c, t, g, unknown or other
  modified_base (279)..(279): a, c, t, g, unknown or other
  modified_base (282)..(282): a, c, t, g, unknown or other
  modified_base (299)..(299): a, c, t, g, unknown or other
  modified_base (622)..(622): a, c, t, g, unknown or other
tcagtctacgtagccacgaccggtgctcgatttagtacacgtgattagggattgggaggtctcagagaggagcccttagcccctggactccaaggcctttccacttggtgatcagcactgagcacagaggactcaccatggagttggggctgagctgggtttttccttgttgctattttagaaggtgtccagtgcgaggagcagctggtggagtcgngggggaggcctggtccgaggccgggggtcctgagactctctgngccgctcngctcacttagnctntgatgagcgtggtcccncgaggccctaccgaggggaacggggcgtggggaggtcggggtacggacccaaagtaaaggtaaaaggaaaggtagtaccgggtaaaagtaccgaaaacgtaaacctaacgttaaagtcgggttacggggtaacctttacggtagggtaacgggtaaacgggggtcccgtaagttaccccaaacccttgtaccctcgaaaggaacgtaacccaaacgaccctaaaagtacttacgaagtgtaactctagactaaatacgaacagtccgagagcgaaccgaggtaccgacggtcgtgttaaagtcgtggttagacgagacgtaanagtaacgaacgtaaggtacggaacggtacggtaggtactag

SEQ ID NO: 370395 - DNA, 696 bp, Homo sapiens
  misc_feature: GZ8MTXP02FUD7J.15.23.C01.1.454.CMB.2.raw
  modified_base (548)..(548): a, c, t, g, unknown or other
  modified_base (580)..(580): a, c, t, g, unknown or other
  modified_base (683)..(683): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctgggtggagtcggtgggggacggccgtggtccgagggccgggggggtccctggacgactccgtccgtgtcgcccgtcctctcggactcctacctttagagtcttagtggatgacgtcgtcgggccgccgaggcctccggaaggggacggggctgggaggtggggtcggacctaaacaaaggtaaaaggaaagtagtagggaaactacgaaaagtaaaactactagtggtcggaccttcgtggtaacggggaacggggtccgtaacttaccaaccctacgttacccctacgaaacggaaacgaacccgtaaaaccggacccaaaaggttaacttacgaaaggttnttaaattccgaggaaacctaaatcgaaaaccnggacctaggaacgaggaccggagaacggcggtacgtaggttacttaggtgtagtacgagaactacgaagtaacgaacgaacggttaggaacggttaacggggnggttacgtaaggg

SEQ ID NO: 370396 - DNA, 671 bp, Homo sapiens
  misc_feature: GZ8MTXP02FO038.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggagcctggtccgaggccggggggtccctgagctctcctgtcgccgcctctggctcacctttagagctattggatgagctgggtccgcaggcctccgaggggaggggctgggaggtgggtggaccaaacaagtaaaaggaagagtaggaaagtccaaagaaaaccatagtgtcggactcgtggtagaacggggccgtattccgaacctatccctaccgaagacgaaaccaaccgaccaaagtaacttcgagttgtatacgtagaactaaatacgaaacgtacgacccgtaggaaacgacggacccgaacgggaaccgaccggggtacccgttaggttaacgtttaacggtggttacggttaacggagtaacgaaccgtaagtaaggaaacccggtaaaacgggtacggtaaaacgggttaaaacccgggggtagggggtttacgttaaagggg

SEQ ID NO: 370397 - DNA, 628 bp, Homo sapiens
  misc_feature: GZ8MTXP02HOUZS.15.23.C01.1.454.CMB.2.raw
  modified_base (287)..(287): a, c, t, g, unknown or other
  modified_base (311)..(311): a, c, t, g, unknown or other
  modified_base (392)..(392): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcgtgggggagcctggtccgaggccgggggtcctgagctctcgtgtcgccgcctcgtggactcacctttagtacnctagttggactgagcgtgggtccnccgaggcctaccgaggggaggtctgggagtgggtcggaccaaacgaaagtaaaggaagagtacgggaatcgaaagaaactntaagtggtggactcgtgtacggaacgggcccgtattcccgacagtcctacgaaggacacgaaacgccaaagtaacttcgaagtgtatcgtagaacaaatacgaaactacgccgtaggacgacggcgtaacggaccgaccgggaccgtgttaacgttacgtcggtagttacggacgaagacagttaacgaaacgtaacgggtacgaaaggttaaccgggagggggtttactaacggg

SEQ ID NO: 370398 - DNA, 566 bp, Homo sapiens
  misc_feature: GZ8MTXP02IT4E3.15.23.C01.1.454.CMB.2.raw
  modified_base (416)..(416): a, c, t, g, unknown or other
  modified_base (427)..(427): a, c, t, g, unknown or other
  modified_base (565)..(565): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggtggccgtggtccaggccgggggggtccctggagactctctgtgccgcctctggactcacttagagctatggatgagctggtccgcaggctccgaggggaggctggagtgggtgccagataaaggagagtggaagtcaaggaaacactaagtgtgggacttcgtagtaggaaggggcccgagttcccgactacttacncccgaaagganaaaccgtaacgaccctaaagaacttcgagtacgttatacgtgactaaaagtcgaaacacgctaggagcgacgaggactaggcctgttactatgtgtacgagacacagaagacgtaacggtagacggtaacggtgtagng

SEQ ID NO: 370399 - DNA, 691 bp, Homo sapiens
  misc_feature: GZ8MTXP02H1F9A.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtggagtcgtgggggaggccgttgggtccgagggcccgggggggtccctggacgactcgtccgtgtcgcccgcctcgtcggaccttcacccttttagtacgccttagtttggatggagtcgtcggggtcccgccgaggcctcccggaaggggaaggggcgtgggaggtgggtcggaccaaacagtaaaacggaagagtagggaagtaccaaggaaaacctacgtaagttggcgggtaactcgtaggtacggaaacggggcctatttacccgaaaccctatacccgtaccgaaggaacgaaaccgtaaaccgacccaaaaggtaacttacgtagttcgtatcctaaggactaaaatgaaaacgcgcccgtaggaagaccggaccggaacggacgtaccgggccgttagtagtttacgtggtagtagacgagtaaccgagtaacggaaccgaaaggtcgaacggtaaaccgggtgggggtttaacagg

SEQ ID NO: 370400 - DNA, 733 bp, Homo sapiens
  misc_feature: GZ8MTXP02I7WA3.15.23.C01.1.454.CMB.2.raw
  modified_base (309)..(309): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctgggtggagtcgtgggggagcctgggtccgaggccgggggggtccctggagactctcctgtcgccgctctggactcaccttagtagctatggatgagcgtcggtccnccaggctaccgaggggacggggctggggagtcggggtggacccaaagaagtaaaagggaaagtagtagggaaacgtcaaaattaaaccacgttatggtggaacctcgtggtaggacggggtaccctattacccaaactcttacccgcaaacggacgaaaccaaacccgttacccgaaaaggttaacctttaccgaaggttaggttaaactttccccgtaaaggtaaacccaaaagttacccgggaaaacctacggtacccccgtaggggaaaggacccggttaaacggggaccgaaccggaacccggggtcccgttaagttaaaccgttccgtagggttacgacggacccgaaagtacccgtaaagtcccgaagtaaacggggttaccggagttaaaacccgggggtgggggtttactaaaggg

SEQ ID NO: 370401 - DNA, 685 bp, Homo sapiens
  misc_feature: GZ8MTXP02GIS4I.15.23.C01.1.454.CMB.2.raw
  modified_base (363)..(363): a, c, t, g, unknown or other
  modified_base (536)..(536): a, c, t, g, unknown or other
  modified_base (544)..(544): a, c, t, g, unknown or other
  modified_base (562)..(562): a, c, t, g, unknown or other
  modified_base (569)..(569): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtgggagtcgtgggggacggccgtgggtcccgacgggcccgggggggtccctggacgactcctccgtgtcgcccgcctcgtggactctaccttagtagctattggatgagtcgtcgggtccgccaggcctaccggaagggggaacggggcgtaggggnggtggggtcggacccaaacgaaagtaaaagggaaagagttaccggggaaagtaccgaaagaaaaacccagttaagttgggtacggaacttcgtagggtaggaacgggggcccaatttccaccctataccctacccaaggacgaaacaaacccgaacccgaaaagtaaacgttnaacggttntattacctagaataaagngaaacgnacccgtgacgacgtccggaaggacgaacgggtccgtagttaagttactaggtggtagacgaagacgtagtcgaaaccgtaagggtataaacggtaaccggggtagggtttacgagg

SEQ ID NO: 370402 - DNA, 943 bp, Homo sapiens
  misc_feature: GZ8MTXP02FKQC9.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggaggttggggctgagcttgggttttccttgttgcttatttagaaggtgtccagtgcgaggagcagcgtggtgggaggtcggtggggggacggccgtcgggtccgacgggcccgggggggtcctggagacctcgttcttggtcgcccgtcctcgtcggactcctaccgtttagtagtcttagtaggataggacggtccgtcggggtccccgccgagggtccgtaccgggaaggggggaacggggtcgtgggggaggtttcgggggccggaacccgtaaaacgaaaaggtaaaaggggaaagtaaggtaaggggtaaacgtaacgaaaaggaaaaaccttaccgttaaggttacgggttacgggaccgtttacggttggggtaaacgggggtaaacccgggggtacccccggtttaaagttcccccaaacccgttaccgtttaccccggttaacccgaaaacggggtaacccggaaaaacccgtaaaaccggaaaccccgtaaaaaggttaaacttttaccgaaacggttggtttaaactcccgttaaaggtaaaccctaaaacgtaacggttaaaccgaaccggtaccgttaacggggaaggtaaacccggggaacccggggtaacgggaaaccccggtacccggggttacccgtttaacggtttaaaggtttaccgtttacgggtaggggttaaacggagggtaaaccgtaggtaaacgttaacggaaaaccgggttaaacgggggtttaaccggaaaacggggtttaaacccggggggtaagggggtttacgggttaaacgggg

SEQ ID NO: 370403 - DNA, 687 bp, Homo sapiens
  misc_feature: GZ8MTXP02HRD49.15.23.C01.1.454.CMB.2.raw
  modified_base (430)..(430): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcttgggttttccttgttgcttattttagaaggtgtccagtgcgaggagcagcgtggtggagtcgtgggggagccgtggtccgaggcccggggggtcctggacgactctccgtgtcgcccgtcctcgtggacctctacctttagtagcttattggatggagcgtcggggtcccgcccgagggtccgtacccggaagggggaacggggtcctggggaggttggggtcggaacccaaacgaaagtaaaagggaaagtagtagggaaagtacaaagaaaaccntaagtggtcggtacctgtggtaggaacgggtccgaattaccacctatccacaagacgaacctaacgaccaaaagtactttacgagttagtatacgtagaaactaaaattcggaaacagcccgtaggaagaccggacggagaaccggtaccggtacgttagttaacgttaacgtggtggtaacggaacggaacgtaacgaagtaacgaacgttaaacggggtagtaaaaccgggttaacgggggtaggtttacgtagg

SEQ ID NO: 370404 - DNA, 682 bp, Homo sapiens
  misc_feature: GZ8MTXP02FYAWJ.15.23.C01.1.454.CMB.2.raw
  modified_base (678)..(678): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccagggccgggggggtccctggagactctcctgtgccgcctctggactcacctttagtagctattggatgagctgggtccgccaggctccgaggggaaggggctgggagtggggtggccaaacaagtaaaagggaaagatagggaaagtcaaagaaaacactaatggtgggactcgtggtaggaaaagggggtcccgtaaagtttccaaacccattcccttacccgaaagggaacgaaacccgaaaaccgccccaaaaaggtaaacttttccgaaaggttgttaaacttcgtaggaaccaaaaagttcggaaaacctagggaccccttagggaagacgggacccggaagggaaccgaccggggtcccgttagttactttaacgtggttagtacggaagaacgacaagtaagaaaccgaagggttcgaaacgtaaccggggaggggtttnaagg

SEQ ID NO: 370405 - DNA, 577 bp, Homo sapiens
  misc_feature: GZ8MTXP02JCBJP.15.23.C01.1.454.CMB.2.raw
  modified_base (383)..(383): a, c, t, g, unknown or other
  modified_base (388)..(388): a, c, t, g, unknown or other
  modified_base (526)..(526): a, c, t, g, unknown or other
  modified_base (571)..(571): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctgggtccaggccgggggggtccctgagactctcctgtgccgcctctggactcacctttagtagctattggatgagcgtgggtccgccagggctccgaggggaaggggctgggagtggggtggccaaacagtaaaaggaagatgggaaagtcaagaaacnctaanggtgggactcgtgtagaacggggccgaattcaaccatcctacccaggacacaacgccaaagacttcagtgtaatcctgactaaagtgaacagccgtagagagccgagaccagggccgtagtacttacgtgaggtaganaacggcagtaagaccgaaacggtgaacggtaaccgggaggggttntaaagg

SEQ ID NO: 370406 - DNA, 765 bp, Homo sapiens
  misc_feature: GZ8MTXP02JVJ8N.15.23.C01.1.454.CMB.2.raw
  modified_base (356)..(356): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggtttccttcgttgtctatttagtaaggtgtccagtgcgaggagcagcgtggtggagtcggtgggggaggcctggtccgagggcccggggggtcccgtgaggactcctcctgtcgccgtcctcgtgtactctacctttagtagtctattggatcgagcgtcgggtccgccgaggcgtccggaggggaagggtcgtagggnggtcgggtgaccaaacgaaagtaaaaggaggtacgtagggaacgtacgaaaggtaaaactacgagtttcgggacgttacggtactttacgggaggggtaccggtaccgtacttacccgaaccgtacctttaccgaccgtaacgaaccgaacgacccaaaccggaaattaacgacggtttagtaagttccgtaagttacccggaaaagaacccgtaaacgtaccgtacgtaccgtacggaaacggacgggaaccggtaccgggacccggttaaccggtaacgtttacgtttagttacggtacggtaggtaaacggaacgtaccgtaaacgtaaacggtaaccggtaaacgggtaaacccgggttaaacggggtaaacggggttaccggggttaaaggggtttacgtacgg

SEQ ID NO: 370407 - DNA, 892 bp, Homo sapiens
  misc_feature: GZ8MTXP02HC79T.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcgtgggggacggccgtggtccgacgggcccgggggggtccctggacgtacctcgtccctgtcgcccgcctcgtcggactcctaccgtttagtagcttagttggatggagtcgtcgggtcccgccgaggcctaccgaggggaacggggcgtgggaggtgggtacggaccaaacgaagtaaaagggaagagtacgggaaagtacgaaacgaaaaccgtacttagttaggtcgggtaccttacggttaggtaacggtaaaccgggggccttaaacgttaccctaaacccgtacttaccccgtaacccgaaaggtaaaccggtaaaacccgaaaacccggtaacccccgtaaaaaggggttaaaacctttaaccggtaaacgggtttaacggtttaaacgtttaccgttaacggtaaaaccgttaaaaacgtttaacggaaaaaccccgtaacggtacccgtttaaacgggaaacggggaaaccggtaaccccggggaaacgggaacccggtaaacccggggtccccggtttaaggtttaaaaccgtttaccggtttagggttacgggtaaggtaaacggtaaacgtaaccgtaaaagtccgggtaaaacccggtaaaacggggttacgggtaaaaccgggtttaaaacccgggggtacgggggttttaacggttaaacggg

SEQ ID NO: 370408 - DNA, 611 bp, Homo sapiens
  misc_feature: GZ8MTXP02GT3XW.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggtccgaggccgggggggtccctgagactctcctgtgccgcctctggacctcacctttagagctattggatgagcgtgggtccgccaggctccgaggggaaggggctggaggtgggtcggaccaaacgaagtaaaaggaaagagtacgggaaagtaccaagaaacactagtgtgggactcgtagtgaaacggggccgaattccgaacccattaccctacccgaagacgaacccaaacgcccaaagtaaacttcaagtgttaaatcctagactaaaataggaaaccagacccgtaggacgagacccggtaaggacacggaccgtgtattactgtgtagagagacataagacgaaacgggtgaacgtaaccggggaggggttataagg

SEQ ID NO: 370409 - DNA, 700 bp, Homo sapiens
  misc_feature: GZ8MTXP02IDBK3.15.23.C01.1.454.CMB.2.raw
  modified_base (365)..(365): a, c, t, g, unknown or other
  modified_base (410)..(410): a, c, t, g, unknown or other
  modified_base (426)..(426): a, c, t, g, unknown or other
  modified_base (635)..(635): a, c, t, g, unknown or other
  modified_base (689)..(689): a, c, t, g, unknown or other
  modified_base (696)..(696): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtggagtcggtgggggaggccgttgggtccgagggcccgggggggtccctggacgtactcgtcctggtcgaccgcctcgtggtacctctacctttagagctatggatgacgcgtgggtcccgccgaggcctaccgaggggaaggggcgtgggaggtgggnggacctaaacgaaagtaaaagggaagagtagggaaagtacgaaanaaaacgactaagtggngtaactcgtaggtagggaaacggggtccagttacccaacctatcccgtacccaaggaaacgaaacccgaaaaccggtacccgaaaaagtaaacgtttcaaagggtttacgaacttaccgttaaggaaccttaaaaagacgaaaaccgcgtaccgaggagggacccggtcgaaacgggaccaaaccgggggtcttaggtaactttacggngtagtagacgacgacagtaacgaaacgtaacggacggtaaacggtaaccggggngggttanacgg

SEQ ID NO: 370410 - DNA, 648 bp, Homo sapiens
  misc_feature: GZ8MTXP02FH1GS.15.23.C01.1.454.CMB.2.raw
  modified_base (466)..(466): a, c, t, g, unknown or other
  modified_base (489)..(489): a, c, t, g, unknown or other
  modified_base (492)..(492): a, c, t, g, unknown or other
  modified_base (575)..(575): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctggttttccttgttgctatttagaaggtgtccagtgcgaggagcagctggtggagtcgtggggggaggccgtgggtccgagggcccgggggggtccctggagacctctcctgtcgcccgcctctggacctcacctttagacgcttagttggatgacgtcgtcggggtcccgccgagggcctccggaaggggaacggggctaggggaggtcggggtcggacccaaaacgaagtaaaagggaaagtagtagggaaagtacaagaaactactagtgtggactgtggtagaacggccgtattcacctatccacaganaccaacgccaaagacttcgagtntanctaggactaaagtcgaaacacggtccctaggacgacggacccggaaggggtaaccctacggggcccgtttagtaacctttagnggttacgaggacgtacgactaagtaaggaaccgtaagggtacgaaacggttaaccgggggtgggttacgtagg

SEQ ID NO: 370411 - DNA, 750 bp, Homo sapiens
  misc_feature: GZ8MTXP02GAZJS.15.23.C01.1.454.CMB.2.raw
  modified_base (589)..(589): a, c, t, g, unknown or other
  modified_base (599)..(599): a, c, t, g, unknown or other
  modified_base (661)..(661): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgttgggttttccttgttgcttattttagaaggtgtccagtgcgaggagcagcgtgggtggaggtcggtgggggacggccgtgggtccgacgggccgggggggtccctggacgtactctccgtggtcgcccgtcctcgtcggtactctacctttagtacgtcttagttggatggacgcgtcgggtccgccgaggccgtaccggaaggggaacggggtcgtaggggacgggttggggtacggaacccgaaacgaaagtaaaagggaaagaggtaccggaaagtacgaaaagaaaacctagttaagtcgggtcggggtaaccttcggttaggtaacggggaacggggtccctaaagttacccaaacctacgttccctaaccgaaggaacaaccgaaaccgaccaaaagttaacttcgaagtctatccgtagaactaaanacgaaaccgngtacccgaggaaccgcgggaacccgagggttaacgccgggtacgttagttaaactttacggngtttacggaggaacgaacgtaacgaaggaacgtaaaccggaaaggggtttacgaaaccgggtttaaacgggggtgggtttaccgtaggg

SEQ ID NO: 370412 - DNA, 805 bp, Homo sapiens
  misc_feature: GZ8MTXP02JMU4Y.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagctggtggagtcgtgggggagccgtggtccgacgggccggggggtcctgacgactctcctgtcgccgcctctggactctacctttagagctagttggatggagcgtcgggtcccgccgaggcctccggaggggaacgggcgtggggaggtggggtcggaccaaacgaagtaaaagggaagagtacgggaacgtacaaacgaaaactacgtagttcggtacggacttcgtagggttaggaaacggggtcccgtaagtttcccaaacctagtttaccccacccgaaagggaacgaaaaccccgaaacccggaaccccgaaaaagttaaccgtttacgaaagggttatttaaaccggttctaaacggtaacctaaaaggttaccggaaaaccgaacggtacccgttagggaaacgggtaaacccggcccgggaaacggggaaccccggaaaccgtttccccggggtttaaagtttaaccgtttaaccggttggggttacgttaacggggtaagaaacggtaccaaaggttaacggaaaaccggttaaaaccggggtaggtaaaaccggtttaaacgggtacggggggtttaaggggttttaaccgg

SEQ ID NO: 370413 - DNA, 777 bp, Homo sapiens
  misc_feature: GZ8MTXP02FIB7X.15.23.C01.1.454.CMB.2.raw
  modified_base (190)..(190): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggtttccttgttgctatttagaaggtgtccagtgngaggagcagctggtggagtcgtgggggaggcctgggtccgaggtccgggggggtccctggacgactccttccctggttcgcccgtccgtcgtcggtactccacccttttaggaacgtcttagttgggaattggacggtcgttggggtacccgcccgagggcctacccggagggggaaacgggggtctggggaacggttggggtcggacccgaaaacgtaagtaaaaaggggaaagtaagtacggggaaacggttaccaaagaaaaccgacgttaagttgggttcgggaacttccgtagggttggaaacggggtaccctaagtttacccgaaaccctaattaccccgtacccgaaacggaacgtaaacccgaaaaccccgacccgtaaaaagtaaacgtttaccaaaggttacggttaaaactcgttaacgaaccgtaaaagtacgaaaaccgtacgaccccgttaaggaacgaacggaccggaaagggaaccgtacgggacccgtagtaacgtttacgtgtacggttagagaacgactagaacgtaaacgaacggtagtaacgtaaaccggggaggggttgtaacgg

SEQ ID NO: 370414 - DNA, 598 bp, Homo sapiens
  misc_feature: GZ8MTXP02HXQQK.15.23.C01.1.454.CMB.2.raw
  modified_base (383)..(383): a, c, t, g, unknown or other
  modified_base (471)..(471): a, c, t, g, unknown or other
  modified_base (476)..(476): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccgggggggtccctgagactctcctgtgccgcctctggactcacctttagtagctattggatgagctgggtccgccaggctccgaggggaaggggctggaggtgggtggccaaacgagtaaaaggaagagtggaatccgaagaaaacnctaatggtggactactggtagaacggggcattccacatctaccagagacaaacgccaaagaaattccatacgtatactgaactaaaangaacngcgagaggacgaccggaaggtaccgacccggtacgttagttaacgtttacgtggtacggtacgaagaacgtacaagtaacgaacgaacggtacggtaacggtaacgggtacggggtaggtag

SEQ ID NO: 370415 - DNA, 747 bp, Homo sapiens
  misc_feature: GZ8MTXP02F6130.15.23.C01.1.454.CMB.2.raw
  modified_base (293)..(293): a, c, t, g, unknown or other
  modified_base (320)..(320): a, c, t, g, unknown or other
  modified_base (658)..(658): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagcgtggtggagtcgtgggggaggccgtggtccacggccgggggggtccctggacgactctcctgtcgcccgcctctggactcacctttagtancttattggatggagcgtcggggtcccncgacggcctccggaaggggacggggcgtgggaggtcggggtcggaccaaacgaagtaaaacggggaagaagtacgggaaagtaccaaaggaaaaccaacttaactgggtcgggaccttcgtgggtaggaaacggggccctagttacccaccgtacttaccacccgaaggaaccgaaaccaaccggacctaaagtaactttccgaaaaggtcgtaattcgtaggtaaacaaaacgttgaaaaccgtcgaacccgttgaaggaaccgggaccgaaggggacccaaaccggggtcccgttagggttaacgttttacggtggttacggtagggtaaaaccgngggtaaaacctaggttaaccggaaaacccggtaaacgggtttacggaaacccggggtaaaccgggggttaaggggggtttcaaacgggg

SEQ ID NO: 370416 - DNA, 722 bp, Homo sapiens
  misc_feature: GZ8MTXP02IUBOA.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttcctgtgctattttagaaggtgtccagtgcgaggagcagctggtggagtcgtgggggaggccgtggtccgaggccggggggtccctgagactctcctgtgcccgcctctggctcacgttagtagctatggatgacgtcgtcggggtcccgccgagggtcctaccggaggggaacggggtcgtaggggaggttggggtcggacccaaacgtaaagtaaaagggaaagtagtaggaaacgtcgaagaaaaccatagtgtgggactcgtaggtagaacggggtccgtaagttccacctactacctaccaacgacggaaaccaaaccgaccgtaacgaaaaaaaattcgagtaggtaattacgtacgtaaacgaaaacttacgaaacgtaacgtacccgtaggaacggacggaacccggaacggaaccggaccggtacccggttacgttaagtttaccgtacggttacggttacggaacggtaagaaccgtaagtaacggaaccggtaaaccgggtaaaggtaaacggtaaacccgggggttaacggggttacgggtttaaacggg

SEQ ID NO: 370417 - DNA, 689 bp, Homo sapiens
  misc_feature: GZ8MTXP02JSVLJ.15.23.C01.1.454.CMB.2.raw
  modified_base (689)..(689): a, c, t, g, unknown or other
tcagtctacgtagccacgaccggtgctcgatttagtacacgtgattagggattgggaggtctcaggagaggagccttagccctggactccaaggcctttccacttggtgatcagcactgagcacagatgactcaccatggagttggggctgagcttgggttttccttgttgcttattttagaagtgtccagtgcgaggagcagctggtggagtcgtgggggagccgtggtaccgagggcccgggggggtccctggacgtcgtctccgtggtcgcccgtctcgtggacctctacctttagtagacctatggaatgagccgtacgggtcccacgaggcctaccggaaggggaacgggcgtgggaggtcggggtacgaccaaaacgaagtaaagggaatagtacggaaagtacaaagaaacctagtaatggtaggaacttcgtggtacggaacggggcccttaatcccgaaactcttccgaccggaagaacgaaccgaaaccggattaaaacggtaattcgaagtttagttacttacctaggaaacctaaaagtcggaaaaccctacggaccgaaggaacggacgaaccgggaagggttacccggtaccggtacgttagttagtcggttaggagacgaaacgctaagaacgacggaacgtaacgggtagaaccgggttacggggtaggtttn

SEQ ID NO: 370418 - DNA, 880 bp, Homo sapiens
  misc_feature: GZ8MTXP02H7RE7.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcgttgggttttccttgttgtcttattttagaaggtgtccagtgcgaggagcagcgtggtggagtcggtgggggacggccgtggtccgacgggcccggggggtccctggacgactcctccgtgtcgccgtcctcgtcggacctcctacctttagtagtcttagttggatggacgtcgtcgggccgaccgacgggccgtaccggaagggggaacggggtcgtaggggtacgggttggggtaccggaaccgaaaacgtaaaggtaaaaaggggaaagtaggtaaggggaaagtaacgaaaacgaaaaccgtaacgttaaggttcgggttacgggtaacccgtttacgttacggggtaaacgggggtaaaccgggggtccccttaaacgtttacccaaaccccgttaactcccccgtaaaccgaaggaaaacccggaaacccgtaaaacccgggtaaccctaaaaaagggttaacctttaaccgtagggttacttaaacgttcccgttaagaaacccgtaaaagttaccggaaacgtacgtaccggtaaggaacgggaaccggaacccggaacgggtaacccgtaccggggttacccgtttaggttaaacgtttaccggttaggtaggtaagggtaacgaacggtaacctaaaggttaacggaaacccgttaaaagggggtacggttaaaaccgggtaaccggggggtttagggggtttaaccttaaggggg

SEQ ID NO: 370419 - DNA, 697 bp, Homo sapiens
  misc_feature: GZ8MTXP02FY2D8.15.23.C01.1.454.CMB.2.raw
  modified_base (646)..(646): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggaggtcggtgggggaggccgtcggtccgacgggcccggggggtccctgacgacctctccgtgtcgcccgcctcgtcggactctacctttagagtctagttggatgagcgtcgggtcccgccgacggccgtaccggaggggacggggcgtgggaggtggggtcgaccaaagaaagtaaagggaagtagtacggaagtacgaaacgaaaactacgtaagttacgggtcggtactcgtagggtaacgggaacggggtaccgtacttaccgaaaccctacgtttcccgaaacccaaagggaccgaaaacccaaaccggaaccctaaaaggtaacttccgaaaagttgttaacgttaccaggtaaaccaaagtacgaaacgacgtacgacgaggacgaccgagaccgacggtacttagtactcgtggtaggagacggtacncgtaagaacggaacggtaaggtacgaaaggtaccggggtaggtacgtaagg

SEQ ID NO: 370420 - DNA, 685 bp, Homo sapiens
  misc_feature: GZ8MTXP02IKS1W.15.23.C01.1.454.CMB.2.raw
  modified_base (293)..(293): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccgacggccggggggtcctgagactcgtccgtgtcgcccgcctcgtcggacttctaccttagtancttagtgatgacgcgtcggtccgaccgaggcctaccggaggggaaggggtcgtagggaggttcggggcggacccaaacgtaaagtaaaaaggaaaggtaagtacgggaaaacgtacgaaagtaaaaccacttaagtacggtacggtaacttcggtaggtacgggaaacggggtcccgtaaacttaccaaacctatacctcgaaagacgaaccaaacgaccaaaagtaacttacgagttagtaactacgttacgactaaaatcgaaaaccagacgaggtaacggacggtaccggaaaggtaccgaaccggtcgtacgttacttacgtcgtagtacgagaacgaatagaacgaacgtaaacggtagaaacggtaacgggtagggttagtaacgg

SEQ ID NO: 370421 - DNA, 836 bp, Homo sapiens
  misc_feature: GZ8MTXP02FQKH6.15.23.C01.1.454.CMB.2.raw
  modified_base (369)..(369): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcttgggttttccttgttgcttattttagaaggtgtccagtgcgaggagcagcgtggtggagtcgtgggggaggccgtcggtccgacgggccggggggtccctgacgtactcctcctggtcgcccgtcctcgtacggacctcctaccctttagtacgtcgttatggatgagtcgtggtcccgccgacggtcctacccggaggggaacggggcgtagggngggtaggggtcggaccgaaaacgtaaagtaaaaagggaggaagtacggggaaaacgtccgaaaagtaaaaccaacgttagttaggtgggtacctcgttagggtaggaacggggtaccgttaaactttcccaaacctacgttacccgtccccgaaagggaacccgtaacccgaaaacccggtaacctaaaacgggttaaaacttacccgtaaaggttccgttaacttaaccggtaacggtaaccctaaaaagtaccggtaaaaaccgtccgtacccgtaaggaacggacccgggaaaccgggtacggaacccgggacgggttacccggttaagttaccgtttaacggtcgggtaacggtttacggaagaaaccggaaactttaaagggaacggtaaaaaccccggtaaagggggtaacggttaaaacccgggtaaaccgggggtttacgggggtaaatttaacggggg

SEQ ID NO: 370422 - DNA, 785 bp, Homo sapiens
  misc_feature: GZ8MTXP02F822C.15.23.C01.1.454.CMB.2.raw
  modified_base (530)..(530): a, c, t, g, unknown or other
  modified_base (630)..(630): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcgtgggggaggccgtggtccgagggccggggggtccctgacgactctcctgtcgcccgtcctcgtggacctctaccgtttagagtcttagtggatggagtcgtcgggtccgccagggtcctaccggaggggtaacggggcgtaggggaacgggttggggtacggaaccccaaaaggtaaaggtaaaaggggaaagtaaggtaggggtaaacgttacgaaaacggtaaaacctacggttaagttgggtaccgggtaacgttccgttacggggttaagggaaaccgggggtcccgttaaactttacccgaaaacccgtnttccccgaccgaaaggggaaaccaacccgaaacccgtaccaaaaggtaccttacgaagtttcgtaaatccggtaaacgaaacgtaaacgtacgaaaccgngtaacctacggggaacgtcccggaacggaacggaccgtaccgggtcgtttaagtacgtttaggtggtaggaggtaaaccgtaacgaacaaggttaaccggaaacgggttaaacgggtacggtaaaccggggttacgggggtacggtttacgtagg

SEQ ID NO: 370423 - DNA, 690 bp, Homo sapiens
  misc_feature: GZ8MTXP02GC60L.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcgtgggggacgccgtgggtccgacgggtcccggggggtccctggaacgtctctcctgtcgcccgcctcgtcggacttcctaccgtttagagtactagttggatggagtccgttcggggcccgaccgacgggtcctaccgggaagggggtaaccggggtcgttaggggacggttggggtaccggaacccgtaaaaggaaagttaaaagggaaggtagttaggggaaagtaccgaaaaggaaaacctacgtagttaggtacggtacttcgtaggtacggaacggggccttagtaccaacctataccctacgaagtaacgaaccgaaacgtaccgtaaagtacttcgaagtagtacttacgagaaactaagtaacgaacgacgtacgaggagacggaccggaaggttaccgaccggtacgttacgtaattgtgtagagacgagactagcgaacgaggtcgaagtacgggtaggtacttgg

SEQ ID NO: 370424 - DNA, 750 bp, Homo sapiens
  misc_feature: GZ8MTXP02HF325.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagcttgggttttccttgttgcttattttagaaggtgtccagtgcgaggagcaggctgggtggaggtcggtgggggacggccgtgggtccgacgggcccggggggtccctggacgacttctcctggtcgcccgtcctcgtcggactcctacctttagtagtctagttggatggacgtcgtcggggtcccgccgacgggcctaccggaagggggaacggggcgtaggggagggtcggggtacggaaccaaacgaaaggtaaaagggaaagtagtaagggaaacgtaccgaaagaaaactactagttcgggtcggtaccttggtaggtacgggaacgggtaccctattacccgaccttatcccgacgaggaaacaacgaaacccggacaaaaggtactttcgaaggttcgttaaactccgtaaagaaccttaaaaggcaaaaccgtcggtaccgaagggacgtaaccgggacgggtaacggaaccggtaccggggttcttaaagttcgttacggtgggtacgtagaaaccggctaacgttaacgaaccggaaaacggttacgggtaacggtaaaccgggttaccgggggtaggtttacgacgg

SEQ ID NO: 370425 - DNA, 765 bp, Homo sapiens
  misc_feature: GZ8MTXP02I71OJ.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaggtgtcagtgcgaggagcagcgtggtggagtcgtgggggagccgtggtccgaggccggggggtcctggacgactcgtcctggtcgccgcctcgtggacctctacctttagtagtctagttaggataggacgtcgtcgggtacccgaccgaggtcctaccggaagggggaacggggtcgtaggggaggttcggggtacggaacccaaacgaaagtaaaagggaaaggtagtaacggggtaaacgtacgaaaacgtaaaacgtacgttagttacgggtagggtaaccttcggtaggggtacggaaacggggtacccttaagttacccaaccaacgttccctaaacccgaaggaaccggaaccccaaaacgtacccgtaaaagtaacgttaccgtaggttaacttaactccgaagtaaccaaaagttccgaaacgacgtaccgtagggaaccgtacggacccggaaacgggttacacccggggtccgtttaagtaacccgttagtggtaaacgtggaagtaaactcgaaagtaacgaaaaccggtaaacggtacggtaaaaccggttaacgggggtaggttacgtacgg

SEQ ID NO: 370426 - DNA, 621 bp, Homo sapiens
  misc_feature: GZ8MTXP02JLLZ9.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtgcgaggagcagcgtggtggagtcggtgggggacggccgtggtccgagggcccggggggtcctgagctcctctgtcgccgcctacgtcggactcgtaccttagtgtacttagtggctaggcgcgttcggcccgcgaggtcctaccggaagggggacggtcgtgggaggtcggggtacggaccaaaacaaaggtaaaaggaagtaacgtagggactaacgaaacgaaactacgtagtcgtggactgtaggagaacggggctagtccacctatccgacgaagaacgtaaccgaacgaccaataacttgattacgtatcgaagaactaaacgaagaacacgaccacgagacggacgacgacgaacggcgtacgtagttaacgtgtagtagagacgagagaagacgaacgaggtacggtacgggtaggtagtagg

SEQ ID NO: 370427 - DNA, 650 bp, Homo sapiens
  misc_feature: GZ8MTXP02FEHDC.15.23.C01.1.454.CMB.2.raw
  modified_base (297)..(297): a, c, t, g, unknown or other
  modified_base (313)..(313): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagctgggttttccttgttgctattttagaaggtgtccagtgcgaggagcagctggtggagtcgtggggggaggcctggtccgaggcccgggggggtccctggagacctctcctgtgcccgtcctctggctcacctttagagctatggntggagcgtgggtcccnccaggctaccgaggggaggggctgggagtggggtcggaccaaacgagtaaaaggaagagtaggaagtacaagaaaaccagtatgggttcggactcgtagtaggaacgggccgatttcgacctacttccacccgaagacgaaccaaacgacccaaaagtaacttcgaaagtgttaaactcgtagtacaaaagttcgaaacacgtcccgaggacgacgggaccgaaggtaccgacgggtcccgtacgttagttaaccgtggtacggttacgaacggaagaccttaacgtaagaacggaaaccgggttgaacggtaaaacccggggaggggtttcgaagg

SEQ ID NO: 370428 - DNA, 609 bp, Homo sapiens
  misc_feature: GZ8MTXP02IQ9B4.15.23.C01.1.454.CMB.2.raw
  modified_base (309)..(309): a, c, t, g, unknown or other
  modified_base (312)..(312): a, c, t, g, unknown or other
  modified_base (389)..(389): a, c, t, g, unknown or other
tcagtctacgtagccacgaccggtgctcgatttagtacacgtgattagggattggggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccaggccgggggggtccctgagactctcctgtgcctcctctggactcacctttagtagctattggatgagctaggggtccnccnggctccgaggggaaggggctggaggtggggtggccaaacgagtaaaggaagatggaaacgtcaagaaaacacttagngtcgggactcgtaggtagaacgggggtccaattccgaaacccagttcccgtacccaagggtaacaaccgaaaccgaccctaaaggaactttcgaaagttgtaaatccctagaactaaagacggaacaacgaccgtagagacgaccggacggacgacgcgtcgtattactgtgagtagacgagataagacgaacggtacgaagtaccggtacgggtagtgg

SEQ ID NO: 370429 - DNA, 700 bp, Homo sapiens
  misc_feature: GZ8MTXP02FEQRO.15.23.C01.1.454.CMB.2.raw
  modified_base (439)..(439): a, c, t, g, unknown or other
  modified_base (533)..(533): a, c, t, g, unknown or other
tcagtctacgtagccacgaccggtgctcgatttagtacacgtgattagggattgggagggtctcagagaggagccttagccctggactccaaggcctttccacttggtgatcagcactgagcacagaggactcaccatggaggttgggctgagctgggttttccttgttgcttattttagaaggtgtccagtgcgaggagcagctggtggagtcgtgggggagcctcgggtccagggcccgggggggtccctggagtacctctccctgtcgcccgctcgtggactctacccgtttagacgtcttaagtggaattggaacgtcgtgggtccccgactagggcctaccggagggggaaggggtccgtagggtaaggtggggtcggacccaaaacgtagtaaaaaggaagtagtaccggaaagtccaaagaaaactacgtanaggtcggaacctgtaggtacggaaacggggtctaactttaccggaaacctaagtttcccaaacccgaaagggaaccaaacccgaaaacccccgngtttaaaaacgaatttccgaaagtttcggtaaaatccgtaagacctaaaagagaacagccagagagacgagacgacgaccggtacgtagtagtagtagttacgacgaaggacagaacgaacgtaaaccggtaggaacggttaaaccggggacggggtacggtaacgg

SEQ ID NO: 370430 - DNA, 602 bp, Homo sapiens
  misc_feature: GZ8MTXP02I94H8.15.23.C01.1.454.CMB.2.raw
  modified_base (383)..(383): a, c, t, g, unknown or other
  modified_base (389)..(389): a, c, t, g, unknown or other
  modified_base (425)..(425): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccgaggccggggggtccctgagactctcctgtgccgcctctggactctacctttagtagctattggatgagctggccgccaggctaccgaggggaaggggctgggaggtggggtcggaccaaagagtaaaaggaagtatggaaagtcaagaaaacncgtaangtggactcgtagtagaacgggtcaattccaaacgtntccacagacaacaacgacctaaaagtacttgacgtagtagtacgtacgaactaaagtaacgaacgaacgacgacgaacggacggacgaacggaacgaacggtacgtacgtacttacgtacgtagtagacgacgaacgagaagaacgaacggtacgaacggtaacgggtaggtagtag

SEQ ID NO: 370431 - DNA, 719 bp, Homo sapiens
  misc_feature: GZ8MTXP02I1HF6.15.23.C01.1.454.CMB.2.raw
  modified_base (706)..(706): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctggttttccttgttgctattttagaaggtgtccagtgcgaggagcagcgtggtggagtcgtgggggacggccgtggtccgacgggccggggggtccctgagactctcgtgtcgccgcctcgtggactctacctttagtagctagttggatggagcgtgggtcccgccaggccgtccggaaggggaacggggcgtggggaggtggggtacgaccaaacgtaaagtaaaaggaaagagtaggaaaacgtacgaaagaaaacactagtggtcggaactcgtaggtaggaacggggtacctacgttccaaacccgattcccaccgaaggaaacgaaacccgaaacggacccaaaaggtaactttccgaaagttcgttaaactcgttagaaacccgtaaaataccgaaaaccgagtaccccgtaggaacggaccgacggtaacgggtaaacccgcccggggttaccgtttaggttaaaacttcggtacggttagtacggagaacgtaacgaagttccggaaaacgaaacggggtttcgaaaacggttaaaccgggggnggttttacgaagg

SEQ ID NO: 370432 - DNA, 769 bp, Homo sapiens
  misc_feature: GZ8MTXP02H9TJV.15.23.C01.1.454.CMB.2.raw
  modified_base (325)..(325): a, c, t, g, unknown or other
tcagtctacgtagccacgaccggtgctcgattttagtacacgtgattagggattgggaggtctcagagaggagccttagccctggactccaaggcctttccacttggtgatcagcactgagcacagaggactcaccatggagttgggctgagctgggttttcttgttgcttattttagaaggtgtccagtgcgaggagcagctggtggagtcgtgggggagtccgttggttccgaggcccgggggggttccctggagacttctccgtgtcgccgtcctcgtcggacttcctacctttagtagctattgatgagtcgtcgggtccncctaggcctaccggaggggaaggggctggggaggtggggtacggaccaaacgaagtaaaacggagtagtaggaagtacgaagaaaactactaagttcggtacgaccttgtaggttacgggaacggggtaccccgtaaatttaccccgaaccctagtttacccgaccgtaaacgaaccggttaaaacccgaaacccgttaaacccgaaaaggttaaacccctttacgaggtttacgtaaacgtttacccgttaagaaccgtttaaaaagtccgaaaaccgacgtacccgtaggaaacccggacggttaacccgggaacggtaccgaaacccggggttcccttagggtaaaaccttttcggagtttggagaaacccgtgaacctaaggttaaccgaaccggtaaagggtacgtaaaaccggtaacccggggttgggtttaacgcgg

SEQ ID NO: 370433 - DNA, 608 bp, Homo sapiens
  misc_feature: GZ8MTXP02G0GT8.15.23.C01.1.454.CMB.2.raw
  modified_base (286)..(286): a, c, t, g, unknown or other
  modified_base (389)..(389): a, c, t, g, unknown or other
  modified_base (492)..(492): a, c, t, g, unknown or other
tcagtctacgtagccacgaccggtgctcgatttagtacacgtgattagggattggggaggtctcagagaggagccttagccctggactccaaggcctttccacttggtgatcagcactgagcacagaggactcaccatggagttgggctgagctgggttttccttgttgcttagttttagaaggtgtccagtgcgaggagcagctggtggagtcgtgggggagcctggtccgaggccggggggtccctgagctcgtctgtcgccgcctctggactcacctttaganctattggatggatcgtaggtccgcaggtccacggaggggaacgggcgtggtaggtggggtacggaccaaacgaagttaaaagggagtataccgggaacgtaanaagaaacatacgtagtgtactcgtaggtacggaacgggccgtactccaacctctacccacgacgaacaacgaaccgtcgaaagtatacgagtgtactgacganagacgaacgagacgacgacgacgacggacgacgacgtacgtacgtacgttagtacgtagtacgtacgacgacgtacgaacgaacgaacggtacgtacggtacggtacggtaggtcg

SEQ ID NO: 370434 - DNA, 641 bp, Homo sapiens
  misc_feature: GZ8MTXP02HSW8N.15.23.C01.1.454.CMB.2.raw
  modified_base (456)..(456): a, c, t, g, unknown or other
  modified_base (508)..(508): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggcctggccgagggccggggggtccctggagactctcctgtcgccgcctcgtggacctctacctttagagctagttggatgagcgtggggtcccgccaggccgtccgaagggggaccgggtgtgggtaggtggggtacggacccaaagaagtaaaaggagagtacggaaagtccgaagaaacactaagtgcgggtaacttcgtggtacgaacgggggccctaattcccgaaacctnttccgaccagacggaaccctaaacgaccgaaagtaaacttcgagtgttaacngttagactaaagtagaacgacgtacccgacgaaggacggccggacggacgaaccggtccgtacgttagttacgttggtgtacgagacgagagtaagaacgaacggtagaacggtaccggtacgggtaggtagg

SEQ ID NO: 370435 - DNA, 711 bp, Homo sapiens
  misc_feature: GZ8MTXP02G4EV4.15.23.C01.1.454.CMB.2.raw
  modified_base (284)..(284): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggaggccgtggtccgaggccggggggtccctgagactctcctgtgccgcctctgactctaccttgtnactagtgatgagcgtcgggtccaccgaggcctccggaggggaacgggctggggaggtggggtacggaccaaacgaaagtaaaagggagtaagacgggaaagtcgaaaagaaaaccgcttaagtcgtacgggtaacctcgtaggtacggaaccggggtaccgtaacttcacccgtattacccgcccgaaagaacggaacccaaaaccggtaccctaaaaggtaaaacttccgaaacgttaggttaaactcgttaaacggacttaaaaagttacccgaaaacggtaacgacccgttaggaacgggaccggtacggacggtaaaccgccgggtaacccgtgttaaacgtttcgtgttacgggaagaccgagaacgaggtaacgacggtaaacggtacgaaaacgggtacgggttaacgggggtgtacggg

SEQ ID NO: 370436 - DNA, 654 bp, Homo sapiens
  misc_feature: GZ8MTXP02JM627.15.23.C01.1.454.CMB.2.raw
  modified_base (313)..(313): a, c, t, g, unknown or other
  modified_base (400)..(400): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgtgctattttagaaggtgtccagtgcgaggagcagctggtggagtcgtgggggagcctcggtccagggccggggggtcctggagactcctcctgtcgccgcctctggactctaccttagtacgctagttggatgagtcgtcgggtccncaggcctacggaaggggaagggctgggaggtggggtcgaaccctaagaaagtaaaagggaacgtagtacggaagtacaaagaaaacncgtagtgtacggtctacgtaggtaggaacggggtcctattccgaaccattccacccgagaacgaaccaacgttccaaagtaacttcgaagttgtacctagtgaaccttaaagacgaacgacgacgacggaacggacggaccggacggaccggacggtacccggtagtacgttacgttacgtaggttacgagtaaccgacgacgtaagaacgtaacggtaccggtaaggtaaccgggtacgggtacggttaaggg

SEQ ID NO: 370437 - DNA, 575 bp, Homo sapiens
  misc_feature: GZ8MTXP02HXD99.15.23.C01.1.454.CMB.2.raw
  modified_base (382)..(382): a, c, t, g, unknown or other
  modified_base (457)..(457): a, c, t, g, unknown or other
  modified_base (479)..(479): a, c, t, g, unknown or other
  modified_base (570)..(570): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctgggtccaggccgggggggtccctgacgactctcctgtcgcccgcctctcggactcacctttagtagctattggatgagctggtccgcaggctcgaggggaggggctgggaggtggggtggccaaacgataaaaggacagtaggaagtaccaagaaacntaatggtcggaacctgtagtgaaggggcctattccgacatccgtcagacgacaacgtccaaagtaactacagtanaattcagtacaaaagtcgaacncgacgtagagacgccgagacctacggccgtgtattacgcttggactaggacagtagaagaacgaacggtgaaacgtaccggggtaggttanaacgg

SEQ ID NO: 370438 - DNA, 855 bp, Homo sapiens
  misc_feature: GZ8MTXP02JY6CT.15.23.C01.1.454.CMB.2.raw
tcagtctacgtagccacgaccggtgctcgatttagtacacgtgattagggattgggaggtctcagagaggagccttagccctggactccaaggcctttccacttggtgatcagcactgagcacagaggactcaccatggagttgggctgagcgttgggttttccttgttgcttattttagaaggtgtccagtgcgaggagcagcgtggtggagtcggtgggggacgccgtcggtccgacgggcccgggggtccctggacgacctctccgtgtcgcccgtcctcgtggtacctacgtacctttagtagctagttggatgacgtcgtcgggtcccgacgacggtccgtaccggaaggggaaggggtccgtaggggtacgggtacggggtcgaacccgaaaacgtaaaggtaaaacgggaaaggtagtaacgggaaacgtacgaaaacgtaaaaccgtacgttaaggttacgggtacggtaaccgttcgggttaagggtacgggaaaccgggggtaccctaaacgtttaccccgaacccgttactaccccgtaaccggaaagaacccgaaacccgaaacccgtaaccctaaaaggttaaacgtttaccgaaaggtttacggttaacgtttaaccgttacggaaaacgtaaagttaaaccgtaaaacccgggacgtaacccggtaggaaacccgggaccgggtaaacccggaacggtaacccgggtaccgggttccggtttaagttaaccgttacggttaggggtacgttagggaacgtaaacggacgttaaacggaaccggtaaaacggtaacgggttaacggtaaaccgggtacgggggttacgggtaagttacggg

SEQ ID NO: 370439 - DNA, 697 bp, Homo sapiens
  misc_feature: GZ8MTXP02H82M8.15.23.C01.1.454.CMB.2.raw
  modified_base (193)..(193): a, c, t, g, unknown or other
  modified_base (278)..(278): a, c, t, g, unknown or other
  modified_base (352)..(352): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggaggttggggctgagcgtggtttctgtgctatttagaggtgtccagtgcgaggancagcgtggtggacggtcggtgggggcgccgtgggtccgagggtcccgggggggtccctggacgctctccgttgtcgccgcctcgngtctctacgttagtagtctagtgatgagtccggtcgggccaccgtaggccgacggaggggtaggtcggtagggngggtacgggacgaacgaaacgtaaagtaaaggagtagacggtaacgtaacaaacgtaaacgtatagttcggtcgtaccgtggtaggtaggacggaccgtacttaccaccctagtaccgaccgaacgtaacgaaacccgaacgtaaccgtaaagtacgtacgtagttacttacgtacgtataacgtaaacgtaacgaaccgtacgaccgtacggacggacggaccggaacggaccggtaccggtcggttacgttacgtttacgtcggtaggtacggacgaacgtaacgaacgtaacgaacggtaacggtaacggtaacgggtaacggggttacggggttaggtagg

SEQ ID NO: 370440 - DNA, 875 bp, Homo sapiens
  misc_feature: GZ8MTXP02JIN4X.15.23.C01.1.454.CMB.2.raw
  modified_base (194)..(194): a, c, t, g, unknown or other
  modified_base (787)..(787): a, c, t, g, unknown or other
tcagtctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgcttattttagaaggtgtccagtggngaggagcagctggtggagtcgtgggggaggccgtgggtccgacggggcccggggggttccctggacgaccgtcctccgtggtcgcccgcctcgtcggacctccgtacctttagacgtcttagttggatggagcgtcgggtccgcgagggcctaccggaagggggaacggggcgtaggggaggttgggggtacgaccgaaaacgtaaagtaaaaagggaaacgtaaagtaggggtaaaacgtacgtaaaagaaaaaaccgtaccttaaaggttaggttaccggggtaacctttacggtttacggggtaaacgggggaaaacccgggggttaacccccggttaaactttacccgaaaaccccgtaacgttttacccctaaaacccggaaaacgggtaacccggaaaaaccccgaaaacccggggtaaacccccgtaaaaaagggtttaaaaccttttaccgggtaaaagtttaaaccgggtttaatttacccggttaaggaaaaccctaaaaggttaacgaaacccgtagtaacccgtagggaaacggacgggacggtaaccgggaaccgtacgggtcccgtagttaccgttagnggttagacggtaagacgtaacgtaataaggaaaacccgtaaggggttaacggtaaacggtaaccgggggtaggggtttcgtaaacggg

SEQ ID NO: 370441 - DNA, 891 bp, Homo sapiens
  misc_feature: GZ8MTXP02JER54.15.23.C01.1.454.CMB.2.raw
tcagtctacgtagccacgaccggtgctcgatttagtacacgtgattaggattgggaggtctcagagaggagccttagccctggactccaaggcctttccacttggtgatcagcactgagcacagaggactcaccagtggaggttgggctgagcgttgggttttccttgttgtctattttagaaggtgtccagtgcgaggagcagcgtggtggagtcggtgggggacggccgtcggtcccgacggggtcccggggggttccctggaacgtaccgttcccgtcccgttggtccggtccccgtccctccgttgggaccttaccgtaacccgtttagtacggacttagtttagggtagttacggacggtccggttccggggtaccccggaccccggacgggtacccgttaccccggggaaaccgggggtaaacggggtccggttacggggtaacggggtttacgggggttaccggaaccccgtaaaacgtaaaacggttaaaagggaaaaggtaacggtaaggggtaaacgtaacgaaaacgtaaacctaacgttagtacggtcgggtaccttacggttaagggttacgggaaaccggggtaccgttaaccgttaccgtaacccttacgtaccccgtacgaaacggaaccgaaaccgaaacccgtaacccgaaaagttaaccgttacgtaaacgttgttaaacctacgttacggaaaaccttaaagtaccgaaccgagtaaccccgtaggaacgacgggaccgaacgggaacccgaaccggggtcttaagggttaactttcgtacggtggtaaaggacgtaaacgttagaaacgtaaccgtaaacggtaaaccggggtacggaacggtaaacgggggttagggtacgttaaaggg

SEQ ID NO: 370442 - DNA, 647 bp, Homo sapiens
  misc_feature: GZ8MTXP02H6MU7.15.23.C01.1.454.CMB.2.raw
  modified_base (258)..(258): a, c, t, g, unknown or other
  modified_base (269)..(269): a, c, t, g, unknown or other
  modified_base (294)..(294): a, c, t, g, unknown or other
  modified_base (311)..(311): a, c, t, g, unknown or other
  modified_base (313)..(313): a, c, t, g, unknown or other
  modified_base (384)..(384): a, c, t, g, unknown or other
  modified_base (405)..(405): a, c, t, g, unknown or other
  modified_base (642)..(642): a, c, t, g, unknown or other
tcagtctacgtagccacgaccggtgctcgatttagtacacgtgattagggattgggaggtctcagagaggagccttagccctggactccaaggccttttccacttggtgatcagcactgagcacagaggactcaccatggagttggggctgagctgggtttttcctgttgctatttttagaagtgtccagtgcgaggagcagctggtggagtcgtgggggagcctgggtccaggcccggggggtcctggagctctccngtcgccgtctntagctctacctttgagtctatcgancgtagcgttacgggccngnggcctacgaacggggaggtacgagggtagtggggtacgacaacgtaagtaaggaaagtgtagaaccggaanaaacgaactagtagtgtcgtnttacgtaggacgtaccgggtactactacacctacgtaccagaacgtaccgaaccgaacaacgtaataacgttgtagttatactacgagtaaactacgtaagacgtaacgacgtaggacggtacggaaccggtacggaccgttacggtcgtttaacggttattacgggttcgtagtacggacgacgtacgtaagtaacgaaacggtaacggtacggtacggtaacgggttacgggttntacgg

SEQ ID NO: 370443 - DNA, 582 bp, Homo sapiens
  misc_feature: GZ8MTXP01EJ6OX.15.67.G01.1.454.CMB.2.raw
  modified_base (257)..(257): a, c, t, g, unknown or other
  modified_base (269)..(269): a, c, t, g, unknown or other
  modified_base (275)..(275): a, c, t, g, unknown or other
  modified_base (312)..(312): a, c, t, g, unknown or other
  modified_base (314)..(314): a, c, t, g, unknown or other
  modified_base (319)..(319): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttctgttgttattttagaaggtgtcagtgtgaggtgcacttggtggagtctgggggagcttggtccagccgggggggtccctgagactctcctgtgctangtctctgacttnaccttnagtagtatggatgctggtcgcaggcgtcgaggagggngnggagnggtagacaacagaaacgaaagagaagtaacagaaaaaactaatgtgacgtacgtagtagaacggaccgacttacaccactactacaacgaacgaacaacgacaacgaattactactagtattagtacaaatagaacgacgaccgtacggaggagggacggacgggacgaacggaccggttaacggttaagttagttcggttggacggtacgaggagttagtaagtaagttaacgtacgtacgttacgtaacgttaaggtaacg

SEQ ID NO: 370444 - DNA, 538 bp, Homo sapiens
  misc_feature: GZ8MTXP01EO03R.15.67.G01.1.454.CMB.2.raw
  modified_base (491)..(491): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagtattggatgacctgggtccgccaggctccaggggaaggggctggagtgggtggccaacataaacaaagacggaaagtcaagaaaaaacctatagtggactctagtgaacggccgattcaccatctccagagacaacgccaagaattcaactgtatttgacaaatgaaacagcctgagaggcgaggacacggcgtgtatatgtgcgngagatgagtagtagacttcttacaagtagcaggtggttatgaagttg

SEQ ID NO: 370445 - DNA, 545 bp, Homo sapiens
  misc_feature: GZ8MTXP01DUTR4.15.67.G01.1.454.CMB.2.raw
  modified_base (495)..(495): a, c, t, g, unknown or other
  modified_base (526)..(526): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccggggggtccctgagactctcctgtgcagtctctggattcacccttagaagtattggatgacctgggtccgccaggctccgaggggaaggggctgggagtggggtggccaaacgataaacaaagacggaaagtcaagaaaaaacctatgtggactctagtgaacggcgattcacatctccagagacaacgaccaaagaattcaactgtatttgacaaatgaaacagcctgagagcgagacacggccgtgtattattgtgcgngagatggatagtagacttcttaacaagtagngaggtggttatggaattgg

SEQ ID NO: 370446 - DNA, 557 bp, Homo sapiens
  misc_feature: GZ8MTXP01BJCZI.15.67.G01.1.454.CMB.2.raw
  modified_base (531)..(531): a, c, t, g, unknown or other
  modified_base (541)..(541): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggcccgggggggtccctgagactctcctgtgcagtctctggattcacccttagaagtatggatgacctgggtccgccaggctccgaggggaaggggctgggagtgggtggccaacataaacaaagacggaagtacaagaaaaacctatgtggactctagtagaacggccgattcaccatcctccagacgacaacgaccaaagaattacacttgttatttgacaaaatgaaacagaccgtggaggaggacggaggacgacgggccgtagtattagttgtgcgcgagatgagtagtagcgttnacgaagtagngaggtgttatgttgtg

SEQ ID NO: 370447 - DNA, 559 bp, Homo sapiens
  misc_feature: GZ8MTXP01EJRAY.15.67.G01.1.454.CMB.2.raw
  modified_base (304)..(304): a, c, t, g, unknown or other
  modified_base (445)..(445): a, c, t, g, unknown or other
  modified_base (486)..(486): a, c, t, g, unknown or other
  modified_base (489)..(489): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttcctgttgttattttagaaggtgtcagtgtgaggtgcacttggtggagtctggggggaggcttgggtccaggccggggggggtccctgagactctcctgtgcagtctctggattcacccttagaagtattggatgacctgggtcnccaggctccaggggagggctggagtgggtggccaacataaacaaagacggaaagtcaagaaaaaacctatagtggactctagtgaacggcgattcaccatctccagagacaacgccaagaattcactgtattgacaataanacagacgagagagacgagacgacgcgtagtattagttgtgnggngagagtagttagtaagtaagttacgttcttacgtaagtaggtaacggtaggtaggttagtaagttaagtg

SEQ ID NO: 370448 - DNA, 545 bp, Homo sapiens
  misc_feature: GZ8MTXP01BBOLX.15.67.G01.1.454.CMB.2.raw
  modified_base (406)..(406): a, c, t, g, unknown or other
  modified_base (452)..(452): a, c, t, g, unknown or other
  modified_base (456)..(456): a, c, t, g, unknown or other
  modified_base (491)..(491): a, c, t, g, unknown or other
  modified_base (493)..(493): a, c, t, g, unknown or other
  modified_base (527)..(527): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggtttctgtgttatttagaaggtgtcagtgtgaggtgcacttggtggagtctggggggaggcttgggtccagcccggggggggtccctgagactctcctgtgcagtctctggattcacccttagaagtattggatgactgggtccgccaggctccaggggaaggggctgggagtggggtggccaacataaacaaaagacggaaagtcagaaaaaacctatgtggactctgtgaacggccgattcaccatccncagagaacaacgacaaagtaatacactatattatacaatagaacanacgngaggaggaggaggacgacggcgtgtattattgtgngngagagtagagtagtagacgttcttactaagtagngaggtggttagtgttgtg

SEQ ID NO: 370449 - DNA, 528 bp, Homo sapiens
  misc_feature: GZ8MTXP01D2LI0.15.67.G01.1.454.CMB.2.raw
  modified_base (347)..(347): a, c, t, g, unknown or other
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggtggtatcagcagaaatccgggaaagcccctaaagctcctgatctgtgctgcatccactttacaaagtcggggtccccatcaaggttcagcggcnggtggatctggcacagtatttcactctcaccatcagcagcctgcagcctgaacggtatttcgactaactttattactgtactaacaatattactaacttcccgtcggtacgttcgggaccgaaggggtacccgaagggttacggaaattacgaaacgtaacgtgtggcttcgcaaccgtaa

SEQ ID NO: 370450 - DNA, 578 bp, Homo sapiens
  misc_feature: GZ8MTXP01DM0A0.15.67.G01.1.454.CMB.2.raw
  modified_base (278)..(278): a, c, t, g, unknown or other
  modified_base (348)..(348): a, c, t, g, unknown or other
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggtggtatcagcagaaatccgggaaancccctaaagctcctgatctgtgctgcatccactttacaaagtcgggtacccccatcaaggttcagcggcnggtggatctggcacagatttcactctcaccatcagcagcctgcagcctagaaggtactttcgactaacttattacctgtactaacaaagtactttaacaaactttaccccgtcgggtaacgtttcgggacccgaaacggggaacccgtaaagggttacgggttaaaacttaaccgaaaaaccggtaaacgttaagggttacgggcttacggaaccgttaacccgttaacg

SEQ ID NO: 370451 - DNA, 537 bp, Homo sapiens
  misc_feature: GZ8MTXP01BUTN2.15.67.G01.1.454.CMB.2.raw
  modified_base (304)..(304): a, c, t, g, unknown or other
  modified_base (510)..(510): a, c, t, g, unknown or other
  modified_base (534)..(534): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagtatggatgacctgggtccnccaggctccgaggggaaggggctggagtggggtggccaaacaataaaacaaagacggaaagtcaagaaaaaacctatgtggactctgtgaacggccgaattcaccatctcagagacaacgccaaagaattcactgtatttgcaaatgaaacagccgtgagaggacgaggacacggccgtgtattatgtgcgcgagatgataggtanacttcacaagagcaggtgttatgngtg

SEQ ID NO: 370452 - DNA, 530 bp, Homo sapiens
  misc_feature: GZ8MTXP01B15BQ.15.67.G01.1.454.CMB.2.raw
  modified_base (369)..(369): a, c, t, g, unknown or other
  modified_base (483)..(483): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccaggccggggggggtccctgagactctcctgtgcagtctctggattcacccttagaagtatggatgacctgggtccgcaggctccagggaggggctggagtgggtggccaacataaacaaagacgaagtcagaaaaacctntgtggactctgtgaacggcgattcaccatctccagagacaacgaccaagaacttcaactgtatttagcaaatgaacagccgtgagagcgaggacgacggccgtgtatattgtgngcgagatgagtagtagacttcttacaagtagcaggtgttatgaagtg

SEQ ID NO: 370453 - DNA, 528 bp, Homo sapiens
  misc_feature: GZ8MTXP01D4808.15.67.G01.1.454.CMB.2.raw
  modified_base (486)..(486): a, c, t, g, unknown or other
  modified_base (504)..(504): a, c, t, g, unknown or other
  modified_base (519)..(519): a, c, t, g, unknown or other
  modified_base (526)..(526): a, c, t, g, unknown or other
tcagtctacgtagccacgaccggtgctcgatttagagtatacatattgggtttgaggtctcagagaggagccttagccctggactccaaggcctttccacttggtgatcagcactgagcacagagaactcaccatggagttggggctgagctggggttttccttgttgttattttagaaggtgtccagtgtgaggtgcacttggtggagtctgggggaggcttggtccaggccgggggggtccctgagactctcctgtgcagtctctggattcacccttagaagtattggatgacctgggtccgccaggctccaggggaaggggctggagtggggtggccaaacataaaacaaagacggaagtcaagaaaaacctatgtggactctgtgaacggcgattcaccatctcagagacaacgcaagaattcactgtatttgcaaaatgaaacagcctgagaggcgaggacacggcgtgtattatgtgcgngagatgatagtagacttnttacaagtagcaggngttatgntg

SEQ ID NO: 370454 - DNA, 537 bp, Homo sapiens
  misc_feature: GZ8MTXP01BBKBW.15.67.G01.1.454.CMB.2.raw
  modified_base (308)..(308): a, c, t, g, unknown or other
  modified_base (488)..(488): a, c, t, g, unknown or other
  modified_base (519)..(519): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggcccggggggggtccctgagactctcctgtgcagtctctggattcacccttagaagtattggatgacctgggtccnccaggctccaggggagggctggagtgggtggccaacataaaacaaagacggaaagtcaagaaaaaacctatgtggactctgtgaacggccgattcaccatctcagagacaacgccaagaattcactgtatttgacaaatgaacagctgagagcgaggacacggcgtagtattatgtgcgngagatgatagtagacgttcttacaagtaggngtagggtgttatgttgtg

SEQ ID NO: 370455 - DNA, 534 bp, Homo sapiens
  misc_feature: GZ8MTXP01EC9H8.15.67.G01.1.454.CMB.2.raw
  modified_base (376)..(376): a, c, t, g, unknown or other
  modified_base (480)..(480): a, c, t, g, unknown or other
  modified_base (491)..(491): a, c, t, g, unknown or other
  modified_base (495)..(495): a, c, t, g, unknown or other
  modified_base (521)..(521): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggcccgggggggtccctgagactctcctgtgcagtctctggattcacccttagaagtattggatgacctgggtccgccaggctccgaggggaggggctgggagtgggtggccaacataaacaaagacgaagtcaagaaaaacctntgtggactctgtgaacggcgattcaccatctccagagacaacgccaagaatcactgtatttgacaaatgaaacagacctgagaggcgaaggcacggccgtagtntattgtgcggngagntggatagtagacttcttacaagtagnagggtgatgaatg

SEQ ID NO: 370456 - DNA, 568 bp, Homo sapiens
  misc_feature: GZ8MTXP01EOISF.15.67.G01.1.454.CMB.2.raw
  modified_base (548)..(548): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccgggggggtccctgagactctcctgtgcagtctctggattcacccttagaagtatggatgacctgggtccgccaggctccgaggggaaggggctggaggtgggtggaccaacaataaacaaagacggaagtacaagaaaaaaccctataggtggactcgtagtagaacggccgaattccaccatctccagacgacaacgaccaaagaattcaactagtatttagacaaatagaaacagccgtagaggaggcggaggacgacggccgtagtattagttgtcgcgcgagagtagagtagtagacttcttacgaagtagngaggtggttatggaagttgg

SEQ ID NO: 370457 - DNA, 571 bp, Homo sapiens
  misc_feature: GZ8MTXP01C9K8N.15.67.G01.1.454.CMB.2.raw
  modified_base (504)..(504): a, c, t, g, unknown or other
tcagtctacgtagccacgaccggtgctcgatttagagtatacatattgggtttggggtctcagagaggagccttagccctggactccaaggcctttccacttggtgatcagcactgagcacagaggactcaccatggagttggggctgagctgggtttccttgttgttatttagaaggtgtccagtgtgaggtgcacttggtggagtctgggggagcttggtccaggccggggggtccctgagactctcctgtgcagtctctggattcacccttagaagttatggatgacctgggtccgccaggctccgagggaaggggctgggagtggggtggccaacgataaaacaaagacggaagtacaagaaaaaactatgtggactctgtcgaaacggcccgattcaacccatctccagagacaaacgccaaagaattcactgtaatttgacaaatgaaacagcctagggagagggcgaagggacaacggccgtagtattattgtgcgngaagagagtagttagtaaggtaacttccgttacttagtaagagaaggtggtagttagtaagttgttg

SEQ ID NO: 370458 - DNA, 555 bp, Homo sapiens
  misc_feature: GZ8MTXP01BNUWW.15.67.G01.1.454.CMB.2.raw
  modified_base (301)..(301): a, c, t, g, unknown or other
  modified_base (372)..(372): a, c, t, g, unknown or other
  modified_base (457)..(457): a, c, t, g, unknown or other
  modified_base (493)..(493): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttctgttgttatttagaaggtgtcagtgtgaggtgcacttggtggagtcgtggggggaggcttggtccaggccggggggggtccctgagactctcctgtgcagtctctggattcacccttagaagtattggatgacctgggtccncaggctccgaggggagggctggagtgggtggaccaacgataaacgaaagacggaagtcaagaaaaaacctntgtggactcgtaagtcgaacgggcctaattcaccatcctcagagacaacgccaaagatcaactgtattgacaaatgaacagccgngagaggcgagacgacggcgtgtaattgttggtgcgngagagtagttagtagtagttacgttacttacgtaagtagtcgtaggtaggttagtgttgttg

SEQ ID NO: 370459 - DNA, 535 bp, Homo sapiens
  misc_feature: GZ8MTXP01ES49B.15.67.G01.1.454.CMB.2.raw
  modified_base (304)..(304): a, c, t, g, unknown or other
  modified_base (488)..(488): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagtatggatgacctgggtccncaggctccagggagggctggagtgggtggccaacataaacaaagacggaagtacaagaaaaaacctatagtggactctagtgaacggccgattcaccatctccagagacaacgccaaagaattcaactgtatttgacaaatagaacagcctgagaggcgaggacacggcgtagtattattgtgngcgagatgatagtaagacttcttacaagtagcgaggtgttatgaatg

SEQ ID NO: 370460 - DNA, 561 bp, Homo sapiens
  misc_feature: GZ8MTXP01EEEZ1.15.67.G01.1.454.CMB.2.raw
  modified_base (450)..(450): a, c, t, g, unknown or other
  modified_base (452)..(452): a, c, t, g, unknown or other
  modified_base (455)..(455): a, c, t, g, unknown or other
  modified_base (457)..(457): a, c, t, g, unknown or other
  modified_base (459)..(459): a, c, t, g, unknown or other
  modified_base (499)..(499): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacttggtggagtcgtggggggaggctttgggtccaggccgggggggtccctgagactctcctgtgcagtctctggattcacccttagaagtatggatgacctgggtccgccaggctccgaggggagggctggagtgggtgccgaacaataaacgaaagacggaaagtacaagaaaaacctatagtggactcgtagtagaacggccgaattccaccatctaccagagacaacgacaagaattcactgtattananaanananagcgagagagacgagacgacgcgtagtagttagtgtgcgngagagtagagtagtaagttacgttcttacgtaagtagtaacgtaggtaggttagtgttgttg

SEQ ID NO: 370461 - DNA, 523 bp, Homo sapiens
  misc_feature: GZ8MTXP01DPY61.15.67.G01.1.454.CMB.2.raw
  modified_base (301)..(301): a, c, t, g, unknown or other
  modified_base (480)..(480): a, c, t, g, unknown or other
  modified_base (502)..(502): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggagcttggtccaggccgggggggtccctgagactctcctgtgcagtctctggattcacccttagaagtatggatgacctgggtccnccaggctccaggggagggctggagtgggtggccaacataaacaaagacggaagtcaagaaaaacctatgtggactctagtgaacggccgattcaccatctccagagacaacgccaagaattcactgtattgcaaatgaacagcctgagaggcgaggacacggcgtagtattatgtgcgngagatgatagtagacttcttangtagcaggtggttatgaattg

SEQ ID NO: 370462 - DNA, 575 bp, Homo sapiens
  misc_feature: GZ8MTXP01EICWP.15.67.G01.1.454.CMB.2.raw
  modified_base (306)..(306): a, c, t, g, unknown or other
  modified_base (480)..(480): a, c, t, g, unknown or other
  modified_base (521)..(521): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactgaccatggagttggggctgagctgggttttccttgttgttattttagaaggtgtccagtgtgaggtgcacttggtggagtcgtggggggaggcgttggtccaggccgggggggtccctgagactctcctgtgcagtctctggattcacccttagaagtattggatgacctgggtccncaggctccgaggggagggctggagtgggtggcaaacaataaaacgaaagacggaaagtacaagaaaaaacctagtagtaggaactcgtaggtagaaccgggccgtaattccaaccatccgtaccagacgaacaaacgaccaaagaattcactagttatttagacaaatgaaacngaccgtgaggaggacgaggacacggctggtattatgtgcgngagatgaagtacgtaagacgttcacgaagtagcgtagggtggttatgaagttgg

SEQ ID NO: 370463 - DNA, 537 bp, Homo sapiens
  misc_feature: GZ8MTXP01AXB1E.15.67.G01.1.454.CMB.2.raw
  modified_base (495)..(495): a, c, t, g, unknown or other
  modified_base (516)..(516): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccaggccggggggggtccctgagactctcctgtgcagtctctggattcacccttagaagtattggatgacctgggtccgccaggctccgaggggaaggggctgggagtgggtggccaacataaacaaagacggaagtcaagaaaaacctatagtggactctgtgaacgcgattcaccatctcagagacaacgcaagattcactgtatttgacaaatgaacagaccgtagaggacggacgaggacgacggccgtagtattagtgtgcgngagatgatagtagacgttcanaagtgcaggtggatggaattg

SEQ ID NO: 370464 - DNA, 569 bp, Homo sapiens
  misc_feature: GZ8MTXP01EC32K.15.67.G01.1.454.CMB.2.raw
  modified_base (336)..(336): a, c, t, g, unknown or other
  modified_base (496)..(496): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttcctgttgttatttagaaggtgtccagtgtgaggtgcacttggtggagtcgtggggggaggcttgggtccaggcccgggggggtccctgagactctcctgtgcagtctctggattcaccttagaagtatggatgactgggtcgccaggctcgagggaggctggagtgggtggccaanataaacaaagacggaagtcaagaaaaaacctagtgtggaactcgtagtagaacgggccaattccaccatctccagagacaaacgccaaagaattcaacttgtatttgacaaatgaaacagacctgagaggacgaggacacggccgtagtattagttgtgngcgagagtagttagtagtaaggttacgttccttactaagtagtaacgtaggtaggttagttaagttaagttgg

SEQ ID NO: 370465 - DNA, 539 bp, Homo sapiens
  misc_feature: GZ8MTXP01EILHQ.15.67.G01.1.454.CMB.2.raw
  modified_base (412)..(412): a, c, t, g, unknown or other
  modified_base (491)..(491): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccggggggtccctgagactctcctgtgcagtctctggattcacccttagaagtattggatgacctgggtccgccaggctccgaggggaaggggctgggagtgggtggccaaacataaaacaaagacggaaagtcaagaaaaacctatgtggactctgtgaacggccgattcaccattcncagagacaacgccaagaattcactgtattgacaaatgaacagccgtgagaggcgaggacacggcgtgtattatgtgcgngagatgataggtaagacttcacaagtagcagggtggttatggaatttg

SEQ ID NO: 370466 - DNA, 538 bp, Homo sapiens
  misc_feature: GZ8MTXP01A8VWV.15.67.G01.1.454.CMB.2.raw
  modified_base (305)..(305): a, c, t, g, unknown or other
  modified_base (448)..(448): a, c, t, g, unknown or other
  modified_base (477)..(477): a, c, t, g, unknown or other
  modified_base (489)..(489): a, c, t, g, unknown or other
  modified_base (519)..(519): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttgggtccaggccgggggggtccctgagactctcctgtgcagtctctggattcacccttagaagtatggatgacctgggtccnccaggctccgaggggaagggctgggagtgggtgccaacaataaacaaagacggaagtcaagaaaaacctatagtggactctagtgaacggcgattcaccatctccagagacaacgcaagaattcactgtattgacaaatgaanagctgaggagcgaggacacggccgtagtnttagtgtagcgngagatgagtagtagacttcttacaagtagngtagggtgttatgaagttg

SEQ ID NO: 370467 - DNA, 536 bp, Homo sapiens
  misc_feature: GZ8MTXP01ETGWV.15.67.G01.1.454.CMB.2.raw
  modified_base (306)..(306): a, c, t, g, unknown or other
  modified_base (372)..(372): a, c, t, g, unknown or other
  modified_base (404)..(404): a, c, t, g, unknown or other
  modified_base (485)..(485): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccaggccggggggggtccctgagactctcctgtgcagtctctggattcacccttagaagtattggatgacctgggtccncaggctcaggggaaggggctggagtgggtggccaacataaacaaagacggaagtcagaaaaacctntgtggactctagtgaacggcgattcaccatcncagagacaacgcaagaattcactgtatttgacaaatgaacagccgtgagaggcgaggacacggccgtgtattattgtgcgngagatggatagtagacgttcttacaagtagcgagggtgttagtgaagttcg

SEQ ID NO: 370468 - DNA, 544 bp, Homo sapiens
  misc_feature: GZ8MTXP01D6GVM.15.67.G01.1.454.CMB.2.raw
  modified_base (486)..(486): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagtattggatgactgggtccgccaggctccgaggggaaggggctggagtgggtggccaacataaacaaagacggaaagtcaagaaaaacctatgtggactctgtgaacgccgattcaccatctcagagacaacgccaagaatcactgtatttgacaaatgaaacagccgtagagaggcgaggacacggcgtagtattattggngcgcgagatgagtagtaagttacttcttacgaagtagcgtagggtggttagtgttgtg

SEQ ID NO: 370469 - DNA, 540 bp, Homo sapiens
  misc_feature: GZ8MTXP01BJSEU.15.67.G01.1.454.CMB.2.raw
  modified_base (418)..(418): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggggttttccttgttgttattttagaaggtgtccagtgtgaggtgcacttggtggagtctgggggaggcttggtccagccgggggggtccctgagactctcctgtgcagtctctggattcacccttagaagtattggatgacctgggtccgcaggctccaggggaaggggctgggagtgggtggccaacataaaacaaagacggaaagtacaagaaaaaacctataggtggaactctagtgaacggccgattcaccatctccaganacaacgccaagaattcactgtattgcaaatgaacagccgtgagaggcgaggacacgggcgtgtattatgtgcgcgagatgagtagtagacgttcttacgaagtagcagggtgttatgaagtg

SEQ ID NO: 370470 - DNA, 539 bp, Homo sapiens
  misc_feature: GZ8MTXP01AK9M3.15.67.G01.1.454.CMB.2.raw
  modified_base (449)..(449): a, c, t, g, unknown or other
  modified_base (522)..(522): a, c, t, g, unknown or other
  modified_base (537)..(537): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcacccttagaagtattggatgacctgggtcccgccaggctccgaggggaaggggctgggagtgggtggccaacaataaacaaagacggaaagtcaagaaaaacctatgtggactctagtgaacgcgattcaccatctcagagacaacgccaagaattcactgtatttgacaaatnaacagcctgagaggacgaggacgacggccgtagtattatgtgcgcgagatgatagagacgttcttacaagtancgaggtggttatggntg

SEQ ID NO: 370471 - DNA, 544 bp, Homo sapiens
  misc_feature: GZ8MTXP01E1UW0.15.67.G01.1.454.CMB.2.raw
  modified_base (305)..(305): a, c, t, g, unknown or other
  modified_base (493)..(493): a, c, t, g, unknown or other
  modified_base (495)..(495): a, c, t, g, unknown or other
  modified_base (501)..(501): a, c, t, g, unknown or other
  modified_base (520)..(520): a, c, t, g, unknown or other
  modified_base (528)..(528): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagtattggatgacctgggtccnccaggctccgaggggagggctggagtgggtgccaacataaacaaagacggaagtcaagaaaaacctagtgtggactctgtgaacggccgattccaccatctccagacgacaacgaccaaagaattcactgtatttgacaaatgaaacagccgtgaaggaggcgaaggacacggccgtggtattattgngngcgagntggatagtagacttcttanaagtaggngaggtgttatgttgtg

SEQ ID NO: 370472 - DNA, 561 bp, Homo sapiens
  misc_feature: GZ8MTXP01CUZF2.15.67.G01.1.454.CMB.2.raw
  modified_base (457)..(457): a, c, t, g, unknown or other
  modified_base (505)..(505): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacttggtggagtcgtggggggaggcttggtccgaggccggggggggtccctgagactctcctgtgcagtctctggattcacccttagaagtattggatgacctgggtccgccaggctccgaggggaaggggctgggagtggggtggccaaacataaacaaagacggaaagtcaaggaaaaaacctatgtggaactctaggtacgaaccggcccgaattccacatctccagagacaacgcaaagattcactgtatttganaatagacagaccgtgagaggacgaggacgacggccgtgtattatgtgngcgagagtgagtagtagacgttcttacaagtagcgaggtaggttagtgttaagttg

SEQ ID NO: 370473 - DNA, 561 bp, Homo sapiens
  misc_feature: GZ8MTXP01CQJS6.15.67.G01.1.454.CMB.2.raw
  modified_base (514)..(514): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggcccggggggggtccctggagactctcctgtgcagtctctggattcacccttagaagtattggatgacctgggtccgccaggctccgaggggaaggggctggagtgggtggccaaacaataaaacaaagaaccggaaagtcaagaaaaaacctatagtggactctagtagaacggcgattcaccatctccagagacaacgaccaagaattacaactgtatttgacaaatgaaacagccgtagagagcgaggacacgggccgtagtattatgtgcgcgaagnttgataagtagacgttcttaacaagtagcgaggtggttatgaagttg

SEQ ID NO: 370474 - DNA, 548 bp, Homo sapiens
  misc_feature: GZ8MTXP01D361G.15.67.G01.1.454.CMB.2.raw
  modified_base (499)..(499): a, c, t, g, unknown or other
  modified_base (520)..(520): a, c, t, g, unknown or other
  modified_base (531)..(531): a, c, t, g, unknown or other
  modified_base (544)..(544): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggcccggggggggtccctgagactctcctgtgcagtctctggattcacccttagaagtatggatgacctgggtccgccaggctccgaggggaggggctggaggtgggtggccaacaataaacaaagacggaagtacaagaaaaacctatgtggactctgtgaacggccgattccaccatctcagagacaacgaccaagaattcaacttgtatttagacaaatgaaacagccgtagaggaggacgaggacacgggccgtagtattatgtgngcgagatgagtagtagacttnttacaagtagnagggtggttatgngttg

SEQ ID NO: 370475 - DNA, 575 bp, Homo sapiens
  misc_feature: GZ8MTXP01EKZDK.15.67.G01.1.454.CMB.2.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggtgtatcagcagaaatccgggaaagcccctaaagctcctgatctgtgctgcactccactttacaaaggtcgggtacccccatcgaaaggttcagcggcaaggtgatcgtggcacagtatttcactctacacatcagcagcctgcagacctagaacggtacttttcgacttaaacttattactgtactaactaatactttaacaaacttcccgtaacggtacgttaccggtaccggaacggggaacccgtaaagggttaggttaaaacgttaacgaaaacggtaacctaaggttacggacgttacgaaccgttaacccgtaacg

SEQ ID NO: 370476 - DNA, 719 bp, Homo sapiens
  misc_feature: GZ8MTXP01EXG2P.15.67.G01.1.454.CMB.2.raw
tcagtctacgtagccacgaccggtgctcgatttagagtatacatattgggtttggggggtccctgagactctcctgtgcagtctctggattcacccttagaagttattggatgacctgggtccgccaggctccagggaaggggctggagtgggtggccaaacataaaacaaagacggaagtcaagaaaaactatgtggactctgtgaacggccgattcaccatctccagagacaacgccaagaattcactgtatttgcaaatgaacagcctgagaggcgaggacacggcgtgtattatgtgcgcgagatgatagtagactctaacagtagcaaggtggtatgatgtctttttgattagtggtgggggaccaaaagggggacaaggttgggtaccaacccggttcaacctttcgaacgtccccttacccgaacccgaaacggggcccctaacgttcccggggttccccttttacccccccggtggggtccccggcccccgttcggcccgttcccgaacgggaacgccccgtaacccgttcccggaacgacggaccaaccgacggcccggggccccgtgggggtccctcgggtccccgttcggggtaaccgaaacggggttacccttaaccgtttccccggaaccgtttaacggttacggttaccgttcgggaacgggtccgggggcgttacggggaccggaaagggcccgttaacgtaag

SEQ ID NO: 370477 - DNA, 553 bp, Homo sapiens
  misc_feature: GZ8MTXP01AIL2X.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttgggtccaggccggggggggtccctgagactctcctgtgcagtctctggattcacccttagaagtatggatgacctgggtccgccaggctccgaggggaaggggctgggagtggggtggccaacataaacaaagacgaagtcagaaaaacctatgtggactctagtgaacggccgattcaccatctccagagacaacgaccaagaattcactagtactttgacaaatgaaacagaccgtgaaggaggacggaggacgacggccgtaggtattagtgtgcgcgagagtgagtagtagacgttcttacgaagtagcagggtggttatggaattg

SEQ ID NO: 370478 - DNA, 580 bp, Homo sapiens
  misc_feature: GZ8MTXP01AV1HF.15.67.G01.1.454.CMB.2.raw
  modified_base (199)..(199): a, c, t, g, unknown or other
  modified_base (382)..(382): a, c, t, g, unknown or other
  modified_base (386)..(386): a, c, t, g, unknown or other
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaganacagagtcaccatcacttgccgggcaagtcaggacattagaactgacttaggtgtatcagcagaaatccgggaaagcccctaagctcctgatctgtgctgcatccactttacgaaagtgggtacccccatcaaggttcagcgggacaaggtggatctggacacagtatttcactctcacctancgancacgctagcacgtaccgtagaacggttactttacgacttaactttattacgtactactaaactaacgttaacttaacctaaccgttacccgtaacgggtacggttaccgggaccggaacggggtaaccgtaagggttaacgaaacgttacgtaaaacgtacgtaaggtcggtcgttacgtaaccgaaccgtaag

SEQ ID NO: 370479 - DNA, 550 bp, Homo sapiens
  misc_feature: GZ8MTXP01CZ0DL.15.67.G01.1.454.CMB.2.raw
  modified_base (502)..(502): a, c, t, g, unknown or other
  modified_base (507)..(507): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggctttgggtccgagggccggggggggtccctggagactctcctgtgcagtctctggattcacccttagaagtattggatgacctggtccgccaggctccaggggaagggctggagtgggtggccaaacaataaacaaagacggaagtacaagaaaaacctatgtggaactctagtgaacggccgattccacatctccagagacaacgaccaaagaatcaactgtatttgacaaatgaacagccgtagaagagacgaggacgacggcctagtattatgtgcgngagangatagtaagacgttcacaagtagcgaggtggttatggaattcg

SEQ ID NO: 370480 - DNA, 613 bp, Homo sapiens
  misc_feature: GZ8MTXP01EBH2Y.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtggggggaggcttgggtccaggccgggggggtccctgagactctcctgtgcagtctctggattcacccttagaagtattggatgacctgggtccgccaggctccgaggggaaggggctgggagtggggtggaccaaacaataaaacgaaaggacggaaagtacaaagaaaaacctatagtaggactcgtagtagaacggccgaattccaccatcaccagacgaacaacgaccaaagaactttacaacttagttaatttagactaaaatagaaacagaccgtaggaaggaggacggaaggaacgacgggccgttaggtatttagttggtgcgaacgaggataggacgttaaggtaacggacttcttaacgtaagtagcgtagggtggttatggttaatttaagg

SEQ ID NO: 370481 - DNA, 511 bp, Homo sapiens
  misc_feature: GZ8MTXP01CAI1G.15.67.G01.1.454.CMB.2.raw
  modified_base (278)..(278): a, c, t, g, unknown or other
  modified_base (349)..(349): a, c, t, g, unknown or other
  modified_base (429)..(429): a, c, t, g, unknown or other
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggtggtatcagcagaaatccgggaaancccctaagctcctgatcgtgtgctgcatccactttaacaaagtcggggtcccccatcgaggttcaggcgcngtgatcgtggcacgagtatttcactctcacatcagcagcctgcagctagaggtatttcgctaactttatactgtactaanagtattacaacttccctcggcttcgaccgagggaacccaaggttaggaattacgaaacgactggtagcgagtccaaccgtaa

SEQ ID NO: 370482 - DNA, 540 bp, Homo sapiens
  misc_feature: GZ8MTXP01BCSDE.15.67.G01.1.454.CMB.2.raw
  modified_base (386)..(386): a, c, t, g, unknown or other
  modified_base (412)..(412): a, c, t, g, unknown or other
  modified_base (486)..(486): a, c, t, g, unknown or other
  modified_base (491)..(491): a, c, t, g, unknown or other
  modified_base (512)..(512): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggggtccctgagactctcctgtgcagtctctggattcacccttagaagtattggatgacctgggtccgccaggctccgaggggaaggggctgggagtgggtggccaacataaaacaaagacggaagtcaagaaaacctatgtggactcngtgaacggcgattcaccatctcaganacacgcaagattcactgtattgacaaatgaaacaacctggagaggcgaggacacggccgtagtattatgtgcgngaagnttgattagtagacttcgttanagtaagcaaggtggtattgaattgttcg

SEQ ID NO: 370483 - DNA, 513 bp, Homo sapiens
  misc_feature: GZ8MTXP01AU748.15.67.G01.1.454.CMB.2.raw
  modified_base (296)..(296): a, c, t, g, unknown or other
  modified_base (315)..(315): a, c, t, g, unknown or other
  modified_base (317)..(317): a, c, t, g, unknown or other
  modified_base (319)..(319): a, c, t, g, unknown or other
  modified_base (321)..(321): a, c, t, g, unknown or other
  modified_base (324)..(324): a, c, t, g, unknown or other
  modified_base (329)..(329): a, c, t, g, unknown or other
  modified_base (331)..(331): a, c, t, g, unknown or other
  modified_base (334)..(334): a, c, t, g, unknown or other
  modified_base (343)..(343): a, c, t, g, unknown or other
  modified_base (346)..(346): a, c, t, g, unknown or other
  modified_base (352)..(352): a, c, t, g, unknown or other
  modified_base (354)..(354): a, c, t, g, unknown or other
  modified_base (356)..(357): a, c, t, g, unknown or other
  modified_base (380)..(380): a, c, t, g, unknown or other
  modified_base (391)..(391): a, c, t, g, unknown or other
  modified_base (405)..(405): a, c, t, g, unknown or other
  modified_base (407)..(407): a, c, t, g, unknown or other
  modified_base (410)..(410): a, c, t, g, unknown or other
  modified_base (412)..(412): a, c, t, g, unknown or other
  modified_base (414)..(414): a, c, t, g, unknown or other
  modified_base (420)..(420): a, c, t, g, unknown or other
  modified_base (451)..(451): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttcgtgtagttatttagaaggtgtcagtgtgaggtgcacttggtggagtcgtggggggaggcttggtccaggccgggggggtccctgagactctcctgtgcagtctctggattcacctagagtatggatgacctgggccncaggctcgaggggacgggngngngnggngacananaanaagagaganaanaaacangngnntagagcgcgatcacatcacaganacaacgacaanaatactatatatananaanananagacgngagagacgagacgacgcgtagtatatagtgngcgagagtagagtagtagttacgttacttacgtaagtagtaagtaggtaggttagtgttgtg

SEQ ID NO: 370484 - DNA, 554 bp, Homo sapiens
  misc_feature: GZ8MTXP01EA3LJ.15.67.G01.1.454.CMB.2.raw
  modified_base (343)..(343): a, c, t, g, unknown or other
  modified_base (530)..(530): a, c, t, g, unknown or other
  modified_base (537)..(537): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacttgggtggagtcgtggggggaggcttgggtccgagggcccgggggggtccctgagactctcctgtgcagtctctggattcatccttagaagttatggatgacctggtccgcaggctccgaggaaggggctggagtgggtgccaanataaacaaagacggaagtcaaaggaaaaactagtgtggactctgtggaacggccgattccacatctccagagacaacgaccaaagaattcacttgtatttgactaaatagaaacaggacctggaagaggcgaggacgacgggtccgtgtattagttgtgcgtcgagattgaatagagttcttctaanagtaagnaggttgtaagttgtaag

SEQ ID NO: 370485 - DNA, 555 bp, Homo sapiens
  misc_feature: GZ8MTXP01CGQXQ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggccggggggggtccctgagactctcctgtgcagtctctggattcacccttagaagtattggatgacctgggtccgccaggctccgaggggaaggggctgggagtgggtgggccaacaataaacaaaagacggaaagtcaagaaaaaaccctatgtggactctgtgaacggccgattcaaccatctccagacgacaacggaccaagaacttcactgtatttgacaaatgaaacagcctgagaggccgaggacgacggccgttagtattattgtgcgcgagatgagtagtagacttcttacaagtagcaggtggttatgaattg

SEQ ID NO: 370486 - DNA, 555 bp, Homo sapiens
  misc_feature: GZ8MTXP01CSB9E.15.67.G01.1.454.CMB.2.raw
  modified_base (498)..(498): a, c, t, g, unknown or other
  modified_base (503)..(503): a, c, t, g, unknown or other
  modified_base (505)..(505): a, c, t, g, unknown or other
  modified_base (520)..(520): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtccgggggaggcttggtccaggccggggggtccctgagactctcctgtgcagtctctggattcacccttagaagttatggatgacctgggtccgccaggctccgagggaaggggctgggagtgggtggaccaacaataaaacaaagacggaagtacaagaaaaactataggtggactctgtagaacggccgatcaccatccaccagagacaacgaccaagaattcactgtatttgacaaatgaacagcctagggagaggcgaagggacacggcgtgtattgttgtgccgngaagngngattagtagacgttnttacagtaagcgaaggtggtattgtaattgttaag

SEQ ID NO: 370487 - DNA, 556 bp, Homo sapiens
  misc_feature: GZ8MTXP01C22RS.15.67.G01.1.454.CMB.2.raw
  modified_base (343)..(343): a, c, t, g, unknown or other
  modified_base (509)..(509): a, c, t, g, unknown or other
  modified_base (531)..(531): a, c, t, g, unknown or other
  modified_base (538)..(538): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtccctgagactctcctgtgcagtctctggattcacccttagaagtatggatgacctgggtccgcaggctccgaggggaaggggctgggagtgggtggaccaanaataaaacaaagacggaaagtacaagaaaaaacctatgtaggactcgtagtgaacggccgattcacatctaccagagacaacgccaaagaattcaactgtatttgacaaatgaaacagaccgtaggaaggaggcggaaggacgacggccgtagtattatgtagcgngagatggatagtagacgttcanaagtagngaggtgttatgaagttcg

SEQ ID NO: 370488 - DNA, 547 bp, Homo sapiens
  misc_feature: GZ8MTXP01C6IO1.15.67.G01.1.454.CMB.2.raw
  modified_base (335)..(335): a, c, t, g, unknown or other
  modified_base (363)..(363): a, c, t, g, unknown or other
  modified_base (488)..(488): a, c, t, g, unknown or other
  modified_base (513)..(513): a, c, t, g, unknown or other
  modified_base (520)..(520): a, c, t, g, unknown or other
  modified_base (531)..(531): a, c, t, g, unknown or other
tcagtctacgtagccacgaccggtgctcgatttagagtatacatattgggtttggggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggcttggtccaggccggggggtcctgagactctcctgtgcagtctctggattcacccttagaagttatggatgacctgggtccgcaggctccagggaggggctggagtggtgcaanataaacaaagacgaagtcaagaaaactntgtaggactctgtagaacggccgattcaaccatcctccagacgacaacgaccaaagaatacactagtatttgacaaatagaacagcctggggagaggcgaggacacggccgtgtattatgtgcgngaagattggattagtagacttcganagtaagntaaggtaggtnttaggtaattgttaag

SEQ ID NO: 370489 - DNA, 541 bp, Homo sapiens
  misc_feature: GZ8MTXP01BRC4W.15.67.G01.1.454.CMB.2.raw
  modified_base (341)..(341): a, c, t, g, unknown or other
  modified_base (382)..(382): a, c, t, g, unknown or other
  modified_base (408)..(408): a, c, t, g, unknown or other
  modified_base (496)..(496): a, c, t, g, unknown or other
  modified_base (511)..(511): a, c, t, g, unknown or other
  modified_base (518)..(518): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtccgggggaggcttggtccaggccggggggtccctgagactctcctgtgcagtctctggattcacccttagaagttatggatgacctgggtccgccaggctccgaggggaaggggctggagtgggtggccaaanataaacaaagacggaagtacaagaaaactatagtggactcngtagaacgcgatcaccatctccaganacaacgccaagatcactgtatttagacaaatgaaactagccgtagggagagggcgaagggacacggccgtgtattatgtgcgcgaagnttgattgagcttcanagtaagngaaggtggtattgtaagttgttg

SEQ ID NO: 370490 - DNA, 545 bp, Homo sapiens
  misc_feature: GZ8MTXP01DZFYY.15.67.G01.1.454.CMB.2.raw
  modified_base (521)..(521): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccggggggggtccctgagactctcctgtgcagtctctggattcacccttagaagtatggatgacctgggtccgccaggctccgaggggaaggggctgggagtgggtggccaacataaacaaagacggaagtcaagaaaaacctatagtggactctgtgaacggccgattccaccatctccagagacaacgccaagaattcaactgtatttgacaaaatgaaacagccgtagagaggcgaggacacggccgtagtattatgtgcgcgagatgatagtagacttcttacngtagcgagggtggttatgaagttg

SEQ ID NO: 370491 - DNA, 810 bp, Homo sapiens
  misc_feature: GZ8MTXP01B4JI6.15.67.G01.1.454.CMB.2.raw
  modified_base (745)..(745): a, c, t, g, unknown or other
tcagtctacgtagccacgaccggtgctcgatttagagtatacatattgggttttgaggtctcagagaggagccttagccctggactccaaggccttttccacttggtgatcagcactgagcacagaggactcaccagtggaggttggggctgagtcgttgggtttttcctttgtttgtttattttagaaggtgtcagtgtgaggtgcgtacgttggtggaggtcggtggggggaggtcgtttcgggtccggacggggtccccggggggggttccctggacgtaccttcctccgtgtcgcgtagttccttcgtggtactttacctaacccgtttaaggtaaagttagttaggacgttacggtacccggttcggggtccccgacccgacgggtccgtacccgggaaaggggggaacgggggtcgtgggggtaagggttcgggggtacggaaacccaaaaacgtaaaacgtaaaaaaaccggaaaaacgggaaacggggtaaaagtaaacgaaaaacggtaaaaaaacccgttaggttaggttacggtaaccttcggttaagggttaaccgggaacccgggtacccgtaaactttacccaaccctacttaccgtaccgaaagaacgaaaccgaaaccgaaccaaagtaacttactaacgttagttatttagaactaaagtaacgaaacgacgacggtaggaaggacgggacggaacggacgaccggtcgttagttattagttggtcgnggaagagttagtgaagtaagtacgttacgttcaagtaagtagaacggtaggtgttagtgttgttg

SEQ ID NO: 370492 - DNA, 547 bp, Homo sapiens
  misc_feature: GZ8MTXP01EZJ48.15.67.G01.1.454.CMB.2.raw
  modified_base (374)..(374): a, c, t, g, unknown or other
  modified_base (414)..(414): a, c, t, g, unknown or other
  modified_base (497)..(497): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtggggggaggcgttgggtccaggcccgggggggtccctgagactctcctgtgcagtctctggattcacccttagaagtatggatgacctgggtccgccaggctccaggggagggctggagtgggtggcaacaataaacaaagacgaagtcaagaaaaacctntgtggactctagtagaacggccgattcaccatctccaganacaacgaccaaagaattcactagttatttgacaaatgaacagaccgtgagaggacgaggaccacggccgtagtattatgtagngcgagatgagtagtagacgttcaacgaagtagcgaggtgttatgaattgg

SEQ ID NO: 370493 - DNA, 534 bp, Homo sapiens
  misc_feature: GZ8MTXP01EARTI.15.67.G01.1.454.CMB.2.raw
  modified_base (488)..(488): a, c, t, g, unknown or other
  modified_base (511)..(511): a, c, t, g, unknown or other
  modified_base (517)..(517): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagtatggatgacctgggtccgccaggctccgaggggagggctggagtgggtggccaacataaacaaagacggaagtacaagaaaaacctatgtggactctgtagaacggcgattcaccatctccagagacaacgcaagattcactgtattgacaaatgaaacagccgtagagaggcgaggacacggcgtagtattagttgtgcgngagatgagtagtagacttcttangtaggngtaggtgttatgttgtg

SEQ ID NO: 370494 - DNA, 620 bp, Homo sapiens
  misc_feature: GZ8MTXP01EMDSP.15.67.G01.1.454.CMB.2.raw
  modified_base (477)..(477): a, c, t, g, unknown or other
  modified_base (485)..(485): a, c, t, g, unknown or other
  modified_base (551)..(551): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccggggggtcctgagactctcctgtgcagtctctggattcacccttagagtatggatgacctgggtccgcaggctccgagggggaagggctgggagtggggtggaccaaacaataaaacaaagacggaaagtaccaaagaaaaaacctagtagtaggacttcgtagtacgaacgggccgaaattccaaccctaatcctaccaagaacgaaccaaacggaccaaagtaattacaactagttaatttanaactaaanacgaacacgacgtaggaaggacggacggaacggaccgacggtacgttagttattagtacgtcgcgngtaagagtagttaacgtaaggtaagacttacgttaacgtaagtagaacgtaggtagttatgttaacgtg

SEQ ID NO: 370495 - DNA, 571 bp, Homo sapiens
  misc_feature: GZ8MTXP01ELJSH.15.67.G01.1.454.CMB.2.raw
  modified_base (429)..(429): a, c, t, g, unknown or other
  modified_base (514)..(514): a, c, t, g, unknown or other
  modified_base (550)..(550): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactgaccatggagttggggctgagctgggttttccttgttgttattttagaaggtgtccagtgtgaggtgcacgttggtggagtcgtggggggaggcgttggtccgaggccgggggggtccctgagactctcctgtgcagtctctggattcacccttagaagtattggatgacctgggtcccgccaggctccgaggggaggggctgggagtggggtggccaaacataaaacaaagacggaagtacaagaaaaacctatgtaggactcgtagtacgaacgggcctattccaccatcctcaaganacaacgaccaagaattcaacttgttatttgacaaatagaaacagacctagaggaggacgaggacgacggccgtgtattattgtgngcgagagtgaagtagtagacttcttaacgaagtagngaggtggttatgttaagttgg

SEQ ID NO: 370496 - DNA, 583 bp, Homo sapiens
  misc_feature: GZ8MTXP01EMKXC.15.67.G01.1.454.CMB.2.raw
  modified_base (301)..(301): a, c, t, g, unknown or other
  modified_base (379)..(379): a, c, t, g, unknown or other
  modified_base (456)..(456): a, c, t, g, unknown or other
  modified_base (459)..(459): a, c, t, g, unknown or other
  modified_base (461)..(461): a, c, t, g, unknown or other
  modified_base (464)..(464): a, c, t, g, unknown or other
  modified_base (505)..(505): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttcctgttgttattttagaaggtgtcagtgtgaggtgcacttggtggagtcgtggggggagcgttggtccaggccgggggggtccctggagactctcctgtgcagtctctggattcaccttagaagtatgatgactgggtccnccagactccgaggggaagggctggagtgggtggaccaaacaataaaacgaaagaacggaatacaaagtaaaaaacctntagtggactcgtacgtagaaccgggcaattcaaccatctccaagagacaacgacaaagaattacatagtattgaaanaananaanagacgagagagacgacgacgacgacgtagtagttagtgtgngaagaagagtagttaagtaagtaacgttacgttacgttaacgtaagtagtaacggtaggtaggttagtaagttaagtg

SEQ ID NO: 370497 - DNA, 582 bp, Homo sapiens
  misc_feature: GZ8MTXP01D791T.15.67.G01.1.454.CMB.2.raw
  modified_base (305)..(305): a, c, t, g, unknown or other
  modified_base (379)..(379): a, c, t, g, unknown or other
  modified_base (552)..(552): a, c, t, g, unknown or other
  modified_base (560)..(560): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggcccgggggggtccctgagactctcctgtgcagtctctggattcaccctagaagtattggatgacctgggtccnccagctccgagggagggctggagtgggtggccaacaataaaacgaaagacggaaagtacaaagaaaaaaccctntagtaggaactctaggtagaaccgggccgtaattccacctatcctccaagacgacaacgacaaagaattcaactgttaattgacaaaatagaaacagaccgtaggagaggacgaggacgacggccgtagtattagttgtacgcgaacgagatgagtaagtagaacttcttaanaaggtagngtagggtagttagtgaagtttg

SEQ ID NO: 370498 - DNA, 573 bp, Homo sapiens
  misc_feature: GZ8MTXP01C0A1Z.15.67.G01.1.454.CMB.2.raw
  modified_base (451)..(451): a, c, t, g, unknown or other
  modified_base (458)..(458): a, c, t, g, unknown or other
  modified_base (460)..(460): a, c, t, g, unknown or other
  modified_base (462)..(462): a, c, t, g, unknown or other
  modified_base (466)..(466): a, c, t, g, unknown or other
  modified_base (503)..(503): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggttttccttgttgttattttagaaggtgtccagtgtgaggtgcacttggtggagtctgggggaggcttggtccagccggggggggtccctgagactctcctgtgcagtctctggattcacccttagaagtattggatgacctgggtccgccaggctccgaggggaaggggctggagtgggtggaccaaacaataaaacaaagacggaaagtcaagaaaaaaaccctatgtggtaactctgtagaacgggcccaattccaccatctccagagacaacgccaagaattcaatgtatttnacaaatnananacgngaggagacgaggacgacgacgtagtagttagttgtgnggaacgagagtagagtaagtaagttacgttacttacgtaagtagtaacgtaggtaggttagtgttaagtg

SEQ ID NO: 370499 - DNA, 549 bp, Homo sapiens
  misc_feature: GZ8MTXP01AC4QN.15.67.G01.1.454.CMB.2.raw
  modified_base (490)..(490): a, c, t, g, unknown or other
  modified_base (494)..(494): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggattcgtggggggaggcttgggtccaggccgggggggtccctgagactctcctgtgcagtctctggattcacccttagaagttattggatgacctgggtccgccaggctccaggggaggggctggagtgggtggccaacataaacaaagacggaagtcaagaaaaacctatgtggactcgtagtgaacggcgattcaccatctcagagacaacgccaaagattcactgtatttgacaaatgaaacagcctagagaggacgaggacgacggccgtgtattattggngcgngagatagagtagtacacgttcttacgaagtagcgtagggtggttatgttaagtcg

SEQ ID NO: 370500 - DNA, 533 bp, Homo sapiens
  misc_feature: GZ8MTXP01ASGC1.15.67.G01.1.454.CMB.2.raw
  modified_base (408)..(408): a, c, t, g, unknown or other
  modified_base (507)..(507): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccgggggggtccctgagactctcctgtgcagtctctggattcacccttagaagtattggatgacctgggtccgccaggctccaggggaaggggctggagtggggtggccaacataaaacaaagacggaagtcagaaaaaaccctatgtggactctgtgaacgaccgattcaccatcnccagagacaacgccaagaattcactgtatttgcaaatgaacagcctgagaggcgaggacacggccgtgtattatgtgcgcgagatgagtagtagacttnttacaagtagcaggtggttatgaatg

SEQ ID NO: 370501 - DNA, 560 bp, Homo sapiens
  misc_feature: GZ8MTXP01DUU7Q.15.67.G01.1.454.CMB.2.raw
  modified_base (536)..(536): a, c, t, g, unknown or other
  modified_base (541)..(541): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggggttttccttgttgttattttagaaggtgtccagtgtgaggtgcacttggtggagtcgtggggggaggcttgggtccaggcccggggggggtccctgagactctcctgtgcagtctctggattcacccttagagtattggatgacctgggtccgccaggctccgaggggaggggctggagtgggtgaccaacaataaaacaaagacggaaagtcaagaaaaacctatgtggactctagtgaacggcgattccaccatctcagagacaacgaccaagaattcaacttgtattgacaaatgaaacagccgtaggaaggagggacggaggacgacgggccgtagttattagttgtgcggaacgagatgagtagtagacttcaacngtagngagggtgttatgaagttcg

SEQ ID NO: 370502 - DNA, 556 bp, Homo sapiens
  misc_feature: GZ8MTXP01BKG39.15.67.G01.1.454.CMB.2.raw
  modified_base (507)..(507): a, c, t, g, unknown or other
  modified_base (528)..(528): a, c, t, g, unknown or other
  modified_base (537)..(537): a, c, t, g, unknown or other
  modified_base (552)..(552): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggccggggggggtccctgagactctcctgtgcagtctctggattcacccttagaagttattggatgacctgggtccgccaggctccgaggggaaggggctgggagtgggtggccaacataaacaaagacggaagtcaagaaaaaacctatagtggactctgtagaacggccgattccaccatctcagagacaacgccaagaattcactagtatttagacaaatgaaacacgaccgtgaaggagggacgaggacgacggccgtgtattattgtgcgngagagtagagtagtagacttnacaagtagntaagggtgttagtgngttg

SEQ ID NO: 370503 - DNA, 552 bp, Homo sapiens
  misc_feature: GZ8MTXP01ELO5V.15.67.G01.1.454.CMB.2.raw
  modified_base (376)..(376): a, c, t, g, unknown or other
  modified_base (455)..(455): a, c, t, g, unknown or other
  modified_base (503)..(503): a, c, t, g, unknown or other
  modified_base (523)..(523): a, c, t, g, unknown or other
  modified_base (531)..(531): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcttggtccagggcccggggggtcctgagactctcctgtgcagtctctggattcacccttagaagtatggatgacctgggtccgccaggctccgaggggaaggggctgggagtgggtggccaacataaaacaaagacgaagtcaagaaaaacctntgtggactgtagtgaacggcgattccaccatctaccagagacaacgccaaagaattcaactgttatttgacaaatgaanagacctgaggaggcgaaggacacggcgtagtagttattgtgcgcgganagtgaagtagtagacttcanaagtacgngtagggtgttatgttaagttg

SEQ ID NO: 370504 - DNA, 542 bp, Homo sapiens
  misc_feature: GZ8MTXP01EF5Q1.15.67.G01.1.454.CMB.2.raw
  modified_base (414)..(414): a, c, t, g, unknown or other
  modified_base (494)..(494): a, c, t, g, unknown or other
  modified_base (525)..(525): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggcccgggggggtccctggagactctcctgtgcagtctctggattcacccttagaagtatggatgacctgggtccgccaggctccgaggggaaggggctggagtgggtggaccaacaataaaacaaagacggaaagtcaagaaaaacctatgtggactctagtgaacggcgattcaccatcnccagagacaacgcaaagattacactgtattgacaaatgaaacagccgtgagaggcgaggacacggccgtgtattatgtgngcgagatggaatagtaagacttcacaagtancgaggtggttatgaatg

SEQ ID NO: 370505 - DNA, 549 bp, Homo sapiens
  misc_feature: GZ8MTXP01AGJP4.15.67.G01.1.454.CMB.2.raw
  modified_base (498)..(498): a, c, t, g, unknown or other
  modified_base (500)..(500): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagtattggatgacctgggtccgccaggctccgaggggaaggggctggagtggggtggccaacaataaaacaaagacggaaagtcaagaaaaacctatgtggactctagtgaacggccgattcaccatctccagagacaacgccaaagaattcactgtatttgacaaatgaacagccgtgagaggcgaggacgacggccgtgtattagttgtgcggngngatgagtagtagacttcttacaagtagcgtagggtggttagtgaagttg

SEQ ID NO: 370506 - DNA, 537 bp, Homo sapiens
  misc_feature: GZ8MTXP01B4AUN.15.67.G01.1.454.CMB.2.raw
  modified_base (494)..(494): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggggttttccttgttgttatttttagaaggtgtccagtgtgaggtgcacttggtggagtctggggggaggcttggtccagccgggggggtccctgagactctcctgtgcagtctctggattcacccttagaagtattggatgacctggggtccgccaggctccaggggaaggggctgggagtggggtggccaacataaacaaagacggaagtcagaaaaacctatgtggactctgtgaacggccgattcaccatctccagagacaacgccaagattcactgtatttgacaaatgaacagccgtggagaggcgaggacgacggcgtgtattatgtgcgcgagntgagtagtagacttcttacaagtagcagggtgttatgaagttg

SEQ ID NO: 370507 - DNA, 566 bp, Homo sapiens
  misc_feature: GZ8MTXP01CFZDM.15.67.G01.1.454.CMB.2.raw
  modified_base (330)..(330): a, c, t, g, unknown or other
  modified_base (443)..(443): a, c, t, g, unknown or other
  modified_base (513)..(513): a, c, t, g, unknown or other
  modified_base (515)..(515): a, c, t, g, unknown or other
  modified_base (517)..(517): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtcagtgtgaggtgcacttggtggagtcgtgggggaggcttggtccgaggccgggggggtccctgagactctcctgtgcagtctctggattcaccttagaagtattggatgactggtccgccaggctccgagggaagggctggagtgggnggaccaaacaataaaacaaagacggaaagtacaaagaaaaaacctatagtaggaactcgtagtagaaccggccgaatttcacccatccaccaagaacgaacaaacgaccaaanaattacactagtatttagacaaaatagaaacaagccgtgaagaggacgaggactacggcgtgtatattgngngngagatagagtagacacttcttagaagtagcgaggtaggttagtgttgtg

SEQ ID NO: 370508 - DNA, 587 bp, Homo sapiens
  misc_feature: GZ8MTXP01A6E7I.15.67.G01.1.454.CMB.2.raw
  modified_base (342)..(342): a, c, t, g, unknown or other
  modified_base (500)..(500): a, c, t, g, unknown or other
  modified_base (523)..(523): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagtatggatgacctgggtccgccaggctccgaggggaagggctgggagtgggtggccaaanataaacgaaagacggaagtacaagaaaaacctatggtaggacctcgtagtagaaccggccgtaattcaccatcctaccagacgaacaaacgacccaaagtaacttcaacttgttaatttgactaaaatgaaacaagccgtaggagaggacgaggaccncggacgtgtattattggtgccgngagagtagaagtagtagacttcgactaaggtagtaacgaggggtgttaagtgttaacgttaagg

SEQ ID NO: 370509 - DNA, 553 bp, Homo sapiens
  misc_feature: GZ8MTXP01DL7RZ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattcacccttagaagtattggatgacctgggtccgccaggctccgaggggaaggggctggagtggggtggaccaacataaaacaaaggacggaaagtacaagaaaaaacctagtagtaggactcgtgtagaacggccgaattcaccatctccagagacaacgaccaagaattacactgtactttgacaaatagaacagccgtagagaggcgaggacgacggccgtagtattatgtgcgcgagatgatagtagacttcttacgaagtagcgaggtgatgaattg

SEQ ID NO: 370510 - DNA, 604 bp, Homo sapiens
  misc_feature: GZ8MTXP01DTRJT.15.67.G01.1.454.CMB.2.raw
  modified_base (300)..(300): a, c, t, g, unknown or other
  modified_base (372)..(372): a, c, t, g, unknown or other
  modified_base (546)..(546): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtcagtgtgaggtgcacttggtggagtcgtgggggagcttggtccgaggccggggggtccctgagactctcctgtgcagtctctggattcacccttagaagtatggatgacctggtccnccaggctccgagggagggctggagtgggtggaccaacaataaacaaagacggaaagtcaaagaaaaaacctntagtaggaactcgtagtagaacgggccgtaattccaacctaatcctacccgaagaacgaaccaaaccggacccaaaagaaacttacaacttagtaattttacggacaaaattaggaaacagacccgtggaacgagggaccgaggacgacgggtccgtaggtattagtgtcgcgngaagatgatagtagaccttgttaaccgaagtaagcgtaagggtgttaatgaagtttgg

SEQ ID NO: 370511 - DNA, 540 bp, Homo sapiens
  misc_feature: GZ8MTXP01CCBXV.15.67.G01.1.454.CMB.2.raw
  modified_base (482)..(482): a, c, t, g, unknown or other
  modified_base (508)..(508): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggggtctgggggaggcttgggtccaggccgggggggtccctgagactctcctgtgcagtctctggattcacccttagagttatggatgacctgggtccgccaggctccgagggaaggggctggagtgggtggccaacataaacaaagacggaagtacagaaaaactatgtggactctgtgaacggccgatcaccatctccagagacaacgccaagaattcactgtatttgacaaatgaacagcctggagaggcgaggacgacggcgtgtatatgtgcgngaagattgattaggtagcttcgttanaggtaagcaagggtggtattgtaagttgttcg

SEQ ID NO: 370512 - DNA, 490 bp, Homo sapiens
  misc_feature: GZ8MTXP01EYXPO.15.67.G01.1.454.CMB.2.raw
  modified_base (319)..(320): a, c, t, g, unknown or other
  modified_base (337)..(337): a, c, t, g, unknown or other
  modified_base (340)..(340): a, c, t, g, unknown or other
  modified_base (342)..(342): a, c, t, g, unknown or other
  modified_base (456)..(456): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgaggccggggggtcccgtgagactctcctgtgcacgtctcgtgtacttactaccttagtaagttagtagtagtcgacgtcggtccgcccnngcgcgcgagggaggcgnggngnggacgacacgacgaacgaagacgaacgacgacgaactagtgtagacgtcgtacggtacgacgacgtactacacacacacacgacgacacgacaactacttactacttagtatanacgacacgaagagcgagagacgaacgaacgaacg

SEQ ID NO: 370513 - DNA, 679 bp, Homo sapiens
  misc_feature: GZ8MTXP01CU08N.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtgggggaggctttgggtccgagggcccgggggggtccctggagactctcctgtgcagtctctggattcacccttagaagttattggatgacctgggtccgccgaggctccgaggggaaggggctgggaggtggggtggacccaaaacgaaataaaaccgaaaaggaaccggaaaagtaccgaaaggaaaaaaaacccttagtacgttagggaacttcgtagggttaggaaccggcccgtaatttaccacctaactcctacccgaaagaacgaacaaaaccgacccaaaagaacttaccaacttagttaatttagacaaaatgaaacagaccgtagaaggacggacgaaggaccgacggcgtagtattattgtgcggaaggtagagttaggattaaggtacgttaacttcgttaaaccgtaaggtacggtcggtagggtttagggttattaaggttaagttttccgg

SEQ ID NO: 370514 - DNA, 546 bp, Homo sapiens
  misc_feature: GZ8MTXP01BW9OY.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccagccgggggggtccctgagactctcctgtgcagtctctggattcacccttagaagtattggatgacctgggtccgccaggctccgaggggaagggggctgggagtggggtggccaaacataaaacaaagacggaaagtcaagaaaaaacctatgtggactctgtgaacgggccgattcaccatctccagagacaacgccaagaattcactgtatttgacaaatgaaacagcctagagaggcgaggacacggccgtgtattattgtgcgcgagatggataggtagacttcttacaagtagcagggtggttatgaagttg

SEQ ID NO: 370515 - DNA, 548 bp, Homo sapiens
  misc_feature: GZ8MTXP01CEIOX.15.67.G01.1.454.CMB.2.raw
  modified_base (301)..(301): a, c, t, g, unknown or other
  modified_base (339)..(339): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcaccctagaagtatggatgacctggtccncaggctccgaggggagggctggagtgggtggaccaaanataaacaaagacggaaagtacaagaaaaaacctatgtggactctgtagaacgccgattccacatctccagagacaacgcaaagaatcatgtattgacaaatgaacagctgagaggacgaggacacggcgtagtattagttgtgcgaaggagattgagttaagtagaacgttcttaactaagtaggctaagggtggttaatgaagtttgg

SEQ ID NO: 370516 - DNA, 563 bp, Homo sapiens
  misc_feature: GZ8MTXP01D8ICI.15.67.G01.1.454.CMB.2.raw
  modified_base (382)..(382): a, c, t, g, unknown or other
  modified_base (507)..(507): a, c, t, g, unknown or other
  modified_base (541)..(541): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccggggggtccctgagactctcctgtgcagtctctggattcacccttagaagtattggatgacctgggtcccgccaggctaccgaggggaaggggctggaggtggggtggaccaaacaataaacgaaagacggaaagtacaagaaaaacctntagtggactcgtagtgaacggcgattcaccatctccagagaacaacgaccaaagaatcactgtatttagacaaatgaaacagccgtagagaggcgaggacacggccgtagtattagtgtagccgngagagtgagtaagtagacttcttacgaagtacgngtaggtggttatcgttaagttg

SEQ ID NO: 370517 - DNA, 541 bp, Homo sapiens
  misc_feature: GZ8MTXP01B0ONP.15.67.G01.1.454.CMB.2.raw
  modified_base (496)..(496): a, c, t, g, unknown or other
  modified_base (500)..(500): a, c, t, g, unknown or other
  modified_base (519)..(519): a, c, t, g, unknown or other
  modified_base (524)..(524): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacttggtggagtctggggggaggcttgggtccaggccggggggggtccctgagactctcctgtgcagtctctggattcacccttagaagtatggatgacctgggtccgccaggctccaggggaaggggctgggagtgggtggccaacataaacaaagacggaagtacaagaaaaacctatgtggactctagtgaacggcgattcaccatctccagagacaacgcaagattcactgtatttgacaaatgaaacagcctggagagggacgaggacacgggccgtggtattattgtgccgngagntgagtagtagacttcttangtagnagggtgttatgaagttg

SEQ ID NO: 370518 - DNA, 535 bp, Homo sapiens
  misc_feature: GZ8MTXP01EQWDF.15.67.G01.1.454.CMB.2.raw
  modified_base (490)..(490): a, c, t, g, unknown or other
  modified_base (492)..(492): a, c, t, g, unknown or other
  modified_base (514)..(514): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccaggccgggggggtccctgagactctcctgtgcagtctctggattcacccttagaagtatggatgacctgggtccgccaggctccaggggaaggggctgggagtggggtggcaacataaacaaagacggaagtcagaaaaacctatagtggactctagtgaacggccgattcaccatctccagagacaacgccaaagaattcactgtaattgcaaatgaaacagcctgagaggcgagacgacggccgtagtattatgtgcgngngatgagtagtagacttcttacngtagcaggtgttatggaattg

SEQ ID NO: 370519 - DNA, 558 bp, Homo sapiens
  misc_feature: GZ8MTXP01BMR3T.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagacggtgtccagtgtgaggtgcacttggtggagtcgtgggggaggcttggtccgaggccggggggtccctgagactctcctgtgcagtctctggattcacccttagaagtattggatgacctgggtccgccaggctccgaggggaaggggctggaggtgggtggccaacataaacgaaaggaccggaaagtacaagaaaaacctatagtggactctagtagaacggccgattccaccatcctccagacgacaacgccaaagaattcactgtatttgacaaatgaacagcctgagaggacgaggacgacggccgtagtattagtgtgcgcgagagtagagtagtagacttcttacgaagtagctagggtggttatgaagtttcg

SEQ ID NO: 370520 - DNA, 579 bp, Homo sapiens
  misc_feature: GZ8MTXP01D4U9G.15.67.G01.1.454.CMB.2.raw
  modified_base (527)..(527): a, c, t, g, unknown or other
  modified_base (531)..(531): a, c, t, g, unknown or other
  modified_base (558)..(558): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttggtccagggccgggggggtccctgagactctcctgtgcagtctctggattcacccttagaagtattggatgacctgggtccgccaggctccgaggggaaggggctgggagtggggtggaccaaacaataaaacgaaaggaacggaaagtacaaagaaaaaacctatagtaggactcgtagtagaacgggccgaattcaccatcctccaagacgaacaacgaccaaagaattcaacttgtatttgacaaatgaaacagccgtagaggacggcgaaggacgacggccgtagtattagtgtgcgngagntgagtagtagacgttcaacgaagtagngtagggtggttatgaagttgg

SEQ ID NO: 370521 - DNA, 545 bp, Homo sapiens
  misc_feature: GZ8MTXP01C8QVS.15.67.G01.1.454.CMB.2.raw
  modified_base (494)..(494): a, c, t, g, unknown or other
  modified_base (526)..(526): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggctttggtccaggcccgggggggtccctgagactctcctgtgcagtctctggattcacccttagaagtattggatgacctgggtccgccaggctccgaggggaaggggctgggagtggggtggccaacataaacaaagacggaagtcaagaaaaacctatagtggactctagtgaacggcgattcaccatctccagagacaacgccaagaattcactgtatttgacaaatgaaacagcctagagaggcgaggcacggcgtagtattagttgtgngcgagatgagtagtagacttcttacaagtagngagggtgttatgaagttcg

SEQ ID NO: 370522 - DNA, 564 bp, Homo sapiens
  misc_feature: GZ8MTXP01DPUN9.15.67.G01.1.454.CMB.2.raw
  modified_base (376)..(376): a, c, t, g, unknown or other
  modified_base (511)..(511): a, c, t, g, unknown or other
  modified_base (543)..(543): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagtatggatgacctgggtccgccaggctccgaggggaaggggctgggagtgggtggcaacaataaaacaaagacggaaatcaagaaaaaacctntgtggactcgtgtagaacggccgattcaccatctccagagacaacgccaaagattacaactgtatttgactaaatgaaacagccgtagaaggaggcgaagggacgacggccgtagtattagttgtgcggcgaagntagagttagtagacttcttaacgaaggtacgngagggtggttatgaagtttcg

SEQ ID NO: 370523 - DNA, 553 bp, Homo sapiens
  misc_feature: GZ8MTXP01DBTG8.15.67.G01.1.454.CMB.2.raw
  modified_base (503)..(503): a, c, t, g, unknown or other
  modified_base (529)..(529): a, c, t, g, unknown or other
  modified_base (550)..(550): a, c, t, g, unknown or other
tcagtctacgtagccacgaccggtgctcgatttagagtatacatactgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggcccgggggggtccctgagactctcctgtgcagtctctggattcacccttagaagtattggatgacctgggtccgccaggctccgaggggaaggggctgggagtgggtggccaaacaataaacaaagacggaagtcaagaaaaacctatgtggactctagtgaacggccgattcaccatctccagagacaacgaccaagaacttcaactgtatttgacaaaatgaaacagccgtagaggagcggaggacacggccgtagtattatgtgtgngagatgagtagtagacttcgttaaanaagtagcgtaggtagttatgngtg

SEQ ID NO: 370524 - DNA, 585 bp, Homo sapiens
  misc_feature: GZ8MTXP01CP9SL.15.67.G01.1.454.CMB.2.raw
  modified_base (331)..(331): a, c, t, g, unknown or other
  modified_base (424)..(424): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttcgtgtagttatttagaagtgtcagtgtgaggtgcattggtggagtcgtggggggagcttggtccaggccgggggggtccctgagactctcctgtgcagtctctggattcacccttagaagtattggatgacctgggtcccgccaggctccgaggggaagggctggagttgggnggaccaaacaataaaacaaagacggaaagtacaagaaaaaaacctatgtggaactctaggtcgaacgggccaatttcaaccatcacaaggaanaacaacgacaaagtaatactactagtattagacaataagaacgaacgacggtagaaggaggacggacggacgacggacgtagtagttatgtgcgcgagagtagagtaagtaagttacgttacttacgtaagtaagaacgaggtaggttagtaagttaagtg

SEQ ID NO: 370525 - DNA, 602 bp, Homo sapiens
  misc_feature: GZ8MTXP01DLYGR.15.67.G01.1.454.CMB.2.raw
  modified_base (351)..(351): a, c, t, g, unknown or other
  modified_base (567)..(567): a, c, t, g, unknown or other
  modified_base (575)..(575): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggaggtcgtggggggaggcgttggtccgagggcccgggggggtccctgagactctcctgtgcagtctctggattcacccttagaagtattggatgacctgggtccgccaggctccgaggggaagggctgggaggtgggtgccaaanaataaaacaaagacggaaagtcaaagaaaaaacctagtgtaggactcgtagtaggaacggccgtattccaacccatcctccaagacgaacaaacgacccaaaagaattacacttagttaatttgacaaaatagaaacacgccgtaggaaggaggacgaaggacgacggccgtagtattagtgtgcgaagagagtgaagtaagtagacttcgttaanaaggtagngtagggtgggttatggttaagtttcgg

SEQ ID NO: 370526 - DNA, 562 bp, Homo sapiens
  misc_feature: GZ8MTXP01CZQ2R.15.67.G01.1.454.CMB.2.raw
  modified_base (290)..(290): a, c, t, g, unknown or other
  modified_base (359)..(359): a, c, t, g, unknown or other
  modified_base (395)..(395): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttctgtgtatttagaagtgtcagtgtgagtgcacttggtggagtctggggggagcttggtccaggccgggggggtccctgagactctcctgtgcagtctctggattcaccttagaagtatggatgactggtccncagctccgagggagggctggagtgggtggccaaacataaacgaaagacggaaagtcaagaaaaaccctntagtggactcgtagtagaacggccgtattcacatcncagagacaacgcaagaatcaactgtattgacaaatgaacacgaccgtggagaggacgtaaggcgacgccgttagtagttatggtagccggaagtaagagttagagttagtaagttacttccgttaacgaaggttaacggtcgtagggtaggttagtcgttaacgttg

SEQ ID NO: 370527 - DNA, 556 bp, Homo sapiens
  misc_feature: GZ8MTXP01DGT0F.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagtattggatgacctgggtccgccaggctccgaggggaaggggctgggagtggggtggccaaacataaacaaagacggaaagtcaagaaaaacctatgtggactctgtgaacggcgattcaccatctcagagacaacgccaagaattacacttgtatttgacaaatgaaacagcctagagaggcgaggacgacggccgtagtattattgtgcgaagagatgagtaacgtagacgttcttacgaagttaagcgtaagggtggttatgaagttgg

SEQ ID NO: 370528 - DNA, 566 bp, Homo sapiens
  misc_feature: GZ8MTXP01C6PHJ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgtttattttagaaggtgtccagtgtgaggtgcacttggtggaggtcgtggggggaggcgttgggtccgagggcccggggggggtcccctggacgactctcctgtgcagtctctggattcacccttagaagttattggatgacctgggtccgccaggctccaggggaaggggctggagtgggtggccaacataaacaaagacggaagtacaagaaaaaacctatagtggaactctagtgaacggccgattacaccatctaccagagacaacgaccaaagaattcgaactgttaatttgacaaaatgaacagcctgaaggaggcgagacgacggccgtagtattattgtgcgcgagatgagtagtagacttcttacaagtagctaggtggttatgaattgg

SEQ ID NO: 370529 - DNA, 578 bp, Homo sapiens
  misc_feature: GZ8MTXP01EDTSH.15.67.G01.1.454.CMB.2.raw
  modified_base (302)..(302): a, c, t, g, unknown or other
  modified_base (340)..(340): a, c, t, g, unknown or other
  modified_base (371)..(371): a, c, t, g, unknown or other
  modified_base (512)..(512): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttcgtgtaggtatttagaaggtgtcagtgtgaggtgcacttggtggagtcgtggggggaggcttggtccaggcccggggggggtccctgagactctcctgtgcagtctctggattcacccttagaagtattggatgacctgggccnccaggctccgaggggagggctggagtgggtggccaaanaataaacgaaagacgaagacaaagaaaactntgtagactgtagtacgaacggctataccacctatccacagacaacgaacgacaaataatactactagttattagacaaataagaacacgacggtagaggaggacggacggacgacggacgtagttagttagttgtggcggngagagtagttagtagtaagttacgttcttacgtaagtagtaacgtaggtaggttagtgttaagttg

SEQ ID NO: 370530 - DNA, 553 bp, Homo sapiens
  misc_feature: GZ8MTXP01BEUUH.15.67.G01.1.454.CMB.2.raw
  modified_base (511)..(511): a, c, t, g, unknown or other
  modified_base (517)..(517): a, c, t, g, unknown or other
  modified_base (537)..(537): a, c, t, g, unknown or other
  modified_base (539)..(539): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacctagaagtattggatgacctgggtccgccaggctccgaggggaagggctggagtgggtggccaaacataaacgaaagacggaaagtcaagaaaaacctatagtaggactcgtaggtgaaccgggccgtaattccaaccctatcctaccagacgaacaacgaccaaagaattcaactgtatttgacaaatagaacagacctgagacggcgaggacacgggtccgtagtattatgtgngcgagntgatagtagacttcacaagngnaggtgatgaattcg

SEQ ID NO: 370531 - DNA, 556 bp, Homo sapiens
  misc_feature: GZ8MTXP01CB9EO.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgagggccggggggtccctgagactctcctgtgcagtctctggattcacccttagaagtattggatgacctgggtccgccaggctccgaggggaagggctgggaggtgggtggaccaacataaacgaaagacggaagtcaagaaaaacctatgtggactctagtgaacggccgattcaccatctccagacgacaacgcaagaattcactgtatttgacaaatgaacagaccgtgagaggacgaggacgacggccgtagtattagttgtgcgcgaagatgaagtagtagacttcttacgaagtagcgtagggtggttatggttaattgg

SEQ ID NO: 370532 - DNA, 553 bp, Homo sapiens
  misc_feature: GZ8MTXP01A39WZ.15.67.G01.1.454.CMB.2.raw
  modified_base (381)..(381): a, c, t, g, unknown or other
  modified_base (412)..(412): a, c, t, g, unknown or other
  modified_base (504)..(504): a, c, t, g, unknown or other
  modified_base (508)..(508): a, c, t, g, unknown or other
  modified_base (536)..(536): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggccgggggggtccctgagactctcctgtgcagtctctggattcacccttagaagtatggatgacctgggtccgccaggctccgaggggaaggggctgggagtggggtggaccaacataaaacgaaagacggaagtcaaagaaaaacctntagtgactctagtgaacggcgatcaccatcncagagacaacgaccaagaacttcactgttatttgactaaatagaacacgccgtagaggaggcgaaggacgacggccgtagtattatgtgcgngagntgagtagtagacttcttacgaagtacgngaggtgttatgaagttg

SEQ ID NO: 370533 - DNA, 545 bp, Homo sapiens
  misc_feature: GZ8MTXP01BO85N.15.67.G01.1.454.CMB.2.raw
  modified_base (410)..(410): a, c, t, g, unknown or other
  modified_base (415)..(415): a, c, t, g, unknown or other
  modified_base (495)..(495): a, c, t, g, unknown or other
  modified_base (499)..(499): a, c, t, g, unknown or other
  modified_base (527)..(527): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggcccgggggggtccctgagactctcctgtgcagtctctggattcacccttagaagtattggatgacctgggtccgccaggctccgaggggaaggggcgtgggagtgggtgcaacataaacaaagacggaagtcaagaaaaacctatagtggactctagtgaacggccgattcaccatcncaganacaacgaccaagaatcactgtatttagacaaatgaacagaccgtgaggaggacgaggacacggccgtgtattatgtgcgngagntgagtagtagacgttcttacaagtacgngaggtgttagtgaagttg

SEQ ID NO: 370534 - DNA, 579 bp, Homo sapiens
  misc_feature: GZ8MTXP01BHHM0.15.67.G01.1.454.CMB.2.raw
  modified_base (305)..(305): a, c, t, g, unknown or other
  modified_base (514)..(514): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccaggccgggggggtccctgagactctcctgtgcagtctctggattcacccttagaagtattggatgacctgggtccnccaggctccgaggggaggggctggagtgggtgccaacataaacaaagacggaagtcaagaaaaacctatagtaggactcgtagtagaacgggccgaattccgacccatcctaccagacgacaacgccaaagaattcaactgtatttgacaaatgaacagccgtagagaggcggaaggacgacggcgtagtattagttcgtgcgcgaagngtagagttaaggtagttacttcttaaccgaaggtgcgtaaggggtggttaagtggttaagtttgg

SEQ ID NO: 370535 - DNA, 567 bp, Homo sapiens
  misc_feature: GZ8MTXP01CLYQ2.15.67.G01.1.454.CMB.2.raw
  modified_base (416)..(416): a, c, t, g, unknown or other
  modified_base (504)..(504): a, c, t, g, unknown or other
  modified_base (545)..(545): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggccgggggggtccctgagactctcctgtgcagtctctggattcacccttagaagtatggatgacctgggtccgccaggctccgaggggaaggggctggagtgggtggaccaaacataaaacaaagacggaaagtacaagaaaaaaccctatagtggaactctgtagaacggcgattcaccatcnccagagacaacgaccaagaattcacttgtatttagacaaatagaaacagaccgtgagaggcgaaggacacggcgtagtattatgtcgngcgagagtgagtaagtagaacgttcttaacgaagttaaggngtaggtagttagtgttaagttg

SEQ ID NO: 370536 - DNA, 631 bp, Homo sapiens
  misc_feature: GZ8MTXP01DA5Z6.15.67.G01.1.454.CMB.2.raw
  modified_base (508)..(508): a, c, t, g, unknown or other
  modified_base (510)..(510): a, c, t, g, unknown or other
  modified_base (512)..(512): a, c, t, g, unknown or other
  modified_base (514)..(514): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacttggtggagtcgtgggggagggctttggtccgaggccgggggggtccctgagactcctcgtgtgctagtcttcgtggtacttcctaacccgttaagtaaagttagttggaatcgaaccgtcgggtcccgccgaggccgtaccgaagggggaacggggcgtgggaggttggggcggaccaaacaaataaaacgaaaggaacggaaagtacaaaagaaaaaacctagtggtaggaactcgtaggtagaaccgggctaattaccacctatccacagacaacaacgacaaagaattcaatgttattgaataaananananacgagagagacgacgacgacgacgtagtagttagttagtcgcgaagagagtagttaagtaagtaacgttacgttacgttaacgtaagtagtaagtaggtaggttagtaagttaagtg

SEQ ID NO: 370537 - DNA, 565 bp, Homo sapiens
  misc_feature: GZ8MTXP01EYOGT.15.67.G01.1.454.CMB.2.raw
  modified_base (430)..(430): a, c, t, g, unknown or other
  modified_base (513)..(513): a, c, t, g, unknown or other
  modified_base (545)..(545): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcttgttgttattttagaaggtgtcagtgtgaggtgcacttggtggagtctggggggaggcttggtccaggccggggggggtccctgagactctcctgtgcagtctctggattcacccttagaagtattggatgacctgggtccgccaggctccgaggggaaggggctggagtggggtggccaaacaataaaacgaaaagacggaaagtcaaagaaaaaacctatagtggaactcgtagtgaacggcccgaattcaacccatcctccaaganaacaaacgccaaagaattcaactgtaatttgacaaatgaaacagcctgaggaggacgaggacacggcgtagtattatgtgcgngaagatgagtagtacgacttcttacaagtagngtagggtgttatgaagttcg

SEQ ID NO: 370538 - DNA, 521 bp, Homo sapiens
  misc_feature: GZ8MTXP01AGZ5N.15.67.G01.1.454.CMB.2.raw
  modified_base (299)..(299): a, c, t, g, unknown or other
  modified_base (310)..(310): a, c, t, g, unknown or other
  modified_base (312)..(312): a, c, t, g, unknown or other
  modified_base (314)..(314): a, c, t, g, unknown or other
  modified_base (316)..(316): a, c, t, g, unknown or other
  modified_base (319)..(319): a, c, t, g, unknown or other
  modified_base (323)..(323): a, c, t, g, unknown or other
  modified_base (325)..(325): a, c, t, g, unknown or other
  modified_base (328)..(328): a, c, t, g, unknown or other
  modified_base (337)..(337): a, c, t, g, unknown or other
  modified_base (339)..(339): a, c, t, g, unknown or other
  modified_base (344)..(344): a, c, t, g, unknown or other
  modified_base (346)..(346): a, c, t, g, unknown or other
  modified_base (348)..(348): a, c, t, g, unknown or other
  modified_base (350)..(350): a, c, t, g, unknown or other
  modified_base (369)..(369): a, c, t, g, unknown or other
  modified_base (372)..(372): a, c, t, g, unknown or other
  modified_base (374)..(374): a, c, t, g, unknown or other
  modified_base (384)..(384): a, c, t, g, unknown or other
  modified_base (397)..(397): a, c, t, g, unknown or other
  modified_base (399)..(399): a, c, t, g, unknown or other
  modified_base (402)..(402): a, c, t, g, unknown or other
  modified_base (404)..(404): a, c, t, g, unknown or other
  modified_base (446)..(446): a, c, t, g, unknown or other
  modified_base (448)..(448): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttcgtgtaggtatttagaagtgtcagtgtgaggtgcattggtggagtctggggggagcttgggtccaggccggggggggtccctgagactctcctgtgcagtctctggattcaccctagaagtattgatgactggtcgcagcnccaggaggggngngngnggngcananaanaagagagananaacangngntntagagcgcgactcacatcncananacacgacaanatactatatatananaananacagacgagagaggacgagacgacgcgtagtagttagtgtgngngagagtagttagtaagtaagttacgttacgttacgtaaggtaggtaaggtagggtaggttagtaagttaagtg

SEQ ID NO: 370539 - DNA, 565 bp, Homo sapiens
  misc_feature: GZ8MTXP01EQZX9.15.67.G01.1.454.CMB.2.raw
  modified_base (389)..(389): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggcccgggggggtccctgagactctcctgtgcagtctctggattcacccttagaagtatggatgacctgggtccgccaggctccgaggggagggctggagtgggtggccaaacataaacgaaagacggaaatacaagaaaacctatgtggactcgtagngaacggccgattcaccatctccagagacaacgccaaagattcactgttattgacaaatgaaacagccgtaggagagggcgaaggaccacgggccgtaggttattagttgtacggcgaacggagatggagtagtaaggacttcttacgaagtagcgtagggtggttatgttaagttg

SEQ ID NO: 370540 - DNA, 668 bp, Homo sapiens
  misc_feature: GZ8MTXP01BVGWP.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgagggccggggggtccctgagactctcctgtgcagtctctggtattcacccttagaagtattggatgaccgtgggtccgccgaggctccgaggggaagggcgtgggaggtgggtggaccaaacaagtaaaacgaaaggacggaaagtacaaagaaaaaccctagtagtaggactcgtaagtacgaaccggccgattccacccatcctaccaagacgaacaaaccgaccaaagtaacttacaaccttagttaattttgaactaaaagtacgaaacacgacccgtaggaaggaacgggaccggaaggaacccgaccgggtaccgttaggttaagtttagttaggttcggcggcggaaggttagtaggaagttaaaggtaacgttacgttaccttaacgaaggttaagcggtaaggggttggttagttggttaacgttttgg

SEQ ID NO: 370541 - DNA, 549 bp, Homo sapiens
  misc_feature: GZ8MTXP01BVJWN.15.67.G01.1.454.CMB.2.raw
  modified_base (409)..(409): a, c, t, g, unknown or other
  modified_base (528)..(528): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtcctgagactctcctgtgcagtctctggattcacccttagaagtatggatgactgggtccgccaggctccgaggggaaggggcgtggagtggggtggccaacataaacaaagacggaaagtcaagaaaaaacctatagtggactctagtagaacggcgattcaccatcnccagagacaacgccaagaattcactgtatttgacaaatagaaacagccgtagagaggacgaggacgacggcgtagtattatgtgcgcgagatgagtagtagacttcttaacgaagtagngtagggtggttatgaagttgg

SEQ ID NO: 370542 - DNA, 583 bp, Homo sapiens
  misc_feature: GZ8MTXP01D57EH.15.67.G01.1.454.CMB.2.raw
  modified_base (563)..(563): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgttgggttttccttgttgttattttagaaggtgtccagtgtgaggtgctacgttggtggagttcgtggggggaggtcgtttgggtcccgagggcccgggggggtccctgagactctcctgtgcagtctctggattcacccttagaagttatggatgacctgggtccgccaggctccgaggggagggctggagtgggtggccaacaataaacaaagacggaagtacaagaaaaacctatgtggactcgtagtagaacggccgattaccaccatctccagagacaacgtaccaagaattcacttgttatttgacaaatgaaacacgaccgtagaggaaggcggaaggaccgacggaccgttaggtattattgtcggcgaagagttatgagtagtagacgttcttaacaagtagngtaggtggttatgaagtttg

SEQ ID NO: 370543 - DNA, 559 bp, Homo sapiens
  misc_feature: GZ8MTXP01APXQY.15.67.G01.1.454.CMB.2.raw
  modified_base (421)..(421): a, c, t, g, unknown or other
  modified_base (486)..(486): a, c, t, g, unknown or other
  modified_base (504)..(504): a, c, t, g, unknown or other
  modified_base (510)..(510): a, c, t, g, unknown or other
  modified_base (514)..(514): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggccgggggggtccctgagactctcctgtgcagtctctggattcacccttagaagtatggatgacctgggtccgcaggctccgaggggagggctggagtgggtggaccaacataaacgaaagacggaagtacaagaaaaaccctagtagtaggacttcgtagtacggaacggccgattccaccagtccnccgagagacaacgaccaagaattcactgtattgacaaatgaacagccgtgaggaggcgaggaccncggccgtagtatagttgngtcggngagntgagtagtagacttcacaaggtgcgagggtagttatgttaagttg

SEQ ID NO: 370544 - DNA, 558 bp, Homo sapiens
  misc_feature: GZ8MTXP01DBPCA.15.67.G01.1.454.CMB.2.raw
  modified_base (423)..(423): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttggtccgaggccgggggggtccctgagactctcctgtgcagtctctggattcacccttagaagtattggatgacctgggtccgccaggctccgaggggaaggggctgggagtggggtggccaaacaataaaacaaagacggaaagtcaagaaaaaacctatgtggactctgtgaacggccgattcaccatctccaaganacaacgccaaagaattcactgtatttgacaaatgaaacagaccgtgaagaggacgaggaccacggccgtagtattattgtgcgcgagatgaagtagtaagacttcttaacaagtagcagggtggttatgaagttg

SEQ ID NO: 370545 - DNA, 557 bp, Homo sapiens
  misc_feature: GZ8MTXP01DUT5D.15.67.G01.1.454.CMB.2.raw
  modified_base (420)..(420): a, c, t, g, unknown or other
  modified_base (507)..(507): a, c, t, g, unknown or other
  modified_base (537)..(537): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccggggggtccctgagactctcctgtgcagtctctggattcacccttagaagtattggatgacctgggtccgccaggctccgaggggaaggggctgggagtggggtggaccaaacaataaacgaaagacggaaagtacaaagaaaaaacctatgtaggactctgtagaacggcgattcaccatctcaganacaacgacaagaattacacttgtatttagacaaatagaacacgccgtagaaggaggacgaggacgacggcgtagtattagtgtgcgngagatgagtagtagacttcttagaagtagngtagggtgttatgaagttcg

SEQ ID NO: 370546 - DNA, 546 bp, Homo sapiens
  misc_feature: GZ8MTXP01BHSBM.15.67.G01.1.454.CMB.2.raw
  modified_base (530)..(530): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggccgggggggtccctgagactctcctgtgcagtctctggattcacccttagaagtatggatgacctgggtccgccaggctccgaggggaggggctggagtgggtggccaacataaaacaaagacggaaagtcaagaaaaaacctatagtggaactctgtgaacggccgattcaccatctcagagacaacgccaagaattcactgtatttgacaaatgaaacagccgtgaaggaggcggaggacacggccgtggtattagttgtgcgcgagatgagtagtagacttcttacaagtagngaggtgttatgaattg

SEQ ID NO: 370547 - DNA, 553 bp, Homo sapiens
  misc_feature: GZ8MTXP01EC76V.15.67.G01.1.454.CMB.2.raw
  modified_base (345)..(345): a, c, t, g, unknown or other
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagagtcaccatcacttgccgggcaagtcaggacattagaactgacttaggtggtatcagcagaaatccgggaaagcccctaagctcctgatctgtgctgcatccactttacaaagtggggtcccccatcaaggttcagcggcnggtggatcgtggcacagtatttcactctcaccatcagcagccctgcagcctagaacggggtattttcgactaactttattactgttactaacaatattaactaacttaccccgtaacggtacggttcggcccgaagggggtacccgaaagggttagggaaacttaccgaaaacgtaaccttggtacgggcttacggccaacccgtaag

SEQ ID NO: 370548 - DNA, 539 bp, Homo sapiens
  misc_feature: GZ8MTXP01CQ0ZJ.15.67.G01.1.454.CMB.2.raw
  modified_base (342)..(342): a, c, t, g, unknown or other
  modified_base (411)..(411): a, c, t, g, unknown or other
  modified_base (500)..(500): a, c, t, g, unknown or other
  modified_base (516)..(516): a, c, t, g, unknown or other
  modified_base (522)..(522): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggggttttccttgttgttattttagaaggtgtccagtgtgaggtgcacttggtggagtctgggggaggcttggtccagccgggggggtccctgagactctcctgtgcagtctctggattcacccttagaagtatggatgacctgggtccgccagactccaggggaggggctgggagtggggtggccaaanataaacaaagacggaaagtcaagaaaaacctatgtggactcgtgtgaacggccgattcacatctcaganacaacgcaagaattcactgtatttgacaaatgaaacagaccgtgaagagggcgaggacacgggcccgtaggtattagtgtgcgtcgagntgatagtgacttcacngtacgnagggtgttatgaagttg

SEQ ID NO: 370549 - DNA, 711 bp, Homo sapiens
  misc_feature: GZ8MTXP01EQE2P.15.67.G01.1.454.CMB.2.raw
  modified_base (386)..(386): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccggggggtccctgagactctcctgtgcagtctctggattcacccttagagtattggatcgacgtcggtccgccgacggcgtaccgagggggaagggggcggtgggtagggtggggtacgggaccgaaacaaataaaacgaaaacggaaacggnaaacggtaaactaagaaaaacgtaaagtagttacggtacgtcgtacggtcggaaacgggtcccgacttactacccaactactaccaacgaacggaaccaaacgaaccctaaacgaaacttactaacttacgtactttaagtacgaaactaacgggtaacctaagaccgtacggacggaacgggaccggaacggggaccggaccggtaccggttacggttacgttagttcggttcggttacggtacgttaggaagtagttaagttaacgttacgtaacgtacgttaacgtaacggtaacgggttacggtaacggttaagggttaag

SEQ ID NO: 370550 - DNA, 523 bp, Homo sapiens
  misc_feature: GZ8MTXP01AECBX.15.67.G01.1.454.CMB.2.raw
  modified_base (422)..(422): a, c, t, g, unknown or other
  modified_base (440)..(440): a, c, t, g, unknown or other
  modified_base (507)..(507): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagtattggatgacctgggtccgccaggctccaggggaaggggctggagtgggtggcaacataaacaaagacgaagtcaagaaaaacctatgtggactctagtgaacggcgattcaccatctccagagacaacgccaagaatnactgtattgacaatgaanagctgagagcgaggacacggcgtagtattatggtgcgcgagatgagtagtagacttcacgaagtgcnggtggttatggaattg

SEQ ID NO: 370551 - DNA, 537 bp, Homo sapiens
  misc_feature: GZ8MTXP01D1MUM.15.67.G01.1.454.CMB.2.raw
  modified_base (401)..(401): a, c, t, g, unknown or other
  modified_base (489)..(489): a, c, t, g, unknown or other
  modified_base (493)..(494): a, c, t, g, unknown or other
  modified_base (533)..(533): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagtatggatgacctgggtccgccaggctccgaggggaaggggctgggagtggggtgccaacataaacaaagacggaagtcaagaaaaacctatgtgactctgtgaacggcgattcaccanctcagagacaacgcaagattacactagtatttgacaaatgaaacagccgtagagaggcgaggacgacggccgtagtattagtgtgcgngagnnggatagtgacttcttacaagtagctaaggtggttatggnttcg

SEQ ID NO: 370552 - DNA, 641 bp, Homo sapiens
  misc_feature: GZ8MTXP01DQR6F.15.67.G01.1.454.CMB.2.raw
  modified_base (345)..(345): a, c, t, g, unknown or other
  modified_base (384)..(384): a, c, t, g, unknown or other
  modified_base (572)..(572): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagtattggatgacctgggtccgccaggctccgaggggaaggggctggagtgggtggaccaanaataaaacaaaggacggaaagtacaagaaaaaaaccctntagtaggactcgtaggtagaaccgggccgtaatttccaacctatcctaccaagaacgaaccaaaccggaccctaaaagaaactttacaaaccttaggttaattttacgaaccaaaataaggaaacaacgacccgtacgaggaaggacggaacggaacgaccggacccggtagtagttagttagttcgnggcgagagtagagtaagtaaggacgttcttactaagtagtaacgaggtaggttagtgttaagtttaagg

SEQ ID NO: 370553 - DNA, 560 bp, Homo sapiens
  misc_feature: GZ8MTXP01D2C7U.15.67.G01.1.454.CMB.2.raw
  modified_base (413)..(413): a, c, t, g, unknown or other
  modified_base (513)..(513): a, c, t, g, unknown or other
  modified_base (536)..(536): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagtatggatgacctgggtccgccaggctccgaggggaaggggctggagtgggtggccaacaataaaacaaagacggaaagtcaagaaaaaacctatagtggactctagtgaacggccgattcacctatcnccagacgacaacgaccaaagaattcaactgtatttgacaaatagaaacagacccgtagaaggaggacggaaggaccgaacggccgtgtattattgtgcgngagatagatagtagacttcttanaagtagcagggtgttatgaagttg

SEQ ID NO: 370554 - DNA, 538 bp, Homo sapiens
  misc_feature: GZ8MTXP01BZWHD.15.67.G01.1.454.CMB.2.raw
  modified_base (494)..(494): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagtatggatgacctgggtccgccaggctccgaggggaaggggctggagtgggtggccaaacataaacaaagacggaagtcaagaaaaacctatgtggactctgtagaacgggccgattccaccatctccagagacaacgccaagaattcactgtatttgacaaatgaacagccgtgagagcgagacgacggccgtgtattagtgtgcgcgngatgatagtagacttcttacaagtagcagggtgttatgaagttg

SEQ ID NO: 370555 - DNA, 567 bp, Homo sapiens
  misc_feature: GZ8MTXP01AJABA.15.67.G01.1.454.CMB.2.raw
  modified_base (411)..(411): a, c, t, g, unknown or other
  modified_base (467)..(467): a, c, t, g, unknown or other
  modified_base (505)..(505): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtccagtgtgaggtgcacttggtggagtcgtggggggaggctttgggtccaggccggggggggtccctgagactctcctgtgcagtctctggattcacccttagaagtattggatgaccgtgggtccgccaggctccgaggggaggggctgggagtgggtggccaaacataaacaaagacggaagtcaagaaaaacctatgtggactctagtgaacggccattcaccatcnccagacgacaacgacctaaagacttcaactgtatttgactaaatagaacagaccgngagaggacgaggacgacggccgtggtagttattgttgngcgagagtagagtagtaagacgttcttacgaagtagaacgaggtggttagtaagttaagttg

SEQ ID NO: 370556 - DNA, 525 bp, Homo sapiens
  misc_feature: GZ8MTXP01BOG3H.15.67.G01.1.454.CMB.2.raw
  modified_base (275)..(275): a, c, t, g, unknown or other
  modified_base (291)..(291): a, c, t, g, unknown or other
  modified_base (297)..(297): a, c, t, g, unknown or other
  modified_base (306)..(306): a, c, t, g, unknown or other
  modified_base (308)..(308): a, c, t, g, unknown or other
  modified_base (310)..(310): a, c, t, g, unknown or other
  modified_base (312)..(312): a, c, t, g, unknown or other
  modified_base (315)..(315): a, c, t, g, unknown or other
  modified_base (320)..(320): a, c, t, g, unknown or other
  modified_base (322)..(322): a, c, t, g, unknown or other
  modified_base (325)..(325): a, c, t, g, unknown or other
  modified_base (334)..(334): a, c, t, g, unknown or other
  modified_base (336)..(336): a, c, t, g, unknown or other
  modified_base (339)..(339): a, c, t, g, unknown or other
  modified_base (341)..(341): a, c, t, g, unknown or other
  modified_base (343)..(343): a, c, t, g, unknown or other
  modified_base (345)..(345): a, c, t, g, unknown or other
  modified_base (347)..(347): a, c, t, g, unknown or other
  modified_base (371)..(371): a, c, t, g, unknown or other
  modified_base (380)..(380): a, c, t, g, unknown or other
  modified_base (384)..(384): a, c, t, g, unknown or other
  modified_base (394)..(394): a, c, t, g, unknown or other
  modified_base (396)..(396): a, c, t, g, unknown or other
  modified_base (399)..(399): a, c, t, g, unknown or other
  modified_base (449)..(449): a, c, t, g, unknown or other
tcagtctacgtagccacgaccggtgctcgatttagagtatacatattgggtttggggtctcagagaggagccttagccctggactccaaggcctttccacttggtgatcagcactgagcacagaggactcaccatggagttggggctgagcgtggtttcgtgtaggtatttagaaggtgtcagtgtgaggtgcattggtggagtctgggggaggcttggtccaggccggggggtcctgagctctcctgtgcagtctctgatccaccttagaattntggatgacctgggccncaggcncgaggaggngngngnggngacananaanaagagagananaanangngntntgtagacgcgatcacatcacaganacacacaanatanatagtattananaanagacacgacgaggagaggacggagacgacgcgtagtagttagttgtgcgngaagtagttagtagttagtaacgtacgttacgttacgttagtaaggtacggtaaggtggtagttagtaagttgttg

SEQ ID NO: 370557 - DNA, 536 bp, Homo sapiens
  misc_feature: GZ8MTXP01A4X6W.15.67.G01.1.454.CMB.2.raw
  modified_base (486)..(486): a, c, t, g, unknown or other
  modified_base (518)..(518): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggggttttccttgttgttattttagaaggtgtccagtgtgaggtgcacttggtggagtctggggggaggcttggtccaggccgggggggtccctgagactctcctgtgcagtctctggattcacccttagaagtattggatgacctgggtccgccagactccaggggaaggggctggagtgggtggccaacataaacaaagacggaaagtcagaaaaacctatgtggactctgtgaacggccgattcaccatctccagagacaacgccaagaattcactgtatttgcaaatgaacagcctgagaggcgaggacacggccgtgtattatgtgcgngagatgagtagtagacgttcttacgaagtagnagggtgttatgaagttgg

SEQ ID NO: 370558 - DNA, 549 bp, Homo sapiens
  misc_feature: GZ8MTXP01DTNM3.15.67.G01.1.454.CMB.2.raw
  modified_base (496)..(496): a, c, t, g, unknown or other
  modified_base (520)..(520): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcacccttagaagtatggatgacctgggtccgccaggctccgaggggaaggggctgggagtggggtggccaacataaacaaagacggaagtcaagaaaaacctatagtggactcgtgtgaacggcgattcaccatctcagagacaacgccaaagaattcaactgtatttgacaaatgaaacagccgtagagaggcgaggacacggccgtgtattattgtgcgngagatgatagtagacttcttaacngtaagcgtaagggtggttatggaatttgg

SEQ ID NO: 370559 - DNA, 574 bp, Homo sapiens
  misc_feature: GZ8MTXP01CJ5M5.15.67.G01.1.454.CMB.2.raw
  modified_base (538)..(538): a, c, t, g, unknown or other
  modified_base (556)..(556): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcacccttagaagttatggatgacctgggtccgccgaggctccgaggggaaggggctgggagtggggtggccaaacaataaaacaaagacggaaagtcaagaaaaacctatagtaggactcgtagtacgaacggcgtaacttcaccgatcctccaagacgacaaaccgccaaagaacttcacttagtatttgacaaatagaacagccgtagaggaggcgaggacgacggcgtagtattagtgtgcgcgagttgtagagtaggtanacgttcttacgtaagtgngaggtgttatgaagtttg

SEQ ID NO: 370560 - DNA, 547 bp, Homo sapiens
  misc_feature: GZ8MTXP01D7T8U.15.67.G01.1.454.CMB.2.raw
  modified_base (303)..(303): a, c, t, g, unknown or other
  modified_base (378)..(378): a, c, t, g, unknown or other
  modified_base (525)..(525): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagtatggatgacctgggtccnccaggctccgaggggaaggggctgggagtgggtggaccaaacaataaacaaagacggaagtacaagaaaaacctntagtggactctagtgaacggcgattccacatctaccagacgacaacgacaagaattcactgtattgacaaatgaacagcgtagagagcgagacacggcgtatattatgtgcgaagagagtgagtagtagacgttcttacgaagtagngtaggtgttagtgttaacgttg

SEQ ID NO: 370561 - DNA, 541 bp, Homo sapiens
  misc_feature: GZ8MTXP01DYV2S.15.67.G01.1.454.CMB.2.raw
  modified_base (456)..(456): a, c, t, g, unknown or other
  modified_base (497)..(497): a, c, t, g, unknown or other
  modified_base (518)..(518): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcaccttagaagtattggatgacctgggtccgccaggctccgaggggaaggggctgggagtggggtggccaaacaataaaacaaagacggaaagtcaaagaaaaacctatgtggactctagtgaacggccgattccaccatcacagagacaacgccaagaattcactgtattgacaaatgaaacngccgtgagaggcgaggacacggccgtagtattagtgtgcgngagatgagtagtagacttcangtagcgaggtggttatgaattcg

SEQ ID NO: 370562 - DNA, 546 bp, Homo sapiens
  misc_feature: GZ8MTXP01BNVEO.15.67.G01.1.454.CMB.2.raw
  modified_base (376)..(376): a, c, t, g, unknown or other
  modified_base (415)..(415): a, c, t, g, unknown or other
  modified_base (499)..(499): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagtatggatgacctgggtccgccaggctccgaggggaaggggctgggagtggggtggccaaacataaacaaagacggaaagtcaagaaaaacctntgtggactctagtgaacggccgattcaccatctccaganacaacgccaaagattcactgtatttgacaaatgaacagcctgagaggcgaggaccgacggccgtagtattagtgtgcgcgaagntgagtagtagacttcttacgaagtagcgagggtggttatggaattgg

SEQ ID NO: 370563 - DNA, 541 bp, Homo sapiens
  misc_feature: GZ8MTXP01A07YZ.15.67.G01.1.454.CMB.2.raw
  modified_base (323)..(323): a, c, t, g, unknown or other
  modified_base (367)..(367): a, c, t, g, unknown or other
  modified_base (388)..(389): a, c, t, g, unknown or other
  modified_base (394)..(394): a, c, t, g, unknown or other
  modified_base (396)..(396): a, c, t, g, unknown or other
  modified_base (418)..(418): a, c, t, g, unknown or other
  modified_base (420)..(420): a, c, t, g, unknown or other
  modified_base (423)..(423): a, c, t, g, unknown or other
  modified_base (425)..(425): a, c, t, g, unknown or other
  modified_base (427)..(427): a, c, t, g, unknown or other
  modified_base (469)..(469): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggttttcgtgtaggtatttagaagtgtcagtgtgaggtgcattggtgagtctgggggagcttggtccagccggggggggtccctgagactctcctgtgcagtctctggattcacccttagaagtattggatgactggccgccaggctcgaggggagggctgggagtgggngaccaagataaacaaagacgaagcaagaaaacctatgtggactntgtagaacggccattcaaccnncacananacacgacaatatacatatatananaanananagacgagagaggacgacgacgacgacgtagtagtagtagtgngaacgagagtagttagtaagtagttacgttacttacgtaagtaggtaagtaggtaggttagtaagttaagtg

SEQ ID NO: 370564 - DNA, 549 bp, Homo sapiens
  misc_feature: GZ8MTXP01DYIG1.15.67.G01.1.454.CMB.2.raw
  modified_base (300)..(300): a, c, t, g, unknown or other
  modified_base (500)..(500): a, c, t, g, unknown or other
  modified_base (522)..(522): a, c, t, g, unknown or other
  modified_base (529)..(529): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggagcttggtccaggccgggggggtccctgagactctcctgtgcagtctctggattcacccttagaagtatggatgactgggtccncagctcgagggagggctggagtgggtggccaacataaaacgaaagacggaaagtacaagaaaaaacctagtgtaggactctagtagaacggccgaattccaccatctccagagaacaaacgcccaaagaacttacaactgttaatttgacaaaatagaaacagccgtagagagcgagacacggcgtagtatattgtgcgngagatgatagtagacttcttanaagtagngagggtgttagtgttaatcg

SEQ ID NO: 370565 - DNA, 553 bp, Homo sapiens
  misc_feature: GZ8MTXP01D4BM7.15.67.G01.1.454.CMB.2.raw
  modified_base (508)..(508): a, c, t, g, unknown or other
  modified_base (536)..(536): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtccagtgtgaggtgcacgttggtggaggtcgtggggggaggcgttgggtccgagggcccggggggggtccctggagactctcctgtgcagtctctggattcacccttagaagtattggatgacctgggtccgccaggctccaggggaaggggctggaggtgggtggccaacataaacaaagacggaagtcaagaaaaacctatagtggactctagtgaacggccgattcaccatctccagagacaacgccaaagaattcactgtatttgacaaatgaaacagccgtagagagggacgaggacgacggccgtagtattagttgtgcgngagatgatagtagacgttcacaagtagngaggtgttatgaagttg

SEQ ID NO: 370566 - DNA, 585 bp, Homo sapiens
  misc_feature: GZ8MTXP01EKKX4.15.67.G01.1.454.CMB.2.raw
  modified_base (384)..(384): a, c, t, g, unknown or other
  modified_base (563)..(563): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagaagtattggatgacctgggtccgccaggctccgaggggaaggggctgggagtggggtggaccaaacgaataaaacgaaagacggaaagtacaagaaaaaacctntagtggaactcgtagtaggaacgggccgtaattccacctaatcctaccaagagaaccaacgaccaaagaattacaacgttgtatttgacaaatgaaacagccgtagaggaggcgaaggcgaacggccgtagtatttatgtgcgcgagagttgaagttagtagacttcaacgtaagtagngagggtggttatgttaagttgg

SEQ ID NO: 370567 - DNA, 575 bp, Homo sapiens
  misc_feature: GZ8MTXP01CTHNA.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgagggcccggggggggtccctggagactctcctgtgcagtctctggattcacccttagaagttattggatgacctgggtccgccgaggctccgaggggaaggggctgggaggtggggtcggaccaaacaataaaacaaagacggaaagtcaaagaaaaaccctatgtggactctgtgaacgggcagttcaccatctccagagacaacgccaaagaattcactgtatttagacaaatgaaacagccgtgacggaggcggaggcgaacggccgtgtattagttgtaggcgcgagatgagtagtagacttcttaacgaagtagcgagggttggttatggttaagtttg

SEQ ID NO: 370568 - DNA, 535 bp, Homo sapiens
  misc_feature: GZ8MTXP01C78F3.15.67.G01.1.454.CMB.2.raw
  modified_base (406)..(406): a, c, t, g, unknown or other
  modified_base (488)..(488): a, c, t, g, unknown or other
  modified_base (509)..(509): a, c, t, g, unknown or other
  modified_base (514)..(514): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggggtttttccttgttgttattttagaaggtgtccagtgtgaggtgcacttggtggagtctgggggaggcttggtccagccgggggggtccctgagactctcctgtgcagtctctggattcacccttagaagtattggatgacctgggtccgccaggctccaggggaaggggctgggagtgggtggccaacataaacaaagacggaaagtcaagaaaaaacctatgtggactctgtgaacggccgattcaccanctccagagacaacgcaagaattacactgtatttgcaaatgaacagcctgagaggcgaggacgacggccgtgtattattgtgngcgagatggatagtgacgttnttacngtagcgaggtgttatgaattg

SEQ ID NO: 370569 - DNA, 573 bp, Homo sapiens
  misc_feature: GZ8MTXP01DVHQA.15.67.G01.1.454.CMB.2.raw
  modified_base (307)..(307): a, c, t, g, unknown or other
  modified_base (450)..(450): a, c, t, g, unknown or other
  modified_base (455)..(455): a, c, t, g, unknown or other
  modified_base (498)..(498): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggggtttttccttgttgttatttttagaaggtgtccagtgtgaggtgcacttggtggagtctggggggaggcttgggtccagcccgggggggtccctgagactctcctgtgcagtctctggattcacccttagaagtatggatgacctgggtccnccaggctcgagggagggctggagtgggtggccaaacataaaacaaagacggaaagtcaagaaaaacctatagtggactctagtgaacgggcattcaccatctccagagacaacgccaaagaattcaactgtatttgacaaaanagaanagacgagagaggacgacgacgacggacgtagtagttagtgtgngaacgagagtagttagtaagtaagttacgttacttaacgtaagtagtaacgtagggtaggttagtaagttaagtg

SEQ ID NO: 370570 - DNA, 558 bp, Homo sapiens
  misc_feature: GZ8MTXP01C9JC6.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccggggggggtccctgagactctcctgtgcagtctctggattcacccttagaagtattggatgacctgggtccgccaggctccgaggggaaggggctgggagtggggtggccaaacgataaaacaaaagacgggaaagtcaagaaaaaaccctatagtggactctagtgaacggccgattcaccatctccagagacaaacgccaaagaattacactgtatttgacaaatgaacagcctgacgaggcgaggacgacggccgtagtattagttgtgcggcgagatgatagtagacttcttacaagtagcgaggtggttatgaagttg

SEQ ID NO: 370571 - DNA, 670 bp, Homo sapiens
  misc_feature: GZ8MTXP01EXEVB.15.67.G01.1.454.CMB.2.raw
  modified_base (303)..(303): a, c, t, g, unknown or other
  modified_base (369)..(369): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccgggggggtccctgagactctcctgtgcagtctctggattcacccttagaagtatggatgacctgggtccnccaggctccaggggagggctggagtgggtggcaacataaacaaagacggaagtcaagaaaaacctntgtggactcgtagtgaacggccgtactaccactactcacgagacaacacgaacgaattactactacgttagtttagtacaaacttaagtaacgaaacgaccgtacgggtaggaacggggacggaacggggaaccggtaacccgggaccccgggttacggttaagtttaaacgtttaggttacgggttacggccgggtaacggtaaggttaggtaaggttaaaccgttaaaggaaccggttaaccgttccgttaaacggttaaggaaccgtggggttaagggtagttaagtgttccgtttgg

SEQ ID NO: 370572 - DNA, 652 bp, Homo sapiens
  misc_feature: GZ8MTXP01A8S2C.15.67.G01.1.454.CMB.2.raw
  modified_base (387)..(387): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtccctgagactctcctgtgcagtctctggattcacccttagaagtatggatgacctgggtccgccgaggctccgaggggagggctgggaggtggggtggaccaaacaagtaaaacgaaagaacggaagtacgaaagtaaaaaacctntaggtaggactcgtaggtacgaaccgggcctaagttccaacctactacctcgaagaacgaaccaaacggacccaaagtaacttacaactgttaatttagaacaaagtagaaacgacgacccgtaggaacggaggaccggaaggaccgacgggccgttagttaactttagttggtcgcggaacggtaaggagttagaagtaacggttaagaccgttcgttaacgtaaggtcggtaacgtagggtgggttaagtggttaactttggg

SEQ ID NO: 370573 - DNA, 640 bp, Homo sapiens
  misc_feature: GZ8MTXP01DHWT2.15.67.G01.1.454.CMB.2.raw
  modified_base (351)..(351): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtggaggtgcacgttggtggagtcgtggggggaggcttgggtccgaggccgggggggtccctgagactctcctgtgcagtctctggattcacccttagaagtattggatgaccgtgggtccgcaggctccgaggggaagggctgggaggtgggtggaccaaanaataaaacaaaaggaacggaaagtacaaagtaaaaaacctatagtaggactcgtagtacggaacggcccgtaattcccaaccaattccaccgaaagaacgaacaaaccggacccaaagaattaccaacgttagtaatttagaacaaaatacggaaacaacgccgtaggaaggacgggacgaagggacgacggtaccgtaggttattagttggcgcggaagaagagtagttaacgtaaggtaacttacgttcaacgaagtagtaacgagggttagttagtgttaagttcg

SEQ ID NO: 370574 - DNA, 543 bp, Homo sapiens
  misc_feature: GZ8MTXP01D5SSY.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccggggggggtccctgagactctcctgtgcagtctctggattcacccttagaagtattggatgacctgggtccgccaggctccgaggggagggctggagtgggtggcaacataaacaaagacggaagtcaagaaaaacctatgtaggactctgtagaacggccgattccaccatctccagagacaacgaccaaagaattcaactgtatttgacaaatgaaacagaccgtagagaggcgaggacacggccgtagtattattgtgcgcgagatgagtagtagacttcttacaagtagcgtaggtggttatgaattg

SEQ ID NO: 370575 - DNA, 559 bp, Homo sapiens
  misc_feature: GZ8MTXP01D0DTH.15.67.G01.1.454.CMB.2.raw
  modified_base (342)..(342): a, c, t, g, unknown or other
  modified_base (377)..(377): a, c, t, g, unknown or other
  modified_base (527)..(527): a, c, t, g, unknown or other
  modified_base (539)..(539): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagtatggatgacctgggtccgccaggctccgaggggagggcgtggagtgggtggaccaanaataaaacaaagaacggaagtcaagaaaaaacctntagtggactcgtagtacgaacggccgaattccaccatctccagagaacaacgaccaaagaattcaactgttatttgacaaatagaaacagccgtagagaggcgaggacgcggccgtgtattagtgtgcgaagagatgagtagtagacttnttacgaagtacngtagggtgttatgaagttcg

SEQ ID NO: 370576 - DNA, 561 bp, Homo sapiens
  misc_feature: GZ8MTXP01BV5ZM.15.67.G01.1.454.CMB.2.raw
  modified_base (342)..(342): a, c, t, g, unknown or other
  modified_base (515)..(515): a, c, t, g, unknown or other
  modified_base (519)..(519): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagaagtatggatgacctgggtccgccaggctccgaggggaaggggctggagtgggtggccaaanataaaacaaagaacggaaagtcaaagaaaaaacctatagtggaactcgtaagtcgaacgggccgattccaccatcctaccagagaacaacgaccaaagaattacactagttatttgacaaatgaaacagccgtagagagggcgaggaccgaggccgtagtattattgtgcggngagntggatagtagacttcttacaagtagcaggtgttatcgaagtg

SEQ ID NO: 370577 - DNA, 560 bp, Homo sapiens
  misc_feature: GZ8MTXP01BOF0T.15.67.G01.1.454.CMB.2.raw
  modified_base (309)..(309): a, c, t, g, unknown or other
  modified_base (350)..(350): a, c, t, g, unknown or other
  modified_base (386)..(386): a, c, t, g, unknown or other
  modified_base (511)..(511): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttgggtccgagggcccgggggggtccctgagactctcctgtgcagtctctggattcacccttagaagtattggatgacctgggtccnccaggctccgaggggaaggggctgggagtgggtggccaaanaataaacgaaaggacggaaagtcaaagaaaaacctntgtaggactcgtagtagaacggcgaattcaccatcaccagagacaacgccaagaattcactgtatttgacaaatgaaacagccgtagaggaggacgaggacgacggccgtagtattgttgtgcgngagatgatagtagacttcttacaagtagcgagggtggttatgaagttcg

SEQ ID NO: 370578 - DNA, 572 bp, Homo sapiens
  misc_feature: GZ8MTXP01DLAR5.15.67.G01.1.454.CMB.2.raw
  modified_base (524)..(524): a, c, t, g, unknown or other
  modified_base (547)..(547): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggccgggggggtccctgagactctcctgtgcagtctctggattcacccttagaagttatggatgacctgggtccgccaggctccgaggggagggctgggagtggggtggaccaaacaataaaacaaaggacggaaagtacaagaaaaaccctataggtggactcgtaggtacgaaccgggccgattaccaccatcctccagacgacaacgccaaagaattcactgtattgacaaatgaaacacgacgtagaggaaggcgaaggacgacggccgtagtattatgtgcgaacganagtgagtagtagacgttcaacgngtaagcgtaggtggttatgaagttg

SEQ ID NO: 370579 - DNA, 600 bp, Homo sapiens
  misc_feature: GZ8MTXP01ENY4L.15.67.G01.1.454.CMB.2.raw
  modified_base (535)..(535): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttgggtccgagggcccgggggggtccctgagactctcctgtgcagtctctggattcacccttagaagtattggatgacctgggtccgccgaggctccgaggggaaggggctggaggtgggtggccaaacaataaaacgaaaagaacgggaaagtacgaaagaaaaaaccctagtagtaggactcgtaggtagaacggccgattcacctatctaccagagacaacgccaaagaattcaactgttatttagacaaatgaaacacgccgtaggaggaaggcggaaggaccgacgggccgtagtattagttgtcgnggcgagatgagttagtacttacgttcttacgaaggtagtcgagggttgggatggttaagtttcgg

SEQ ID NO: 370580 - DNA, 547 bp, Homo sapiens
  misc_feature: GZ8MTXP01ECRTF.15.67.G01.1.454.CMB.2.raw
  modified_base (484)..(484): a, c, t, g, unknown or other
  modified_base (495)..(495): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtggggggaggcttgggtcccaggcccgggggggtccctgagactctcctgtgcagtctctggattcacccttagaagtatggatgacctggtccgccagctccgaggggagggctggagtgggtggccaacataaacaaagatggaaagtcaaagaaaaactatgtggactcgtagtggaaacggccgattccaccatcctacagagacaacgaccaaagaattacactgtattgacaaatagaacaggctagagaggcgagacgcggcgtgtnttattgtgcgngagattgattaggagacttcgtaactagtgagagggttaggtaagttgtaag

SEQ ID NO: 370581 - DNA, 570 bp, Homo sapiens
  misc_feature: GZ8MTXP01B7IML.15.67.G01.1.454.CMB.2.raw
  modified_base (509)..(509): a, c, t, g, unknown or other
  modified_base (545)..(545): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcttggtccgaggcccggggggtccctgagactctcctgtgcagtctctggattcacccttagaagtatggatgacctgggtccgcaggctccgaggggaagggctggagtgggtggccaaacaataaaacgaaagacggaaagtacaagaaaaaaccctatgtaggactctagtagaacggcgattcaccatctaccagacgaacaaccgacaaagaattcgaacttgtatttagacaaatagaacagccgtagagaggacgagacgacgcgtagtatagttgtcgngcgaagatgagtaagtgacgttcttaacgaagtagngtagggtggttagtgttaacgttgg

SEQ ID NO: 370582 - DNA, 576 bp, Homo sapiens
  misc_feature: GZ8MTXP01C64NX.15.67.G01.1.454.CMB.2.raw
  modified_base (437)..(437): a, c, t, g, unknown or other
  modified_base (529)..(529): a, c, t, g, unknown or other
  modified_base (533)..(533): a, c, t, g, unknown or other
  modified_base (559)..(559): a, c, t, g, unknown or other
  modified_base (572)..(572): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattcacccttagaagtattggatgacctgggtcccgccaggctccgaggggaggggctgggagtggggtggaccaaacaataaaacgaaaggacggaaagtacaaagaaaaaacctatgtaggactcgtaagtcgaacgggcccgaattccacctatcctccaaganaaccaaacgacccaaagaacttacaacttagtatttagacaaatagaacagcctgaagaggacgaggacgacggccgtagtattatgtgcgngagntgattagagacttcttacaagtacgngagggtgttatgngttg

SEQ ID NO: 370583 - DNA, 615 bp, Homo sapiens
  misc_feature: GZ8MTXP01BKNWG.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaggtgtccagtgtgaggtgcacttggtggaggtcgtggggggaggcgttgggtccgagggcccgggggggtccctggacgactctcctgtgcagtctctggattcacccttagaagtattggatgacctgggtcccgccaggctccgagggggaacggggctgggaggtgggtggaccaaacaataaaaccgaaaagaaccgggaaagtacaaaggtaaaaaaaccctataggtaggaactcgtaagtacggaacggcccgaattccaccatcctaccagacaacaacgaccaaagaattctaactagttatttgactaaatgaaacagaccgtagaaggaggacggaagaccgacggccgtagtattattggtgcgaagagagtgaagttagaagttacttcttacgaaggttagcgtagggtgttagtgttaatttgg

SEQ ID NO: 370584 - DNA, 553 bp, Homo sapiens
  misc_feature: GZ8MTXP01DB74J.15.67.G01.1.454.CMB.2.raw
  modified_base (300)..(300): a, c, t, g, unknown or other
  modified_base (334)..(334): a, c, t, g, unknown or other
  modified_base (377)..(377): a, c, t, g, unknown or other
  modified_base (398)..(398): a, c, t, g, unknown or other
  modified_base (495)..(495): a, c, t, g, unknown or other
  modified_base (517)..(517): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtcagtgtgaggtgcacttggtggagtcgtgggggagcttggtccaggccggggggtccctgagactctcctgtgcagtccctggattcaccttagaagttatggatgacctgggtccncaggctcgagggaggggctggagtgggtgccaanataaaacaaagacggaagtacaagaaaaactatggtggaactngtagaacgcgattccacatcnccagacacaacgccaagaatcactgtaatttgacaaatgaaacagccctaggggagaggacgaggaacacgggccgtagtaattattgtgcgtgaanagttgattagtagacttcttanagtaacgagtaaggtggtattgtaagttggtttaag

SEQ ID NO: 370585 - DNA, 647 bp, Homo sapiens
  misc_feature: GZ8MTXP01BX99X.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctcgtggattcacccttagaagttattggatgaccgtgggtcccgccgaggctccgaggggaaggggcgtgggaggtggggtcggacccaaacaataaaacgaaaggaacgggaaagtacaaggaaaaaacccttagtaggtagggaacctcgtaagtaggaaccgggccgtaattccaccctatcctaccaagacgacaaacgacaagaattcacttgtatttgacaaatacgaaacagccgtagaaggagggacggaaggaccgaccgggccgttagtaagtttgttaggtcgtcggaacgaagagtaggaattaaggtaagttaacttcttaaaccgtaaggttaacggcgtaagggttgggttagttggttaagttttggg

SEQ ID NO: 370586 - DNA, 551 bp, Homo sapiens
  misc_feature: GZ8MTXP01EBMCR.15.67.G01.1.454.CMB.2.raw
  modified_base (499)..(499): a, c, t, g, unknown or other
  modified_base (521)..(521): a, c, t, g, unknown or other
  modified_base (531)..(531): a, c, t, g, unknown or other
  modified_base (537)..(537): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtcagtgtgaggtgcacttggtggagtcgtgggggagctttgggtccgaggcccgggggggtccctgagactctcctgtgcagtctctggattcacccttagaagtatggatgacctggtccgcaggctccgagggagggctggagtgggtggcaaacataaaacaaagacggaaagtcaaagaaaaacctatagtaggactcgtagtacgaacggccgattccaaccatctccagacgacaaacgccaaagaattcaactgtatttgacaaatgaaacaggcctagacgaggcgagacacggcgtagtatatgtgcgngagatgagtacgtagaccgttnaacaagtagngtaggngttatgttaagttg

SEQ ID NO: 370587 - DNA, 572 bp, Homo sapiens
  misc_feature: GZ8MTXP01ED1PR.15.67.G01.1.454.CMB.2.raw
  modified_base (256)..(256): a, c, t, g, unknown or other
  modified_base (309)..(309): a, c, t, g, unknown or other
  modified_base (321)..(321): a, c, t, g, unknown or other
  modified_base (406)..(406): a, c, t, g, unknown or other
  modified_base (426)..(426): a, c, t, g, unknown or other
  modified_base (442)..(442): a, c, t, g, unknown or other
  modified_base (444)..(444): a, c, t, g, unknown or other
  modified_base (447)..(447): a, c, t, g, unknown or other
  modified_base (498)..(498): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggttttcgtgtagttatttagaagtgtcagtgtgagtgcattggtggagtcgtggggggagcttggtccaggccggggggggtccctgagactctcctgtgcngtctctggattcacccttagaagttattggattgacctgggtcccgccaggcnccgaggggaggngtggagtggtgcgaacaataaacaaagaacgaagacaagaaaacaatagtggactctgtcgaacggaccggattacaccaactcnccacgagaacaacaccaaanaatactatattattananaanaagaacacgacgagaggaggacggacgacgacggacgtagtagttgtgtgngaagagagtagttagtaagtaacgttacgttacttacgtaagtagtaagtaggtaggttagttaagttaagttg

SEQ ID NO: 370588 - DNA, 568 bp, Homo sapiens
  misc_feature: GZ8MTXP01CA78E.15.67.G01.1.454.CMB.2.raw
  modified_base (351)..(351): a, c, t, g, unknown or other
  modified_base (384)..(384): a, c, t, g, unknown or other
  modified_base (468)..(468): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcgttgggttttccttgttgttattttagaaggtgtccagtgtgaggtgcacgttggtggagtcgtgggggaggcttggtccgagggcccgggggggtccctggagactctcctgtgcagtctcgtggtattcacccttagaagtatggatgacctgggtccgccaggctccgaggggagggctgggaggtgggtggccaaanaataaacaaaggacggaatcaaagaaaaacctntagtggactcgtagtagaacggccgattccaccatctccagacgaacaacgaccaagaattcacttgtatttgacaaatgaacngcgtgaggaggacgagacgacggcgtgtattagtgtgcgcgagagtgagtaaggtagacttcgttacaaggtagcgtagggtaggttatgttaacgtttg

SEQ ID NO: 370589 - DNA, 591 bp, Homo sapiens
  misc_feature: GZ8MTXP01A5PZR.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagaagtattggatgacctgggtccgccaggctccgaggggaagggctgggagtgggtggaccaaacaataaaacaaaggaacggaaagtacaaagaaaaacctatagtggactcgtagtagaaccgggcctagttccacccatcctaccaagacgacaaacggaccaaagtaaacttcaactagttatttagacaaatgaaacagccgtagaagaggacgaggacgacggccgtagtagttattgtgcgcgagagtgaagtagtaagacgttcttaacgaagtagaacgagggtggttagtgttaagtttcgg

SEQ ID NO: 370590 - DNA, 604 bp, Homo sapiens
  misc_feature: GZ8MTXP01BVTFR.15.67.G01.1.454.CMB.2.raw
  modified_base (305)..(305): a, c, t, g, unknown or other
  modified_base (382)..(382): a, c, t, g, unknown or other
  modified_base (535)..(535): a, c, t, g, unknown or other
  modified_base (580)..(580): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccggggggtccctgagactctcctgtgcagtctctggacttcacccttagaagtattggatgacctgggtccnccgaggctccgaggggagggcgtggaggtgggtggaccaaacataaacaaaggacggaaagtacaaagaaaaacctntgtaggactctagtagaacggcgattcaccatctaccagacgacaacgaccaaagaacttacacttgttaatttgacaaatagaacacgccgtaggaaggacgggacggaacggaccgacgggtaccgttaggttaattagttggtcggcggnggaagttagtaggataaggtagttaccttcgttaacgaaggtagngtagggtggttatgttaagtttgg

SEQ ID NO: 370591 - DNA, 546 bp, Homo sapiens
  misc_feature: GZ8MTXP01C8QMM.15.67.G01.1.454.CMB.2.raw
  modified_base (420)..(420): a, c, t, g, unknown or other
  modified_base (453)..(453): a, c, t, g, unknown or other
  modified_base (492)..(492): a, c, t, g, unknown or other
  modified_base (528)..(528): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggcccggggggggtccctggagactctcctgtgcagtctctggattcacccttagaagtatggatgacctgggtccgccaggctccaggggaaggggctgggagtgggtggccaacataaacaaagacggaaagtcaaggaaaaacctatagtggactctagtgaacggccgattcaccatctcaganacaacgcaagattcatgtattgcaaatgaaacngccgtgagaggcgaggacacggcctagtattagtgtcgngcgagagttgatagtagacttcttacgtaagtacgngagggtgttatgaagttg

SEQ ID NO: 370592 - DNA, 634 bp, Homo sapiens
  misc_feature: GZ8MTXP01DLTEQ.15.67.G01.1.454.CMB.2.raw
  modified_base (498)..(498): a, c, t, g, unknown or other
  modified_base (505)..(505): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcgagtctcgtggtacttcctaccttaagtaagttagtggatcgaccgttcgggtcccgccgaggtcctaccggaagggggacgggcgtgggaggttggggacggaccaaactaaactaaaacgaaaggaacggaatacgaaagtaaaaaacctgtagtcggactcgtagtacgaacggctataccaccatcacaagacaacaaccgacaaagtaacttcaattgttattacgaactaaanagaaacncgacggaggaggacggacgacggacgcggtacgtagttatgtgcggcgaagtagttagtacgttaagtaacgtacgttaacgttcgttaagtaaggtaaggcgggtagggttagttagtgttaacgttg

SEQ ID NO: 370593 - DNA, 566 bp, Homo sapiens
  misc_feature: GZ8MTXP01ETF4G.15.67.G01.1.454.CMB.2.raw
  modified_base (463)..(463): a, c, t, g, unknown or other
  modified_base (543)..(543): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccgaggccgggggggtccctgagactctcctgtgcagtctctggattcacccttagaagtatggatgacctgggtccgccgaggctcgaggggagggcgtggaggtgggtggaccaacaataaaacgaaagaacggaaagtacaaagaaaaaacctgtgtggaactcgtagtagaacggccgattcaccatctccagacacaacgacaagattcactgttattgacaaatgaaacngaccgtagaggagcggaggacgcggccgtgtattagttgtgcgaacgagagtagagtagtagacttcttacgtaagtagngtagggtgttagtgaagtttcgg

SEQ ID NO: 370594 - DNA, 569 bp, Homo sapiens
  misc_feature: GZ8MTXP01DB6MZ.15.67.G01.1.454.CMB.2.raw
  modified_base (384)..(384): a, c, t, g, unknown or other
  modified_base (515)..(515): a, c, t, g, unknown or other
  modified_base (550)..(550): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcacccttagaagtattggatgacctgggtccgccaggctccgaggggaaggggctgggagtggggtggccaaacaataaaacgaaagacggaaagtcaagaaaaaacctntgtggactcgtagtagaacggccgaattcaccatctaccagagacaacgaccaaagaattcactgtatttgacaaatgaaacagaccgtgaaggaggcgaaggaccgacggccgtagtattagttgtgcgngagatgagtaagtagaacgttcttaacgaagtagngtaggtggttatggaattg

SEQ ID NO: 370595 - DNA, 552 bp, Homo sapiens
  misc_feature: GZ8MTXP01BE8SW.15.67.G01.1.454.CMB.2.raw
  modified_base (500)..(500): a, c, t, g, unknown or other
  modified_base (525)..(525): a, c, t, g, unknown or other
  modified_base (532)..(532): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggcccgggggggtccctgagactctcctgtgcagtctctggattcacccttagaagtattggatgacctgggtccgccaggctccgaggggaaggggctggagtgggtggcaacataaacaaagacggaagtacagaaaaacctatgtaggactctgtgaacggccgattcaccatctccagagacaacgccaaagaattcactgtatttgacaaatgaacagcctggagaggcgaaggacgacggccgtggtaattagttgtgccggngagatgagtagtagacttccttaanaagtagnaggtggttaatggaattcgg

SEQ ID NO: 370596 - DNA, 535 bp, Homo sapiens
  misc_feature: GZ8MTXP01D8QZ2.15.67.G01.1.454.CMB.2.raw
  modified_base (303)..(303): a, c, t, g, unknown or other
  modified_base (367)..(367): a, c, t, g, unknown or other
  modified_base (403)..(403): a, c, t, g, unknown or other
  modified_base (482)..(482): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccgggggggtccctgagactctcctgtgcagtctctggattcacccttagaagtatggatgacctgggtccncaggctcaggggagggctggagtgggtgccaacataaacaaagacggaagtcaagaaaaacctntgtggactctgtgaacggcgattcaccatctcaganacaacgccaagaattcacttgtatttgacaaatgaactagcctaggagaggcgaggacacggcgtgtattattgtgcgngtagatgataacgtagacttcttacaagtagctagggtgttatgttaagttcg

SEQ ID NO: 370597 - DNA, 540 bp, Homo sapiens
  misc_feature: GZ8MTXP01A3EO3.15.67.G01.1.454.CMB.2.raw
  modified_base (416)..(416): a, c, t, g, unknown or other
  modified_base (517)..(517): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggcccgggggggtccctgagactctcctgtgcagtctctggattcacccttagaagtatggatgacctgggtccgccaggctccgaggggaaggggctggaggtgggtggccaacaataaaacaaagacggaagtacaagaaaaacctatgtggactctgtgaacggcgattcacatctccaganacacgacaagaattcactgtattgacaaatgaacagcctagagagggcgaaggacgacggaccgtgtattagtgtgcgcgagatgagtagtagacttcacngtagcgaggtgttatgaagttcg

SEQ ID NO: 370598 - DNA, 547 bp, Homo sapiens
  misc_feature: GZ8MTXP01CWTB0.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggctttgggtccgaggcccggggggggtccctggagactctcctgtgcagtctctggattcacccttagaagtattggatgacctgggtccgccaggctccgaggggaaggggctgggagtggggtggccaacataaacaaagacggaaagtcaagaaaaacctatagtggactctgtagaacggccgattcaccatctaccagagacaacgaccaagaattcactgtatttgacaaatgaacagccgtgagaggacgaggacacggcgtgtattagtgtgcgcgagatgagtagtgacttcacaagtagcgaggtgttatgaagttg

SEQ ID NO: 370599 - DNA, 590 bp, Homo sapiens
  misc_feature: GZ8MTXP01C3GYP.15.67.G01.1.454.CMB.2.raw
  modified_base (304)..(304): a, c, t, g, unknown or other
  modified_base (557)..(557): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctggagactctcctgtgcagtctctggattcaccttagaagtatggatgacctggtccncagctccgaggggaagggctggagtgggtggaccaaacaataaaaccgaaaaggacggaaagtacaaagaaaaaacctataggtaggaacctcgtagtacggaacgggcccgaattaccaccactcctaccagacgaacaaaccggaccaaagaattacaacttagtatttgactaaaatgaaacagccgtaggagaaggcggaagacgacggcgtagtattagttgtcggcgaacgagagtgagtaaggtanacttcaagaagtaagcgtaggtgttatgttgtg

SEQ ID NO: 370600 - DNA, 530 bp, Homo sapiens
  misc_feature: GZ8MTXP01EE8SE.15.67.G01.1.454.CMB.2.raw
  modified_base (345)..(345): a, c, t, g, unknown or other
  modified_base (375)..(375): a, c, t, g, unknown or other
  modified_base (379)..(379): a, c, t, g, unknown or other
  modified_base (414)..(414): a, c, t, g, unknown or other
  modified_base (447)..(447): a, c, t, g, unknown or other
  modified_base (487)..(487): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccggggggggtccctgagactctcctgtgcagtctctggattcacccttagaagtattggatgacctgggtccgccaggctccgaggggaggggctggagtgggtggccaaanataaacaaagacggaagtcaagaaaacctntagnggactctagtgaacggccgattcaccatctcaganacaacgcaagatcactgtattgacaaatgaaangccgtagagaggcgaggcacggcgtagtattagtgtgcgngagatgagtagtagacgttcacgtgtagcagggtgatgaagtg

SEQ ID NO: 370601 - DNA, 556 bp, Homo sapiens
  misc_feature: GZ8MTXP01BML56.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaggtgtccagtgtgaggtgcacttggtggagtcgtggggggaggcgttggtccgaggcccgggggggtccctgagactctcctgtgcagtctctggattcacccttagaagttattggatgacctgggtccgccaggctccgaggggaaggggcgtggaggtggggtggccaacaataaaacaaagacggaaagtcaagaaaaacctatgtggactctagtgaacggccattcaccatctccagagacaacgccaaagaattcaactgttatttgacaaatgaacagccgtagagaggcgaggcacgggccgtgtattattgtgcgtcgagatgataggtagacttcttacgaagtagcgagggtggttatgttaagttgg

SEQ ID NO: 370602 - DNA, 558 bp, Homo sapiens
  misc_feature: GZ8MTXP01B2BO1.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagtattggatgacctgggtccgccaggctccgaggggaaggggctggagtgggtggccaaacataaaacaaagacggaaagtcaagaaaaaacctatgtggactcgtagtacgaacggccgaattccaccatctccagagacaacgcaagaattcaactgtatttgacaaatagaacaagctgaagaggacgaggacacggccgtaggtattattggtgcgaacgagatggatacggtagacttcttacgaagtagcgaggtggttatggaattgg

SEQ ID NO: 370603 - DNA, 562 bp, Homo sapiens
  misc_feature: GZ8MTXP01D9JV6.15.67.G01.1.454.CMB.2.raw
  modified_base (305)..(305): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggcccgggggggtccctgagactctcctgtgcagtctctggattcacccttagagtattggatgacctgggtccnccaggctccaggggagggctgggagtgggtggcaacataaaacaaagacgaaagtcaagaaaaacctatgtggactctagtgaacggccgattcaccatctccagagacaacgaccaagaattacacttagttatttagactaaaatgaaacagacctagaagaggacgaggacgacgggccgtaggtattagttgtgcgcgagatggataagtaagacgttcttaacgaagtaagtcagggtggattggaatttgg

SEQ ID NO: 370604 - DNA, 545 bp, Homo sapiens
  misc_feature: GZ8MTXP01B796G.15.67.G01.1.454.CMB.2.raw
  modified_base (305)..(305): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcacccttagaagtatggatgacctgggtccnccaggctccgaggggagggctgggagtgggtggccaacataaacaaagacggaagtcaagaaaaaacctatgtggactcgtagtgaacggccgaattcaccatctccagagacaacgccaagaattcactgtatttgacaaatgaacagaccgtaggaggaggacgaaggacacgggccgtagtattattgtgcgcgagatgatagtagacttcacaagtgcgaggtgttatgttaagtg

SEQ ID NO: 370605 - DNA, 580 bp, Homo sapiens
  misc_feature: GZ8MTXP01EBMZB.15.67.G01.1.454.CMB.2.raw
  modified_base (305)..(305): a, c, t, g, unknown or other
  modified_base (346)..(346): a, c, t, g, unknown or other
  modified_base (525)..(525): a, c, t, g, unknown or other
  modified_base (529)..(529): a, c, t, g, unknown or other
  modified_base (559)..(559): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttggtccaggccgggggggtccctgagactctcctgtgcagtctctggattcacccttagaagtatggatgacctgggtccnccgaggctccgaggggaggggcgtggagtgggtggaccaanaataaaacaaagacggaaagtacaagtaaaaacctatagtaggactcgtagtacgaacggccgattcaccatctccaagacgacaacgacaagaattcacttgtatttagactaaatagaacagccgtagaggacgggacgacggacgacgggtccgttagtagtttattggtgccggngagntaggagttagtaagacttgttacaagtagngtagggtgttatgaagtttgg

SEQ ID NO: 370606 - DNA, 579 bp, Homo sapiens
  misc_feature: GZ8MTXP01BQVSK.15.67.G01.1.454.CMB.2.raw
  modified_base (266)..(266): a, c, t, g, unknown or other
  modified_base (304)..(304): a, c, t, g, unknown or other
  modified_base (424)..(424): a, c, t, g, unknown or other
  modified_base (452)..(452): a, c, t, g, unknown or other
  modified_base (455)..(455): a, c, t, g, unknown or other
  modified_base (458)..(458): a, c, t, g, unknown or other
  modified_base (460)..(460): a, c, t, g, unknown or other
  modified_base (462)..(462): a, c, t, g, unknown or other
  modified_base (504)..(504): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttctgttgttattttagaaggtgtccagtgtgaggtgcacttggtggagtcgtgggggaggcttggtccaggccgggggggtccctgagactctcctgtgcagtctcgnggtatcctacctagtaagtagtgatcgacgtgggcccncgagtcacggaggggaggcgtgggaggtgggcgacaaacgaaataaacgaaaggacgaagtacaaagtaaaaacctgtagtacggactcgtagaggaacgcgtatcactatccgacaganacaacgtacaaagtatcattatattaanaanaanananagacgagagagacgagacgacgtacgtagtagttagtgtcgngaagagagtagagtaagtaagttacgttacgttacgtaagtaggtaaggtaggtaggttagtaagttaagttaag

SEQ ID NO: 370607 - DNA, 615 bp, Homo sapiens
  misc_feature: GZ8MTXP01DOMXL.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggccgggggggtccctgagactctcctgtgcagtctctggattcacccttagaagtatggatgacctgggtccgccgaggctccgaggggagggcgtggaggtgggtggaccaaacaataaaacgaaagaaccggaaagtacgaagaaaaaaccctagtaggtaggaacctcgtaagggttacgaaccgggcccgtaatttccaacccatcctaccaagaacgaacaaaccgaccaaagaacttacaacttgttatttagacaaaatgaaacagcgtagaggaggacgaggacgacgggtcgtagttattattgtgcggaacgagatagagtaagtagacttcttaacgaagtacgcgtaggggtggttaagtgttaagtttgg

SEQ ID NO: 370608 - DNA, 554 bp, Homo sapiens
  misc_feature: GZ8MTXP01DMU8D.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggcccgggggggtccctgagactctcctgtgcagtctctggattcacccttagaagtattggatgacctgggtccgccaggctccaggggaaggggctgggagtgggtggccaacaataaacaaagacggaaagtacaagaaaaaacctatgtggaactctagtgaacgggccgattccaaccatctaccagagacaacgccaaagaattcactagtatttgacaaatgaacagccgtagaggaggcgaggacgacggcgtgtattatgtgcgcgagatgagtagtagacttcttactaagtagcagggtggttatgaagttg

SEQ ID NO: 370609 - DNA, 586 bp, Homo sapiens
  misc_feature: GZ8MTXP01CONGD.15.67.G01.1.454.CMB.2.raw
  modified_base (531)..(531): a, c, t, g, unknown or other
  modified_base (536)..(536): a, c, t, g, unknown or other
  modified_base (558)..(558): a, c, t, g, unknown or other
  modified_base (565)..(565): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccggggggtccctgagactctcctgtgcagtctctggattcacccttagaagtatggatgacctgggtccgccaggctccgaggggaaggggctgggagtgggtggccaaacaataaaacgaaagaacggaaagtcaaagaaaaaacctatggtaggaactcgtaggtacgaaccggccgtaattccaccatcctaccaagacgaacaaacgaccaaagaattcaacttgtatttgacaaatgaaacagccgtgaaggaggacgaaggaccgacgggccgtggtaattagtggtgcggngaagntagagtaagtagacgttcttanaagtagngtagggtgttaatgaagtttg

SEQ ID NO: 370610 - DNA, 591 bp, Homo sapiens
  misc_feature: GZ8MTXP01BX0UD.15.67.G01.1.454.CMB.2.raw
  modified_base (306)..(306): a, c, t, g, unknown or other
  modified_base (350)..(350): a, c, t, g, unknown or other
  modified_base (437)..(437): a, c, t, g, unknown or other
  modified_base (542)..(542): a, c, t, g, unknown or other
  modified_base (547)..(547): a, c, t, g, unknown or other
  modified_base (573)..(573): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttccttgttgttattttagaaggtgtccagtgtgaggtgcacttggtggagtcgtgggggaggcttgggtccagggcccggggggtccctgagactctcctgtgcagtctctggattcacccttagaagtattggatgacctgggtccnccaggctccgaggggaaggggcgtggaggtggggtggaccaaanaataaaacaaagaacggaaagtacaaaggaaaaaaccctagtaggtaggacctcgtaggtagaaccggccgaatttcaacccatccnccaagagacaaacggacccaaagaacttcaactagttatttgaacaaatagaacagcctaggaggaggacgaaggaccgacggccgttagtattagttgtgccgngaagntagatagagacttcttacaagtacgngagggtgttatgaagttg

SEQ ID NO: 370611 - DNA, 551 bp, Homo sapiens
  misc_feature: GZ8MTXP01AUKLN.15.67.G01.1.454.CMB.2.raw
  modified_base (383)..(383): a, c, t, g, unknown or other
  modified_base (413)..(413): a, c, t, g, unknown or other
  modified_base (490)..(490): a, c, t, g, unknown or other
  modified_base (501)..(501): a, c, t, g, unknown or other
  modified_base (505)..(505): a, c, t, g, unknown or other
  modified_base (532)..(532): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtccagtgtgaggtgcacttggtggagtcgtgggggaggcttggtccaggccgggggggtccctgagactctcctgtgcagtctctggattcacccttagaagtatggatgacctgggtccgccaggctccgaggggagggctggagtgggtggccaacaataaacaaagacggaagtacaagaaaaacctatagtaggactntagtgaacggcgaattcaccatctccaganacaacgaccaagaattcactgtatttgactaaatagaacagccgtagacggaggacggaggaccgacggccgtagtnttattgtgcgngagngtgagtagtagacttcttacaagtagnagggtgttatgttaagttg

SEQ ID NO: 370612 - DNA, 549 bp, Homo sapiens
  misc_feature: GZ8MTXP01CZC7K.15.67.G01.1.454.CMB.2.raw
  modified_base (381)..(381): a, c, t, g, unknown or other
  modified_base (515)..(515): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggccgggggggtccctgagactctcctgtgcagtctctggattcacccttagaagtattggatgacctgggtccgccaggctccgaggggaaggggctgggagtgggtggccaaacataaaacaaagacggaaagtcaagaaaaacctangtggactctagtgaacggccgattcaccatctccagagacaacgccaaagaattcactgtatttgacaaatgaacagcctgagaggacgaggacgacggccgtagtattatgtgcgcgagatgatagagacttnttacaagtagcgtagggtggttatgttaagttcg

SEQ ID NO: 370613 - DNA, 627 bp, Homo sapiens
  misc_feature: GZ8MTXP01BWB7C.15.67.G01.1.454.CMB.2.raw
  modified_base (546)..(546): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtggggggaggcgttgggtccgagggcccgggggggtccctggagactctcctgtgcagtctctggacttcacccttagaagtattggatgacctgggtccgccgaggctccgaggggaaggggctgggaggtggggtcggaccaaacaataaaacgaaaggacggaagtacaaagaaaaaacctgtagtaggactcgtagtacgaacggccgaattcaacccatcctaccgaagacgaacaacgaccaaagaattacacttgttaatttagacaaagtagaaacagaccgtagaggaggacgaaggaccgacggccgtagtattagtttaggngcggaagagttagtagaacgtagtaacgttacgttacgttacgaaggtaggaacgtagggtaggttagtaagttaagttcg

SEQ ID NO: 370614 - DNA, 555 bp, Homo sapiens
  misc_feature: GZ8MTXP01CJWOH.15.67.G01.1.454.CMB.2.raw
  modified_base (307)..(307): a, c, t, g, unknown or other
  modified_base (346)..(346): a, c, t, g, unknown or other
  modified_base (376)..(376): a, c, t, g, unknown or other
  modified_base (454)..(454): a, c, t, g, unknown or other
  modified_base (521)..(521): a, c, t, g, unknown or other
  modified_base (528)..(528): a, c, t, g, unknown or other
  modified_base (533)..(533): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtggggggaggcttggtccgagggccgggggggtccctgagactctcctgtgcagtctctggattcaccttagagtattggatgacctgggtccnccgaggctccgaggggagggctggagtgggtggaccaanataaacaaagacggaatcaagaaaaacctntgtggactctagtgaacggccgattcacatctacagagacaacgaccaaagattcactgttatttgacaaatgaaacngaccgtgacgaggacgaggacgacggtcctagtattatgtgcgcgagagtgagtaaggtagaccttnttaacgngtagngtagggtggttatgaagtttgg

SEQ ID NO: 370615 - DNA, 557 bp, Homo sapiens
  misc_feature: GZ8MTXP01AC4UB.15.67.G01.1.454.CMB.2.raw
  modified_base (305)..(305): a, c, t, g, unknown or other
  modified_base (448)..(448): a, c, t, g, unknown or other
  modified_base (512)..(512): a, c, t, g, unknown or other
  modified_base (516)..(516): a, c, t, g, unknown or other
  modified_base (541)..(541): a, c, t, g, unknown or other
  modified_base (554)..(554): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccgaggccgggggggtccctgagactctcctgtgcagtctctggattcacccttagaagtatggatgacctgggtccnccaggctccgaggggaggggctggaggtgggtggccaaacaataaaacgaaagacggaaagtacaaagaaaaaccctatgtaggactcgtagtacgaacgggccaaattcaccattcaccagacacaacgaccaaagaacttnactgtatttgacaaatgaacagcgtgagaggacgaagacgacggccgtagtattagtgtcgcgngaantaggatagagacttcataaggtagngtaggtgttatgngtg

SEQ ID NO: 370616 - DNA, 542 bp, Homo sapiens
  misc_feature: GZ8MTXP01AQ3YJ.15.67.G01.1.454.CMB.2.raw
  modified_base (502)..(502): a, c, t, g, unknown or other
  modified_base (526)..(526): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccaggccgggggggtccctgagactctcctgtgcagtctctggattcacccttagaagtattggatgacctgggtccgccaggctccaggggaaggggctggagtggggtggccaacataaaacaaagacgaaagtcaagaaaaaacctatgtggactctagtgaacggccgattcaccatctcagagacaacgaccaagaattcactgtatttgacaaatgaacagccgtggaagaggcgaaggacacggccgtagtattattgtgcgcgaagntgagtagtagacttcacaagagtnagggtgttatgaattg

SEQ ID NO: 370617 - DNA, 602 bp, Homo sapiens
  misc_feature: GZ8MTXP01AH3WF.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggccgggggggtccctgagactctcctgtgcagtctctggattcacccttagaagtattggatgaccgtgggtccgccgaggctccgagggggaaggggcgtgggaggtggggtggaccaaacaataaaacgaaaggacggaaagtacaaagaaaaaccctatggtaggactcgtagtagaacggccgattccaccatcctaccagacgaacaacgaccaaagaattcaacttgtatttagacaaatgaacagccgtagaggaggacggaaggaccgacgggccgttagtagttagttgtcgcggaacgaggagtagttagtaaggtagacgttcttacgaaggtagcgtagggtgttagttgaagtttgg

SEQ ID NO: 370618 - DNA, 610 bp, Homo sapiens
  misc_feature: GZ8MTXP01DW5PY.15.67.G01.1.454.CMB.2.raw
  modified_base (518)..(518): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagtattggatgacctgggtccgccaggctccgaggggaaggggctgggagtgggtggaccaaacaataaacaaaggacggaagtcaagaaaaacctagtagtggactcgtagtgaacggccgaattcaccatctaccaagacgaacaacgaccaaagaattacaacttgttaatttgactaaatgaaacagccgtagagacgccggaggaccgacggccgtagtattacgtgttgngaagagacagttagaaacgaacgggttaggaacgttaaaccgggggaaggggttagaagtggtcgtttagtaagttaacggtttaacggggg

SEQ ID NO: 370619 - DNA, 698 bp, Homo sapiens
  misc_feature: GZ8MTXP01C7RZ5.15.67.G01.1.454.CMB.2.raw
  modified_base (315)..(315): a, c, t, g, unknown or other
tcagtctacgtagccacgaccggtgctcgatttagagtatacatattgggtttgaggtctcagagaggagccttagccctggagtccaaggcctttccacttggtgatcagcactgagcacagaggactcaccatggagttgggctgagcttgggttttccttgttgttatttagaaggtgtccagtgtgaggtgcacgttgggtggaggtcgtggggggaggctttgggtcccgagggcccgggggggtccctggagactctcctgtgcagtctctggattcacccttagaagtattggatgacctgggtcccnccgaggcctccgaggggaaggggcgtgggaggtgggtggacccaaagaataaaaccgaaaggaaccgggaaagtcaaaggaaaaaaaccctagtaggtacggaacttccgtaagtacgggaaccggcccgtaactttaccaacccatcctaccgagacgaacaacggaccaaagaactttacaacttagttatttacgacaaaattgaaacgagacccgtaggaacggaagggaccggaaagggaaccgtaccgggtccgttaggtttaagtttagttggtggccggaacgaaggagttagaagttaaagtacggttaaacccttgttaaaccgtaaggttaaacgggcggtaagggttaggttaagttaaggttaacgtttg

SEQ ID NO: 370620 - DNA, 579 bp, Homo sapiens
  misc_feature: GZ8MTXP01DRLND.15.67.G01.1.454.CMB.2.raw
  modified_base (563)..(563): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtggaggtgcacttggtggaggtcgtgggggaggcttggtccgaggcccgggggggtccctgagactctcctgtgcagtctctggattcacccttagaagtattggatgacctgggtccgccaggctccgaggggaaggggctgggagtggggtggaccaaacaataaaacgaaaagacggaaagtcaaagaaaaaacctatgtaggaactcgtagtagaaccgggcccgaattccaccatctccaagagaacaacgaccaaagaattcaactgtaatttgacaaaatgaaacagaccgtggaaggaggacgaaggacacggccgtagtattagttgtgcgcgaggatggatagtagacttcttacaagtaaggngaggtgttatgttgtg

SEQ ID NO: 370621 - DNA, 552 bp, Homo sapiens
  misc_feature: GZ8MTXP01BTIG1.15.67.G01.1.454.CMB.2.raw
  modified_base (269)..(269): a, c, t, g, unknown or other
  modified_base (300)..(300): a, c, t, g, unknown or other
  modified_base (333)..(333): a, c, t, g, unknown or other
  modified_base (369)..(369): a, c, t, g, unknown or other
  modified_base (413)..(413): a, c, t, g, unknown or other
  modified_base (419)..(419): a, c, t, g, unknown or other
  modified_base (425)..(425): a, c, t, g, unknown or other
  modified_base (443)..(443): a, c, t, g, unknown or other
  modified_base (445)..(445): a, c, t, g, unknown or other
  modified_base (447)..(447): a, c, t, g, unknown or other
  modified_base (486)..(486): a, c, t, g, unknown or other
  modified_base (488)..(488): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgaggccgggggggtccctgagactctcctgtgcagtctcnggattcaccctagaatatgatgactggtccncagctcgaggggaggctggagtgggtgaccaanaataaaacgaaagacggaagtcaaagaaaaaacctntagtggaactcgtagtacgaacggcaattcaaccattcacaganacaacncgaaanatcatgtattgactaaanananagacgagagagacgagacgacgacgtagtattagtgtgngngagagtagttagtaagtaagttacgttacttacgaagtagtaaggtaggtaggttagtgttgtg

SEQ ID NO: 370622 - DNA, 566 bp, Homo sapiens
  misc_feature: GZ8MTXP01BU1RU.15.67.G01.1.454.CMB.2.raw
  modified_base (513)..(513): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggcccgggggggtccctgagactctcctgtgcagtctctggattcacccttagaagtattggatgacctgggtccgccaggctccgaggggaaggggcgtggaggtgggtggaccaaacataaaacaaagacggaaagtacaagaaaaaaccctagtagtggactctagtacgaacggccgattacaccatctcagagacaacgccaaagattcactgtatttgacaaatgaacagccgtagagaggacgaggacgacggccgtaggtacttagtgtgcgngagatgagttagagttacttcttacgaagtagcgtaggtggttatgaagttgg

SEQ ID NO: 370623 - DNA, 550 bp, Homo sapiens
  misc_feature: GZ8MTXP01A74PU.15.67.G01.1.454.CMB.2.raw
  modified_base (532)..(532): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagtattggatgacctgggtccgccaggctccgaggggaaggggctgggagtgggtggcctaaacataaaacaaagacggaaagtcaagaaaaaacctatgtggactctagtagaacggcgattcaccatctcagagacaacgccaagaattcactgtatttgacaaatgaacagccgtgaaggaggacgaggacacggccgtagtattagttgtgcgtcgagatgagtagtagacttcttacaagtacgngagggtgttatgaagttg

SEQ ID NO: 370624 - DNA, 532 bp, Homo sapiens
  misc_feature: GZ8MTXP01BJJC8.15.67.G01.1.454.CMB.2.raw
  modified_base (338)..(338): a, c, t, g, unknown or other
  modified_base (369)..(369): a, c, t, g, unknown or other
  modified_base (404)..(404): a, c, t, g, unknown or other
  modified_base (485)..(485): a, c, t, g, unknown or other
  modified_base (504)..(504): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtacacttggtggagtcgtgggggaggcttggtccaggccggggggtccctgagactctcctgtgcagtctctggattccacccttagaagttatggatgacctggtccgcaggctcgagggaggggctggagtgggtggccaanataaacaaagacggaagtcaagaaaaactangtggactctgtagaacgccgatcaccatctcaganacaagccaagaatcactagtattgacaaatgaacagcctggagagggcgaggacgacggcgtgtattattgtgcgcgaagnttgattaggagacttcganagtaagcaagggtgattgaagttcgttg

SEQ ID NO: 370625 - DNA, 671 bp, Homo sapiens
  misc_feature: GZ8MTXP01AI9GL.15.67.G01.1.454.CMB.2.raw
  modified_base (305)..(305): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggccgggggggtccctgagactctcctgtgcagtctctggattcacccttagaagtatggatgacctgggtccnccaggctccgaggggagggcgtggaggtgggtggaccaaacaataaaacgaaaggaacggaagtacaaagaaaaacctagtaggtaggactcgtaggtacggaaccgggccgtaactttaccaaccctactacctaccgaaagacgaaaccgaaaccggaccaaacgtaacttactaaccgttagttaacttttaggaaccttaaaagtacgaaacgacgacccggtaggaacgggagggaccggaaggaccggaccggtccggttagttattagttgtcggcggaacggaagttagtagaagttaaggtacgttaacgttcttaacgtaaggttagcggtaagggtaggttatggttaagtttgg

SEQ ID NO: 370626 - DNA, 577 bp, Homo sapiens
  misc_feature: GZ8MTXP01ALKJT.15.67.G01.1.454.CMB.2.raw
  modified_base (558)..(558): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtccgtgggggaggtcttgggtccgagggcccggggggtccctgagactctcctgtgcagtctctggattcacccttagaagtattggatgaccgtgggtccgccaggctccgaggggaaggggctggaggtgggtggccaaacaataaaacaaaggaacggaaagtacaaagaaaaacctagtgtggactctagtgaacggccgtattcaccatctaccaagacgaacaacgaccaaagaacttcactagtatttgactaaatagaaacagaccgtggagaggcgaaggacgacggccgtgtattagtgtgcgaacgagatgagtaagtagacttcttaacgaagtagngtagggtgttatgaagttg

SEQ ID NO: 370627 - DNA, 812 bp, Homo sapiens
  misc_feature: GZ8MTXP01CLEZC.15.67.G01.1.454.CMB.2.raw
  modified_base (312)..(312): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacgttggtggagtcgtggggggaggcttgggtccgagggcccgggggggtccctggagactctcctgtgcagtctctggattcacccttagaagtattggatgacctgggtccnccaggctccgaggggaaggggctggaggtgggggtcggaccaacaaataaaacaaaaggtacggaaagtacaaagtaaaaaaccctataggtaggaactcgtaggttagaaccgggcctaacgtttccaaccctatccctaccgaacgaacgaaccgaaaccgaccccaaaggtaaactttaccaaccgtttaggtaactttttaggacctaaaaagttacggaaaaccgtaacggaccccggtttagggaaaggggtaacgggaacccgggtaaacggggaaaccccgaaacccgggggtccccgggttaacggtttaaacgttttaaacggtttgggttaacggtccccggggtaacggtaaaacgggacgttacggggttaaacgtttaaacgggttaagggttaacccccttaagttaaaacccgtaaggggttaaaggtaacccgggtaagggggttacgggttttaagtaacgggttaaacgtttttaacgggg

SEQ ID NO: 370628 - DNA, 575 bp, Homo sapiens
  misc_feature: GZ8MTXP01A8CKY.15.67.G01.1.454.CMB.2.raw
  modified_base (385)..(385): a, c, t, g, unknown or other
  modified_base (514)..(514): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctagggttttccttgttgttattttagaaggtgtccagtgtgaggtgcacttggtggagtcgtgggggaggcttggtccgaggccgggggggtccctgagactctcctgtgcagtctctggattcacccttagaagtattggatgacctgggtccgccaggctccgaggggaagggctgggaggtgggtggccaaacaataaaacgaaagacggaaagtacaaagaaaaaacctntgtaggactctagtacgaacggccgaattcaccatctaccagagaacaacggaccaaagaattcaactgtatttgacaaatgaaacagccgtagagaggacgaggacacggccgtaggtattagttggngcgaagagagtagagtagtacttacgttcgacgtaagtagaagtaggtgttagtgttcgtg

SEQ ID NO: 370629 - DNA, 563 bp, Homo sapiens
  misc_feature: GZ8MTXP01BSTK1.15.67.G01.1.454.CMB.2.raw
  modified_base (376)..(376): a, c, t, g, unknown or other
  modified_base (411)..(411): a, c, t, g, unknown or other
  modified_base (416)..(416): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtcctgagactctcctgtgcagtctctggattcacccttagaagtatggatgacctgggtccgcaggctccgagggggaagggctgggagtgggtggccaaacaataaacgaaagacggaaagtcaaagaaaaacctntagtgactctagtcgaacggccgattcaccatccncaganacaacgcaagaattcaactgtatttgacaaatgaaacagcctaggagacggacgaacggacgacggccgttaggtattagtcgtgccgaagagatacgagtagtacggttacttcgacaaggtagcgtagggtggttatggaattcg

SEQ ID NO: 370630 - DNA, 554 bp, Homo sapiens
  misc_feature: GZ8MTXP01CTTMD.15.67.G01.1.454.CMB.2.raw
  modified_base (346)..(346): a, c, t, g, unknown or other
  modified_base (378)..(378): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggccgggggggtccctgagactctcctgtgcagtctctggattcacccttagaagtatggatgacctgggtccgccaggctccgaggggaaggggctgggagtgggtggccaanaataaacaaagacggaagtcaagaaaaacctntgtggactctgtgaaccggcattcaccatctccagagacaacgaccaaagaattcgaacttgttatttgacaaatgaaacagccgtgaggaggacgaggacacggcgtagtattattgtgcgcgagatgagtaagtgacttcttacgaagtacgcgtagggtggttatgaacgttg

SEQ ID NO: 370631 - DNA, 556 bp, Homo sapiens
  misc_feature: GZ8MTXP01ADADP.15.67.G01.1.454.CMB.2.raw
  modified_base (346)..(346): a, c, t, g, unknown or other
  modified_base (388)..(388): a, c, t, g, unknown or other
  modified_base (407)..(407): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcttgggtccgaggccggggggtccctgagactctcctgtgcagtctctggattcacccttagaagtattggatgacctgggtccgccaggctccgaggggaagggctggagtggggtggccaanataaaacaaagacggaagtacaagaaaaacctatgtggactntagtgaacgcgattcaccntctcagacgacacgaccaagaacttcactgttatttgacaaatgaacagccgtagaggaggacgaggacgacggcgtagtattatggtgcgaagagagtgagtagtaacgacttcgttacgaagagcgaggtgggttatgttaagtttg

SEQ ID NO: 370632 - DNA, 558 bp, Homo sapiens
  misc_feature: GZ8MTXP01CXJ14.15.67.G01.1.454.CMB.2.raw
  modified_base (422)..(422): a, c, t, g, unknown or other
  modified_base (499)..(499): a, c, t, g, unknown or other
  modified_base (534)..(534): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggtccgggggggtccctggagactctcctgtgcagtctctggattcacccttagaagtatggatgactggtccgccaggctccgagggaagggctggaggtggtggaccaacaataaaacaaaaggacggaaagtacaaagaaaaacctatagtggaactctagtagaacggccgattcacatctccaganacaacgaccaagaatcaactgtattgacaaatgaacagcctgaggaggcgagacgacggcgtagtattatgtagcgngtagatgagtagtagttacgttccttagaagtagngtagggtggttatgttaagtttgg

SEQ ID NO: 370633 - DNA, 543 bp, Homo sapiens
  misc_feature: GZ8MTXP01A3VXE.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagtattggatgacctgggtccgccaggctccgaggggaaggggctgggagtgggtggccaacataaacaaagacggaaagtcaagaaaaaacctatgtggactcgtagtagaacggccgattcaccatctcagagacaacgcaagattcactgtatttgacaaatgaacagccgtgagaggcgaggacgacggccgtggtattagttgtgcgcgagatgagtagtagacgttcttacaagtagcaggtggttatgttaatcg

SEQ ID NO: 370634 - DNA, 555 bp, Homo sapiens
  misc_feature: GZ8MTXP01BIULN.15.67.G01.1.454.CMB.2.raw
  modified_base (305)..(305): a, c, t, g, unknown or other
  modified_base (506)..(506): a, c, t, g, unknown or other
  modified_base (508)..(508): a, c, t, g, unknown or other
  modified_base (526)..(526): a, c, t, g, unknown or other
  modified_base (538)..(538): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattcacccttagaagtattggatgacctgggtccnccaggctccgaggggaaggggctgggagtggggtggccaacataaaacaaagacggaaagtcaagaaaaaaccctatgtaggactctagtagaacggccgattcacccatctccaagagacaacgccaaagaacttcaactgtatttgactaaatgaacagccgtgaagaggcgaggacacggcgtagtattattgtgcgngngatggatagtagacgttnacgaagtagcgngggtgttatggaattgg

SEQ ID NO: 370635 - DNA, 752 bp, Homo sapiens
  misc_feature: GZ8MTXP01BQUKM.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcgtagtctcgtggtacttcctacccgttaagtaagttagtggatcgaccgtcgggtccccgccgaggtcctccggagggggaacgggcgtgggaggtgggggtcggaccaaacaaataaaacgaaaggaacggaaagtacgaaaacggtaaaaaaccttgtaggtacggtaaccttcgttaacgggttacgggaacccggggtccgtaactttacccgaaccctaacttccgtaccgaaagaaccgaacaaacccgaaccgaaagtaacttacaacgttagttatttacggaacctaaaagtacgaaacacgtaccggtaggaagggacgggacgggaaggaaccggaccccgggtacgttaaggtttatttaagtttcggtaggtaccggaacgggtaagttagtagttaaagttaagggtaacttacctttaccgttaacggtaaggttaccggcggttaaagggggttgttagttgttaacccgggttttg

SEQ ID NO: 370636 - DNA, 568 bp, Homo sapiens
  misc_feature: GZ8MTXP01D1MA6.15.67.G01.1.454.CMB.2.raw
  modified_base (304)..(304): a, c, t, g, unknown or other
  modified_base (383)..(383): a, c, t, g, unknown or other
  modified_base (549)..(549): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagtatggatgacctgggtccncgaggctcaggggagggctggagtgggtggaccaaacaataaaacaaagacggaagtacaagaaaaactatgtggactntagtagaacggcgattcaccatctcagagacaacgacaagaattacactgttaatttgactaaatgaaacagccgtaggaggagggacggaggacgacgggtccgttaggtatttagttgtacgcggtaacgagagtgagttaagtagacttcttacaagtaaggngtaggtgttagtgttgttg

SEQ ID NO: 370637 - DNA, 550 bp, Homo sapiens
  misc_feature: GZ8MTXP01EM4TH.15.67.G01.1.454.CMB.2.raw
  modified_base (307)..(307): a, c, t, g, unknown or other
  modified_base (375)..(375): a, c, t, g, unknown or other
  modified_base (385)..(385): a, c, t, g, unknown or other
  modified_base (410)..(410): a, c, t, g, unknown or other
  modified_base (415)..(415): a, c, t, g, unknown or other
  modified_base (442)..(442): a, c, t, g, unknown or other
  modified_base (532)..(532): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggcccggggggggtccctgagactctcctgtgcagtctctggattcacccttagaagttattggatgactgggtccncaggctcgaggggagggctggagtgggtgccaaacataaacgaaagacggaagtacaagaaaaacctntgtaggactntagtgaacggccgattccaccatcncaganacaacgcaagaattcactgttattganaaatgaacagaccgtagaggaggcggagacgacggccgtagtattattggtagcggtaagagataggatagtagacgttcttagaagtgngagggtgttatgaattgg

SEQ ID NO: 370638 - DNA, 539 bp, Homo sapiens
  misc_feature: GZ8MTXP01BV68Q.15.67.G01.1.454.CMB.2.raw
  modified_base (411)..(411): a, c, t, g, unknown or other
  modified_base (522)..(522): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagtattggatgacctgggtccgccaggctccgagggggaaggggctgggagtggggtggccaaacataaacaaagacggaagtcaagaaaaacctatgtggactctgtgaacggccgattcaccatcncagagacaacgaccaagaattcactgtatttgacaaatgaacagcctgagaggcgaggacacggcgtgtattattgtgcgcgagatgatagtagacttcacgaagtagcgngggtggttatgaattgg

SEQ ID NO: 370639 - DNA, 575 bp, Homo sapiens
  misc_feature: GZ8MTXP01AHDYX.15.67.G01.1.454.CMB.2.raw
  modified_base (525)..(525): a, c, t, g, unknown or other
  modified_base (555)..(555): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggcccgggggggtccctggagacctctcctgtgcagtctctggattcacccttagaagtattggatgaccgtgggtccgccaggctccgagggggaaggggctggggagtggggtggaccaaacaataaaaccaaaggacggaagtacaagaaaaacctagtgtggactcgtagtagaacggccgaattcaccatcaccagacgacaacgaccaagaattcactgttatttgacaaatcgaaacagccgtagaggaggccgaggtaccgacggccgtagtattagtgtgcggngagatgacgtagacacgttcttagaagagngtagggtgttagtgttcgtg

SEQ ID NO: 370640 - DNA, 562 bp, Homo sapiens
  misc_feature: GZ8MTXP01BXCV3.15.67.G01.1.454.CMB.2.raw
  modified_base (445)..(445): a, c, t, g, unknown or other
  modified_base (517)..(517): a, c, t, g, unknown or other
  modified_base (533)..(533): a, c, t, g, unknown or other
  modified_base (539)..(539): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttggtccgaggccgggggggtccctgagactctcctgtgcagtctctggattcacccttagaagtatggatgacctgggtccgccaggctccgaggggaaggggctggagtgggtggccaacataaacaaagacggaagtcaagaaaaacctatgtggactctagtgaacggccgattcgaccatctccagagacaacgcaaagaattcaactgtatttganaaatgaaacagccgtaggacggagggaccggaagggaccaccggggccgtagtacttattggtgcggcgagntagagtagtagacttnttaacngtagcgaggtggttatgaattgg

SEQ ID NO: 370641 - DNA, 581 bp, Homo sapiens
  misc_feature: GZ8MTXP01BTFZU.15.67.G01.1.454.CMB.2.raw
  modified_base (545)..(545): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagtatggatgacctgggtccgccaggctccgaggggaagggctgggaggtggggtggaccaaacaataaacgaaagacggaaagtacaaagaaaaacctatagtaggactcgtagtacgaacggcgattcaccatctaccagagacaacgacaagaattcaactgttatttagacaaatagaaacgagccgtagaacggaggacggaaggaccgacggccgtaggtattagttgtgcgcgagagtagagtaggtagacgttnttaccgaagttaggcgtagggtggttatgaagtttg

SEQ ID NO: 370642 - DNA, 637 bp, Homo sapiens
  misc_feature: GZ8MTXP01C1STM.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtcagtgtgaggtgcacgttggtggagtcgtgggggaggcgttggtccgaggccgggggggtccctgagactctcctgtgcagtctctggattcacccttagaagtattggatgacctgggtccgccaggctccgaggggaaggggcgtgggaggtggggtggaccaaacaataaaacgaaaggaacggaaagtacaaagaaaaaacctatagtggaactctagtagaacggccgattacaccatctccagacacaacgaccaaagaattcaactgttatttagacaaaatgaaactacggaccgttaggaacggaacgggacggaagggaacccgtaaccggggcccgttagggtatttaagttggtagccggaacggagttagtcgaagttaaagtaggttaacttccgttaaacgaaggttaaaggcggtaagggttggttagtgttaacgttg

SEQ ID NO: 370643 - DNA, 554 bp, Homo sapiens
  misc_feature: GZ8MTXP01AR70C.15.67.G01.1.454.CMB.2.raw
  modified_base (502)..(502): a, c, t, g, unknown or other
  modified_base (548)..(548): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcacccttagaagtattggatgacctgggtccgccaggctccgaggggaagggcgtgggagtgggtggccaacataaaacaaagacggaagtacaagaaaaacctatagtggactcgtagtagaacggccgattcatcatctccagagacaacgccaagaattcactgtatttgacaaatgaacaggcctgagaggcgaaggacacgggtccgtgtattagtgtggcgngagattgagtagttagcttactaacagtaagcgagggttggtaagnggtaag

SEQ ID NO: 370644 - DNA, 615 bp, Homo sapiens
  misc_feature: GZ8MTXP01C4FWF.15.67.G01.1.454.CMB.2.raw
  modified_base (226)..(226): a, c, t, g, unknown or other
  modified_base (280)..(280): a, c, t, g, unknown or other
  modified_base (377)..(377): a, c, t, g, unknown or other
  modified_base (429)..(429): a, c, t, g, unknown or other
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggnaagtcaggacattagactgacttaggtgtatcagacaagaaacgtccgggaaanccccctaaagccttcctagacttcgtagtcgctgccaattaccctaacttttaaacgaaaggtcggggtacccccagtacgaaggttcaggccgganggtggactcgtgggactaacgagtactttcacttctaccaactcacagaccncgtccgcgacgacgtacgtagtaacgttacttacgtaacttaacttacttacgtacgtactaaactaagttaacttaactaaccgttaccggtaacggtaccggttccggacggttaacgggtaaaccgtaaggttaacgaaacttaacgtaaacgtacgtcggtgtacgacgtaaccttaacgtg

SEQ ID NO: 370645 - DNA, 610 bp, Homo sapiens
  misc_feature: GZ8MTXP01CHMP5.15.67.G01.1.454.CMB.2.raw
  modified_base (553)..(553): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggctttgggtccgaggccgggggggtccctgagactctcctgtgcagtctctggattccacccttagaagtattggatgacctgggtcccgccaggctccgaggggagggctgggaggtggggtggccaaacaataaaacaaagacggaaagtcaagaaaaaactagtagtaggactcgtgtacggaacggccgtaacttcaccatctaccagacgacaaccggaccaaagtaattcaacttagtatttagactaaatcgaaacacgccgtaggaaggacgggacggaaacgggaccgacgggtaccgttgttaagtttagttggtcgaccggngaaggttatggagttaagtagacttcttagaagtgcgagggtggttatgttaagttg

SEQ ID NO: 370646 - DNA, 562 bp, Homo sapiens
  misc_feature: GZ8MTXP01DSVEV.15.67.G01.1.454.CMB.2.raw
  modified_base (538)..(538): a, c, t, g, unknown or other
  modified_base (543)..(543): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtccagtgtgaggtgcacttggtggagtcgtggggggaggcttggtccgaggccgggggggtccctgagactctcctgtgcagtctctggattcacccttagaagttatggatgacctgggtccgccaggctccaggggaaggggctgggagtggggtggccaacaataaaacgaaagacggaaagtacaagaaaaacctataggtggactctagtgaacggccgattccaccatctcagagacaacgccaaagaattcgaactgttatttgacaaatgaaacacgccgtagagagggacgaggacacgggccgtaggtattattggtgcgtcgagatgagtagtagacttcttacgngtagngtaggtggttatgaagttg

SEQ ID NO: 370647 - DNA, 524 bp, Homo sapiens
  misc_feature: GZ8MTXP01AWSJM.15.67.G01.1.454.CMB.2.raw
  modified_base (463)..(463): a, c, t, g, unknown or other
  modified_base (480)..(480): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggcccggggggggtccctgagactctcctgtgcagtctctggattcacccttagaagtattggatgacctgggtccgcaggctccaggggagggctggagtgggtggcaacataaacaaagacggaagtcagaaaaacctatgtggactctagtgaacggcgattcaccatctccagagacaacgcaagaattcactgtatttgacaaatgaacagactgagagcgaggacnggctgtattatgtgcgngagagtgagtagtagacttcacgaagtgcagggtgttatgcttg

SEQ ID NO: 370648 - DNA, 568 bp, Homo sapiens
  misc_feature: GZ8MTXP01EICMH.15.67.G01.1.454.CMB.2.raw
  modified_base (302)..(302): a, c, t, g, unknown or other
  modified_base (514)..(514): a, c, t, g, unknown or other
  modified_base (539)..(539): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccgggggggtccctgagactctcctgtgcagtctctggattcacccttagaagtatggatgacctgggtccnccaggctccgaggggaagggctgggagtggggtgccaaacaataaaacgaaagacggaaagtacaagaaaaaacctagtagtaggactctagtacgaacggccgattccaccatctaccaagagacaaacgaccaaagaacttacactagttatttagacaaatgaaacagccgtagagaggcgaagaccgacggcgtgtattagtgtgcgngagatgagtaagtagacttcgttanaagtagaacgtaggtgttagtgaagttcg

SEQ ID NO: 370649 - DNA, 552 bp, Homo sapiens
  misc_feature: GZ8MTXP01AEMY3.15.67.G01.1.454.CMB.2.raw
  modified_base (380)..(380): a, c, t, g, unknown or other
  modified_base (504)..(504): a, c, t, g, unknown or other
  modified_base (506)..(506): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtgggggaggcttggtccgaggccggggggtccctgagactctcctgtgcagtctctggattcacccttagaagtattggatgacctgggtccgccaggctccgaggggaaggggctgggagtggggtggccaaacataaaacaaagacggaaagtcaagaaaaacctntgtggactctgtgaacggccgattcaccatctaccagacgaacaacgccaaagaatcactgtatttgacaaatagaacagccgtagacggaggacgaggacgacggccgtagtattatgtgcgngngatgagtagtaagcttcacgtaagtgcgagggtgttatgaacgttg

SEQ ID NO: 370650 - DNA, 574 bp, Homo sapiens
  misc_feature: GZ8MTXP01D5ZKG.15.67.G01.1.454.CMB.2.raw
  modified_base (344)..(344): a, c, t, g, unknown or other
  modified_base (466)..(466): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttgggtccaggccgggggggtccctgagactctcctgtgcagtctctggattcaccttagaagtatggatgacctgggccgcaggctccgaggggaaggggctggaggtgggtggaccaaanaataaacaaagacggaaagtacaagaaaaacctatgtggactcgtagtagaacggccgattcaccatctaccagagacaaacggaccaaagaacttacactgttatttgacaaatagaaacngaccgtagaggaggacgaaggaccacgggcgtagttattagttgtcgcggcgaagagtagaagtaggtagacgttcaacaaggtagcgaagggtgttatgttaagttg

SEQ ID NO: 370651 - DNA, 588 bp, Homo sapiens
  misc_feature: GZ8MTXP01D2V85.15.67.G01.1.454.CMB.2.raw
  modified_base (300)..(300): a, c, t, g, unknown or other
  modified_base (336)..(336): a, c, t, g, unknown or other
  modified_base (537)..(537): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccgggggggtcctgagactctcctgtgcagtctctggattcaccttagaagtatggatgacctgggtccncaggctcgaggggaggctggaggtgggtgaccaaanaataaacgaaagacggaaagtacaaagaaaaaacctgtagtaggactcgtaagtacgaaccggccgtaattccaacctatcctaccgaagacgaacaaacgaccaaagtaacttactaacttgttaatttgaacaaagtagaaacagtccgtaggaaggaggacggaggaaccgacggtccgtagttattagttgtcgcgngagatagagtagtacgacttcttacgaagtagcgaggtggttatgaagttg

SEQ ID NO: 370652 - DNA, 623 bp, Homo sapiens
  misc_feature: GZ8MTXP01AM72R.15.67.G01.1.454.CMB.2.raw
  modified_base (345)..(345): a, c, t, g, unknown or other
  modified_base (534)..(534): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggtttcctgttgttatttagaaggtgtccagtgtgaggtgcacgttggtggagtcgtggggggaggcttgggtccgaggcccgggggggtccctgagctctcctgtgcagtctccgattcacccttagaagttatggatgaccgtgggtccgcaggctccgaggggaggggctgggagtgggtcgaccaanaataaaacgaaaggacggtaatacaaagtaaaactgtaggtaggactcgtgtaacgaccgcgtactccacatccacgagacacaacgacaaagtatacacttagttattgaacaaagtacgaaacacgtaccgaggggaaggacggacggaacggaccgacggtcgtagttaatttagttggagccggngaagtaagttggaattaaggtacgtaacttaccgttaacttagggtaagacggtaagggttagggtattaggtaaccgttgttttaacg

SEQ ID NO: 370653 - DNA, 578 bp, Homo sapiens
  misc_feature: GZ8MTXP01E2NDX.15.67.G01.1.454.CMB.2.raw
  modified_base (519)..(519): a, c, t, g, unknown or other
  modified_base (523)..(523): a, c, t, g, unknown or other
  modified_base (530)..(530): a, c, t, g, unknown or other
  modified_base (556)..(556): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcttgggtccaggcccgggggggtccctgagactctcctgtgcagtctctggattcacccttagaagttattggatgacctgggtccgccaggctccgaggggaaggggctggaggtggggtggccaaacaataaaacgaaagacggaaagtacaaaggaaaaaccctatgtaggactctaagtagaaccggcgattcacatctccagagacaacgaccaaagaattcactgttatttgactaaatgaaacagccgtagaggaggacgaacggacgacggccgttagtattagttggngcgngagttangagtagacgacttcttagaagtacgngtagggtggttatggaatttcg

SEQ ID NO: 370654 - DNA, 567 bp, Homo sapiens
  misc_feature: GZ8MTXP01DM8YW.15.67.G01.1.454.CMB.2.raw
  modified_base (379)..(379): a, c, t, g, unknown or other
  modified_base (546)..(546): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattcacccttagaagttatggatgacctgggtccgccgaggctccgaggggaggggctgggagtgggtggccaaacaataaacgaaagacggaagtcaagaaaaacctntgtggactctagtgaacggcgattcaccatctcagagacaacgccaaagattacacttagttatttgacaaatgaaacacgaccgtagaaggaagggcggaagggaccgacggtccgtagttatttattgtgcggcgagatgatagtagacttcttaacgaagtagngagggtgttagtgaagtttcg

SEQ ID NO: 370655 - DNA, 553 bp, Homo sapiens
  misc_feature: GZ8MTXP01AEL8U.15.67.G01.1.454.CMB.2.raw
  modified_base (377)..(377): a, c, t, g, unknown or other
  modified_base (414)..(414): a, c, t, g, unknown or other
  modified_base (499)..(499): a, c, t, g, unknown or other
  modified_base (501)..(501): a, c, t, g, unknown or other
  modified_base (532)..(532): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcacccttagaagtattggatgacctgggtccgccaggctccgaggggaggggctggagtggggtggccaacataaacaaagacggaagtcaagaaaaacctangtggactctagtgaacggccgattcaccatctcaganacaacgccaaagaattacactgtatttagacaaatgaacagccgtgaggaggcgaaggcgacggccgtagtattagtcgtgccgngngatgagtagtagacgttcttacaagtagcgnggtaggttagtgttaagttgg

SEQ ID NO: 370656 - DNA, 547 bp, Homo sapiens
  misc_feature: GZ8MTXP01AUCM8.15.67.G01.1.454.CMB.2.raw
  modified_base (380)..(380): a, c, t, g, unknown or other
  modified_base (414)..(414): a, c, t, g, unknown or other
  modified_base (442)..(442): a, c, t, g, unknown or other
  modified_base (487)..(487): a, c, t, g, unknown or other
  modified_base (529)..(529): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagtatggatgacctgggtccgccaggctccgaggggaaggggctggagtgggtggaccaaacataaaacgaaagacggaagtcaagaaaaaaccctntaggtggactctagtgaacggccgatcaccatcncagagacaacgccaagaacttcgaactntatttgactaaatgaacagaccgtgagaggcgaggacacggcgtntattagtgtgcgcgagatgagtagtaagcttcacaagtgcgngggtagttagtgaagttg

SEQ ID NO: 370657 - DNA, 560 bp, Homo sapiens
  misc_feature: GZ8MTXP01BD26Y.15.67.G01.1.454.CMB.2.raw
  modified_base (418)..(418): a, c, t, g, unknown or other
  modified_base (504)..(504): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccgaggccgggggggtccctgagactctcctgtgcagtctctggattcacccttagaagtatggatgacctgggtccgccaggctccgaggggaaggggctgggagtggggtggccaacaataaacaaaggacggaaagtcaagaaaaacctatgtaggactctagtgaacggcgattcaccatctccaganacaacgacaagaattcactgtattgacaaatgaacacgccgtgaaggaggcgaaggaccacgggccgtaggtattagttgtgtcgngagagtgagtaagtagacttcttaacgaagtagcgtaagggtgttagtcgaagttg

SEQ ID NO: 370658 - DNA, 583 bp, Homo sapiens
  misc_feature: GZ8MTXP01EPUTZ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggcccggggggtccctgagactctcctgtgcagtctctggattcacccttagaagtatggatgacctgggtccgccgaggctccgaggggagggctggaggtgggtggaccaaacaataaaacgaaaggacggaaagtacgaaaggtaaaaaacctgtagtaggactcgtagtagaacggcgattcaccatctcagagacaacgaccaagattacactgttatttgactaaatagaaacagccgtaggaggacgggacggaaggacgaacggtccgtagttattagttgtcggcgcgagagtgagttagtaagacttcttacgaagtagcgtaggtggttatgttgtttaag

SEQ ID NO: 370659 - DNA, 551 bp, Homo sapiens
  misc_feature: GZ8MTXP01EHRP4.15.67.G01.1.454.CMB.2.raw
  modified_base (298)..(298): a, c, t, g, unknown or other
  modified_base (365)..(365): a, c, t, g, unknown or other
  modified_base (405)..(405): a, c, t, g, unknown or other
  modified_base (418)..(418): a, c, t, g, unknown or other
  modified_base (430)..(430): a, c, t, g, unknown or other
  modified_base (432)..(432): a, c, t, g, unknown or other
  modified_base (434)..(434): a, c, t, g, unknown or other
  modified_base (436)..(436): a, c, t, g, unknown or other
  modified_base (438)..(438): a, c, t, g, unknown or other
  modified_base (476)..(476): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcttgttgttatttagaaggtgtcagtgtgaggtgcacttggtggagtcgtggggggaggcttggtccaggccgggggggtcctgagactctcctgtgcagtctctggattcaccttagaagtatggatgactgggtccncaggctcgaggggagggctggagtgggtgcaacaataaacaaagacgaagtacaaagaaaaaacctntagtaggactcgtagtagaacggcattcaccatcacaganacaacgcaagatnactgtattgaanananananacgagagaggacgagacgacgacgtagtattagtgtgngaagagagtagttagtagtaagttacgttacttacgtaagtaggtaacggtagggtaggttagtaagttaagttg

SEQ ID NO: 370660 - DNA, 553 bp, Homo sapiens
  misc_feature: GZ8MTXP01BSVF1.15.67.G01.1.454.CMB.2.raw
  modified_base (507)..(507): a, c, t, g, unknown or other
  modified_base (538)..(538): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgagggcccgggggggtccctgagactctcctgtgcagtctctggattcacccttagaagtattggatgacctgggtccgccaggctccgaggggaaggggctgggagtggggtggaccaacaataaacaaagacggaaagtacaagaaaaacctatgtggactctagtgaacggccgattcaccatctccagagacaacgaccaagaattcacttgtatttgacaaatgaaacagccgtaggagagggacgaggacacgggcgtagtattatgtgcgngagatgagtacgtagacttcttacaagtagngaggtgatggaattg

SEQ ID NO: 370661 - DNA, 581 bp, Homo sapiens
  misc_feature: GZ8MTXP01BXOIW.15.67.G01.1.454.CMB.2.raw
  modified_base (439)..(439): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgaggcccgggggggtccctgagactctcctgtgcagtctctggattcacccttagaagtattggatgaccgtgggtccgccgaggctccgaggggaaggggcgtgggaggtggggtggaccaaacataaaacaaaggacggaaagtacaagaaaaaaccctatagtggaactcgtaagtcgaaccggccgagttccaccatcctacaganacaacgccaaagaattacactgttatttagacaaatagaaacacgaccgtaggagaggacggaggacgacggccgtagtagttagtgtgcgcgagatgagtagtagacttcttagaagtagcgtaggtgttatgttaagttg

SEQ ID NO: 370662 - DNA, 564 bp, Homo sapiens
  misc_feature: GZ8MTXP01A9POS.15.67.G01.1.454.CMB.2.raw
  modified_base (383)..(383): a, c, t, g, unknown or other
  modified_base (460)..(460): a, c, t, g, unknown or other
  modified_base (510)..(510): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggccgggggggtccctgagactctcctgtgcagtctctggattcacccttagaagtatggatgacctgggtccgccaggcctccgaggggaaggggctgggagtgggtggccaaacataaaacaaaggacggaagtacgaagaaaaacctntgtggactgtagtgaacggccgattccacatcctcagagacaacgccaagaattctactgtatttgacaaatgaaangccgtgaggaggcgaggacgacggtccgtagtattattggtgcggcgagntagagtagtattacgttcttacgtaagtagcgtagggtggttatggttaattgg

SEQ ID NO: 370663 - DNA, 568 bp, Homo sapiens
  misc_feature: GZ8MTXP01BA8FO.15.67.G01.1.454.CMB.2.raw
  modified_base (304)..(304): a, c, t, g, unknown or other
  modified_base (381)..(381): a, c, t, g, unknown or other
  modified_base (504)..(504): a, c, t, g, unknown or other
  modified_base (530)..(530): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatagagttggggctgagcgtggttttccttgttgttatttagaaggtgtccagtgtgaggtgcacttggtggagtcgtggggggaggcttggtccaggccggggggggtccctgagactctcctgtgcagtctctggattcaccttagaagtattggatgacctgggtccncaggctccgaggggaaggggctgggagtgggggtcggaccaaacaataaacgaaagacggaatacaagaaaaacctntgtaggactcgtagtagaacggcattcacctatcaccagacgacaacgaccaaagaacttacactagttattgactaaataggaacagccgtaggagagggacgaggacgacgggtcgtagtnttagtgtgcgaagagatgataagtanacttcttagaagtagcgtaagggtggttatgaacgttg

SEQ ID NO: 370664 - DNA, 547 bp, Homo sapiens
  misc_feature: GZ8MTXP01A3Q27.15.67.G01.1.454.CMB.2.raw
  modified_base (489)..(489): a, c, t, g, unknown or other
  modified_base (525)..(525): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttctgttgttatttagaaggtgtcagtgtgaggtgcacttggtggagtctgggggaggcttggtccaggccgggggggtccctgagactctcctgtgcagtctctggattcacccttagaagtatggatgacctgggtccgcaggctccgaggggaaggggctgggagtggggtggccaacataaacaaagacggaagtcaagaaaaaccctatagtaggactcgtagtcgaacggccgattacaccattcaccagagacaacgccaaagaattcactgtatttagacaaatgaacagcctagagagcgaggcacggcgtagtatatgtgcgngagagtagagtagtagttacgttcttacgaagtagngtggtaggttagtgttaagttg

SEQ ID NO: 370665 - DNA, 543 bp, Homo sapiens
  misc_feature: GZ8MTXP01DLAIT.15.67.G01.1.454.CMB.2.raw
  modified_base (524)..(524): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccagccgggggggtccctgagactctcctgtgcagtctctggattcacccttagaagtattggatgacctgggtccgccaggctccaggggaaggggctgggagtggggtggccaacataaacaaagacggaaagtcagaaaaaacctatagtggactctgtgaacggccgattcaccatctccagagacaacgccaaagaattcaactgtatttgacaaaatgaaacagccgtgagagcgaggacacggccgtagtattattgtgcgcgagatgatagtagacttcttacaagtagngaaggtggttatggaattg

SEQ ID NO: 370666 - DNA, 608 bp, Homo sapiens
  misc_feature: GZ8MTXP01CJR23.15.67.G01.1.454.CMB.2.raw
  modified_base (342)..(342): a, c, t, g, unknown or other
  modified_base (380)..(380): a, c, t, g, unknown or other
  modified_base (552)..(552): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccgaggccggggggtccctgagactctcctgtgcagtctctggattcaccttagaagtatggatgacctggtccgccaggctccgaggggaggcgtgggaggtgggtcggaccaaanaataaaacgaaagacggaaagtacaaagaaaaaacctntagtaggactcgtaggtacgaaccggccgtaattcccaccatcctaccaagacgaaccgaacgacccaaagtaaacttcaacttagttaagtttagaacaaagttacgaaactacgaccgttagggaaaggacgggacggaaggaccgacggtcgttagtattagtgtgcgngagatagagtaagtagacttcgttacaagtagcgtaggtagttacgtgaagtttcg

SEQ ID NO: 370667 - DNA, 580 bp, Homo sapiens
  misc_feature: GZ8MTXP01AONUX.15.67.G01.1.454.CMB.2.raw
  modified_base (387)..(387): a, c, t, g, unknown or other
  modified_base (549)..(549): a, c, t, g, unknown or other
  modified_base (563)..(563): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggctttgggtccgaggccggggggtccctgagactctcctgtgcagtctctggattcacccttagagtatggatgacctgggtccgccaggctccgaggggaaggggctggaggtggggtggaccaaacgaataaaacgaaaggaacggaagtacaaagaaaaacctntaggtaggactcgtagtagaaccggccgaattaccaccatcctaccagagacaacggacaaagattcactgttattgacaaatagaacgtagaccgtaggagagggacgacggacgacggccgtagttattagtgtagcggtgagatgagtagagttacttnttacaaggtacggngtaggtgttatgttgtg

SEQ ID NO: 370668 - DNA, 625 bp, Homo sapiens
  misc_feature: GZ8MTXP01AD9W9.15.67.G01.1.454.CMB.2.raw
  modified_base (562)..(562): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtggggggaggcttgggtccgaggccgggggggtccctgagactctcctgtgcagtctctggattcacccttagaagtatggatgacctgggtccgcaggctccgaggggaagggctgggaggtgggtcggaccaaacaataaaacaaaggacggaaagtacaaagaaaaacctatggtaggtaactcgtaggtacgggaaccggccggtaatttccaaccctaattcctacccgaagaacgaacaaaccggaccaaagtaacttacaactgttaatttagactaaaatacggaaacacgaccgtaggaaggagggacggaaggacgacggccgtagtattagtggtgcgngagatgagtaagtacgttacttcttacgaagtgaacggtaggggtaggttatgttaacgttgg

SEQ ID NO: 370669 - DNA, 548 bp, Homo sapiens
  misc_feature: GZ8MTXP01B9TNG.15.67.G01.1.454.CMB.2.raw
  modified_base (477)..(477): a, c, t, g, unknown or other
  modified_base (492)..(492): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggccggggggtccctgagactctcctgtgcagtctctggattcacccttagaagtattggatgacctgggtccgccaggctccgaggggaaggggctgggagtggggtggaccaaacataaacaaagacggaaagtcaagaaaaacctatgtggactctgtagaacggccgattcaccatctccagagacaacgccaagaattcactgtatttgacaaatgaacagccgtagagaggacgaggacncgggccgtgtacttntagtgcgcgagatgagtagtaagcttcttacgaagtagcgaggtggttatgaattg

SEQ ID NO: 370670 - DNA, 542 bp, Homo sapiens
  misc_feature: GZ8MTXP01BM5D5.15.67.G01.1.454.CMB.2.raw
  modified_base (492)..(492): a, c, t, g, unknown or other
  modified_base (524)..(524): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccggggggggtccctgagactctcctgtgcagtctctggattcacccttagaagtattggatgacctgggtccgccaggctccgaggggaggggctgggagtgggtggccaacataaacaaagacggaagtcaagaaaaacctatgtaggactctgtgaacggcgattcaccatctccagagacaacgccaaagaattcactgtattgacaaatgaacagccgtgacgaggcgaggacacggccgtgtattatggtgcgngagatgagtacgtagacttcacaaggtgaacngggtgttatgttaagttg

SEQ ID NO: 370671 - DNA, 551 bp, Homo sapiens
  misc_feature: GZ8MTXP01AJGDY.15.67.G01.1.454.CMB.2.raw
  modified_base (347)..(347): a, c, t, g, unknown or other
  modified_base (378)..(378): a, c, t, g, unknown or other
  modified_base (411)..(411): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacttggtggagtcgtggggggaggcttggtccgaggccgggggggtccctgagactctcctgtgcagtctctggattcacccttagaagtattggatgacctgggtccgccaggctccgaggggaaggggctgggagtgggtggccaanataaacaaagacggaagtcaagaaaaacctntgtggactcgtagtgaacggcgattcaccatcncagagacaacgcaagattcaactgtatttgactaaatgaacagccgtgagagggacgaggacgacggccgtagtattagttggtgcgcgagatgataggtagacttcttaacgaagtagcgagggtggttatgaatttgg

SEQ ID NO: 370672 - DNA, 541 bp, Homo sapiens
  misc_feature: GZ8MTXP01BDT8M.15.67.G01.1.454.CMB.2.raw
  modified_base (376)..(376): a, c, t, g, unknown or other
  modified_base (493)..(493): a, c, t, g, unknown or other
  modified_base (497)..(497): a, c, t, g, unknown or other
  modified_base (520)..(520): a, c, t, g, unknown or other
  modified_base (522)..(522): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggagcttgggtccaggccgggggggtccctgagactctcctgtgcagtctctggattcacccttagaagtatggatgaccgtgggtccgccgaggctccgaggggaggggcgtggagtgggtggccaacataaaacaaagacgaagtcaagaaaaacctntgtggactctagtgaacggcgattcaccatctccagagacaacgccaagattcactgtattgacaaatgaaactagcgtgaggacggacggaggacgacgcgtgtattagtgtgcgngagntgatagtagacttcagaagtagngngggtgttatgttaagttcg

SEQ ID NO: 370673 - DNA, 638 bp, Homo sapiens
  misc_feature: GZ8MTXP01AF8FU.15.67.G01.1.454.CMB.2.raw
  modified_base (596)..(596): a, c, t, g, unknown or other
  modified_base (616)..(616): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggccggggggtccctgagactctctgtgcagtctctggattcacccttagaagtatggatgacctgggtccgccgaggctccgaggggaacggggcgtgggagtggggtggaccaaacaataaaaccgaaaggaaccggaaagtacgaaagaaaaacccttagtagtagggaacctcgtaggtacggaaccgggtcccgaatttccaaccccaattcctacccaagacgaaccaaacggacccaaaggaactttacacttagttatttacgactaaaatgaaacgacgccgtaggaacggagggaccggaaggccgaacgggtccggtaggtattagttgtcgcggcgaagagtgagtaggtaanacgttcttactaaggtacgngagggttggttatgaagtttgg

SEQ ID NO: 370674 - DNA, 582 bp, Homo sapiens
  misc_feature: GZ8MTXP01D9PDM.15.67.G01.1.454.CMB.2.raw
  modified_base (412)..(412): a, c, t, g, unknown or other
  modified_base (435)..(435): a, c, t, g, unknown or other
  modified_base (450)..(450): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggcccgggggggtccctgagactctcctgtgcagtctctggattcacccttagaagtattggatgacctgggtccgccaggctccaggggaaggggctgggagtgggtggccaacataaaacaaagacggaaagtcaagaaaaacctatagtggactctgtgaacggccgattcaccatcncagacacacacaagatactactnttattgaacaaatanaacgacgtaccgtagaggacggacggaaggacgaccggcgtagttattagttgtcggcgaagagagtagttagtaaggtagttacttccttaacgtaaggttagcgtagggtagttagtaagttaagtttgg

SEQ ID NO: 370675 - DNA, 616 bp, Homo sapiens
  misc_feature: GZ8MTXP01BHR8S.15.67.G01.1.454.CMB.2.raw
  modified_base (381)..(381): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattcacccttagaagtattggatgacctgggtccgccgaggctccgaggggaaggggctgggagtgggtggaccaacaataaaacgaaagacgaagtacaagaaaaacctntagtggactcgtagtacgaacgggccgtaattccaccctatcctccgaagacgaacaaaccgaccaaagaaacttcaacttgttaatttgactaaaatcgaaacacgccgtaggaacggagggacggacggaacgaccgggtaccggttagttaagttagttgtcgccggaagagatgaagtaaggtaagacttccgttaagaaggtaagcgaagggttggttaatgttaagttg

SEQ ID NO: 370676 - DNA, 578 bp, Homo sapiens
  misc_feature: GZ8MTXP01D2JJO.15.67.G01.1.454.CMB.2.raw
  modified_base (531)..(531): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagtattggatgacctgggtccgccaggctccgaggggaagggctgggaggtgggtggaccaaacaataaaacgaaagaacgggaaagtacaaagaaaaaacctagtagtaggaactcgtaaggtagaaccggccgaattccaaccattccaccagacgaacaaacggaccaaagtaattcaactgttattgacaaaatgaaacagccgtagaaggaggcgaaggacgacggccgtagtattatgtgcgngagatgagtagtagacttcataagagcgagggtgttatgttaagttg

SEQ ID NO: 370677 - DNA, 551 bp, Homo sapiens
  misc_feature: GZ8MTXP01E0CU4.15.67.G01.1.454.CMB.2.raw
  modified_base (308)..(308): a, c, t, g, unknown or other
  modified_base (336)..(336): a, c, t, g, unknown or other
  modified_base (342)..(342): a, c, t, g, unknown or other
  modified_base (415)..(415): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggtcgttggtccgagggcccgggggggtccctgagactctcctgtgcagtctctggattcacccttagaagtatggatgactgggtccnccaggctcgagggagggctggagtgggngccaanaataaaacgaaagacggaaagtacaagaaaaacctatgtggactctagtgaacggcgattcacatctccaganacaacgaccaaagatcactgtattgacaaatacgaaacagccgtagaggaggcggaggacgacggcgtagtattgtagtgcgtgagagtgaagtagtaagacttcagtaagtagcgtaggtggttatgttaagttg

SEQ ID NO: 370678 - DNA, 540 bp, Homo sapiens
  misc_feature: GZ8MTXP01AG8L8.15.67.G01.1.454.CMB.2.raw
  modified_base (491)..(491): a, c, t, g, unknown or other
  modified_base (517)..(517): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggccgggggggtccctgagactctcctgtgcagtctctggattcacccttagaagtatggatgacctgggtccgccaggctccaggggaagggctggagtggggtggccaacataaacaaagacggaagtcaagaaaaacctatgtggactctagtgaacggccgattcaccatctcagagacaacgaccaagaattcactgtatttgacaaatgaacagccgtgagaggcgaggacacggccgtgtattagtgtgcgngagatgagtacgtagacttcttacgngtagcgaggtggttatgaagttg

SEQ ID NO: 370679 - DNA, 540 bp, Homo sapiens
  misc_feature: GZ8MTXP01DHCX7.15.67.G01.1.454.CMB.2.raw
  modified_base (413)..(413): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccagccgggggggtccctgagactctcctgtgcagtctctggattcacccttagaagtattggatgacctgggtccgccaggctccaggggaaggggctgggagtgggtggccaacataaacaaagacggaaagtcaagaaaaaacctatagtggactctgtgaacggccgattcaccatctcaganacaacgccaagaattcaactgtatttgacaaatgaaacagcctagagaggcgaggacacggccgtagtattattgtgcgcgagatgatagtagacttcttacaagtagcgaggtggttatgaagttg

SEQ ID NO: 370680 - DNA, 593 bp, Homo sapiens
  misc_feature: GZ8MTXP01DTGBM.15.67.G01.1.454.CMB.2.raw
  modified_base (540)..(540): a, c, t, g, unknown or other
  modified_base (561)..(561): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggaggtcgtggggggaggcgtttggtccgaggcccgggggggtccctgagactctcctgtgcagtctctggattcacccttagaagtattggatgacctgggtccgccgaggctccgaggggaagggctgggagtgggtcggaccaaacaataaaacgaaagacggaaagtcaagaaaaacctatgtggactctaggacgaacggccgattaccacctatcctacagagaaccaaacgccaaagaacttacaacttgttatttagactaaatgaaacagacctaggaaggaacgggcggaaggaccgacgggtccgtagtagtttagtgtcgcggngagatgaagtagtaggacttnttacaaggtagcgagggtggttatgaagtttg

SEQ ID NO: 370681 - DNA, 566 bp, Homo sapiens
  misc_feature: GZ8MTXP01BCWO2.15.67.G01.1.454.CMB.2.raw
  modified_base (511)..(511): a, c, t, g, unknown or other
  modified_base (545)..(545): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtggggggaggcttgggtccagggcccgggggggtccctgagactctcctgtgcagtctctggattcacccttagaagtattggatgacctgggtccgccaggctccgaggggaggggctggagtgggtggccaacaataaacaaagaacggaagtacaagaaaaccctatgtggactctagtgaacggccgattccaccatctaccagacgacaacgaccaaagaacttcaactgttatttagacaaaatgaacagccgtagaagaggacgaggacgaccggccgtgttatagttgtgngcgagatgagtagtagacttcttacgaagtacgngagggtggttatgttaagttg

SEQ ID NO: 370682 - DNA, 592 bp, Homo sapiens
  misc_feature: GZ8MTXP01DY012.15.67.G01.1.454.CMB.2.raw
  modified_base (536)..(536): a, c, t, g, unknown or other
  modified_base (540)..(540): a, c, t, g, unknown or other
  modified_base (544)..(544): a, c, t, g, unknown or other
  modified_base (559)..(559): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttggtccagggccgggggggtccctgagactctcctgtgcagtctctggattcacccttagaagtattggatgacctgggtccgccaggctccgaggggaaggggctgggaggtggggtcggaccaaacaataaaacgaaaaggaacggaaagtacaaagaaaaaacctgtggtaggaactcgtaggtagaaccgggcccattccaaccattccaccaagacgaacaaccgaccaaagaattcacttgttaatttgaacaaatagaaacagccgtaggaaggaggacgaggacgacggccgtagtattattgngcgngagntgatacgtagacttnttacaagtagaacgtagggtagatgttaagttg

SEQ ID NO: 370683 - DNA, 559 bp, Homo sapiens
  misc_feature: GZ8MTXP01BNR0L.15.67.G01.1.454.CMB.2.raw
  modified_base (459)..(459): a, c, t, g, unknown or other
  modified_base (508)..(508): a, c, t, g, unknown or other
  modified_base (535)..(535): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggggttttccttgttgttattttagaaggtgtccagtgtgaggtgcacttggtggagtcgtggggggaggcttggtccaggcccgggggggtccctgagactctcctgtgcagtctctggattcacccttagaagtattggatgacctgggtccgccaggctccgaggggaaggggctgggagtgggtggccaaacaataaacgaaagacggaaagtcaagaaaaacctgtgtggactctagtgaacggccgattccaccatctccaagagacaaacgccaagaattcgaactgttattgacaaatnaacagccgtgagaggcggaggacgacggcgtagtattagtgtgcgaagngatgagtagtagacttcttagaagtgngtaagggtgttagtgttaagttcg

SEQ ID NO: 370684 - DNA, 551 bp, Homo sapiens
  misc_feature: GZ8MTXP01CECL7.15.67.G01.1.454.CMB.2.raw
  modified_base (503)..(503): a, c, t, g, unknown or other
  modified_base (525)..(525): a, c, t, g, unknown or other
  modified_base (533)..(533): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcacccttagaagtatggatgacctgggtccgccaggctccgaggggaagggcgtgggagtggggtggccaaacataaacaaagacggaaagtcaagaaaaacctatagtggactcgtagtgaacggcgattcacatctacagagacacgacaagaatcactgtattgacaaatagaacagccgtagaggaggacgaggacgacggcgtaggtattagttgtgcgcgagngtgagtagtagttacttcttanaagtaggngtaggtgttagtgttgtg

SEQ ID NO: 370685 - DNA, 574 bp, Homo sapiens
  misc_feature: GZ8MTXP01DX2F3.15.67.G01.1.454.CMB.2.raw
  modified_base (344)..(344): a, c, t, g, unknown or other
  modified_base (379)..(379): a, c, t, g, unknown or other
  modified_base (415)..(415): a, c, t, g, unknown or other
  modified_base (456)..(456): a, c, t, g, unknown or other
  modified_base (459)..(459): a, c, t, g, unknown or other
  modified_base (461)..(461): a, c, t, g, unknown or other
  modified_base (464)..(464): a, c, t, g, unknown or other
  modified_base (505)..(505): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtcagtgtgaggtgcacgttggtggagtcgtggggggaggcgttgggtccaggccgggggggtccctggagactctcctgtgcagtctctggattcacccttagaagtattggatgacctgggtccgccaggctcgaggggaggctgggagtgggtcggcaaanataaaacgaaagacggaaagtcaagaaaaaacctntggtaggactcgtagtagaacgggccaattcaaccntaccaccagacgacaacgacctaagaattcatgtattgaanaananaanagacgagagagacgacgacgacgacgtagtagttagtgtgngcgagagtagttagtaagtagttacgttacttacgaagtaggtaacggtaggtaggttagtaagttgtg

SEQ ID NO: 370686 - DNA, 561 bp, Homo sapiens
  misc_feature: GZ8MTXP01CHPPW.15.67.G01.1.454.CMB.2.raw
  modified_base (347)..(347): a, c, t, g, unknown or other
  modified_base (384)..(384): a, c, t, g, unknown or other
  modified_base (513)..(513): a, c, t, g, unknown or other
  modified_base (540)..(540): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttgggtccgaggcccgggggggtccctgagactctcctgtgcagtctctggattcacccttagaagtatggatgaccgtgggtccgccgaggctccgaggggagggctggagtgggtgaccaanaataaaacgaaagacggaaagtcaaagaaaaaacctntagtggactcgtaggtacgaacggccgattcaccatctacagacacaacgcaaagaattcactgtattgacaaatgaacagccgtagaaggaggacgaggacgcggacgtgtattatggtgcggcgagntgagtagtagcgttcttacgaagtagngtagggtggttatgaagtttg

SEQ ID NO: 370687 - DNA, 564 bp, Homo sapiens
  misc_feature: GZ8MTXP01B2IYW.15.67.G01.1.454.CMB.2.raw
  modified_base (518)..(518): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggcccgggggggtccctggagactctcctgtgcagtctctggattcaccccttagaagttattggatgacctgggtccgccaggctccaggggaaggggctgggagtggggtgggccaaacataaaacgaaagacggaaagtcaagaaaaaaccctatagtggactctgtgaacggccgattcaccatctccagagacaacgccaagaaattcaactgtatttgacaaatgaaacagcctgaaggaggacgacggacacgggccgtagtattagtgtggcgcgagntgatagtagacttcgttacaaggtagcgagggtggttagtgaattg

SEQ ID NO: 370688 - DNA, 548 bp, Homo sapiens
  misc_feature: GZ8MTXP01A0S56.15.67.G01.1.454.CMB.2.raw
  modified_base (331)..(331): a, c, t, g, unknown or other
  modified_base (421)..(421): a, c, t, g, unknown or other
  modified_base (503)..(503): a, c, t, g, unknown or other
  modified_base (522)..(522): a, c, t, g, unknown or other
  modified_base (531)..(531): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcgttgggtccgaggccgggggggtccctggagactctcctgtgcagtctctggattcacccttagaagtattggatgacctgggtccgccaggctccgaggggagggcnggagtgggtggccaacataaacaaagacggaagtacaagaaaaacctatgtaggactcgtagtagaacggccgattcaccatctccaganacaacgccaagaattcactgtatttagacaaatgaaacagccgtagaggaggacgagacgacggccgtagtattatgtgcgngagatgatagtagaccttnacaagtagnagggtgttagtgcgttg

SEQ ID NO: 370689 - DNA, 546 bp, Homo sapiens
  misc_feature: GZ8MTXP01CAYSB.15.67.G01.1.454.CMB.2.raw
  modified_base (423)..(423): a, c, t, g, unknown or other
  modified_base (451)..(451): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgaggccgggggggtccctggagactctcctgtgcagtctctggattcacccttagaagtattggatgacctgggtccgccgaggctccgaggggaaggggcgtggagtggggtggccaaacaataaacgaaagacggaaagtcaagaaaaacctagtgtggactctagtagaacggccgattcacatctcaganacacgacaagatcactgtattgacaatnaacacgcgtgaggagcgaggcacggcgtgtattatggtgcggcgagatgagtagtacgaacttcagaagtagcgagggtggttaatgttaagttg

SEQ ID NO: 370690 - DNA, 588 bp, Homo sapiens
  misc_feature: GZ8MTXP01A046Z.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcgcttggtggagtcgtggggggaggcttgggtccgagggccggggggggtccctgagactctcctgtgcagtctctggattcacccttagaagtattggatgaccgtgggtccgccaggctccgaggggaaggggcgtgggaggtgggggtggacccaaacaattaaaacaaaggtaacggaaagtaccaaaggaaaaaaccctgtgtaggactcgtagtgaaccggccgattcaccatctaccagagacaacgaccaaagaacttcactgtatttgacaaatgaacagccgtgagaggacgaggacgacggcgttagtattagttcgtgcggaagagagtgagtaacgttagaccttcttacaagtagcgagggtggttatggaactttgg

SEQ ID NO: 370691 - DNA, 639 bp, Homo sapiens
  misc_feature: GZ8MTXP01DFBEL.15.67.G01.1.454.CMB.2.raw
  modified_base (302)..(302): a, c, t, g, unknown or other
  modified_base (306)..(306): a, c, t, g, unknown or other
  modified_base (309)..(309): a, c, t, g, unknown or other
tcagtctacgtagccacgaccggtgctcgatttagagtatacatattgggtttgggggggtccctgagactctcctgtgcagtctctggattcacccttagaagttattggatgacctgggtccgccaggctccagggaagggctggagtgggtggccaacataaacaaagacggaagtcaagaaaaactatgtggactctgtgaacggccgattcaccatctccagagacaacgccaagaattcactgtatttgcaaatgaacagcctgagaggcgaggacacggccgtgtattatttggngcgnganatgatagtagactactaacgagtagcgtagggtggtatgtattcgttactttagtagtagtggtacggggacggaaacgggaacgtaaggtacggtacgtaccgtactacgtacgacgaccctacccgaaccgaacggaccgtacgtccggttcccgttccccgtccggtcccgtcccgtccgtccgtccgacgacgaccgtacccgtaccgacgacgacgacgacggccggccggtcggtcgtcgtccgtcggtaacgaacgttaccgtaccgttccgtacgtacgttacgcgacggaacggcgggcggcggacggacggtcgcgtaag

SEQ ID NO: 370692 - DNA, 565 bp, Homo sapiens
  misc_feature: GZ8MTXP01AVQ8C.15.67.G01.1.454.CMB.2.raw
  modified_base (352)..(352): a, c, t, g, unknown or other
  modified_base (388)..(388): a, c, t, g, unknown or other
  modified_base (512)..(512): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtggggggaggcgttgggtccgagggcccggggggtccctgagactctcctgtgcagtctctggattcacccttagaagtatggatgacctgggtccgccaggctccgaggggaaggggctgggagtggggtggccaaanaataaaacgaaagacggaagtacaagaaaaaacctntgtggactcgagtgaacggccgattccaccatctcaagagacaacgaccaaagaattcactgttatttgactaaatgaacagccgtggagaggcgaggacacggccgttagtattagtgtgcgngagagtgagtaaggtagacttcttacaagttagcgaaggtgatgttaacgttg

SEQ ID NO: 370693 - DNA, 611 bp, Homo sapiens
  misc_feature: GZ8MTXP01A0CAE.15.67.G01.1.454.CMB.2.raw
  modified_base (348)..(348): a, c, t, g, unknown or other
  modified_base (386)..(386): a, c, t, g, unknown or other
  modified_base (508)..(508): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccggggggggtccctgagactctcctgtgcagtctctggattcacccttagaagtatggatgacctgggtccgccaggctccgaggggaaggggctgggaggtgggtggaccaaanaataaaacgaaagacggaaagtacaaagaaaaaccctntaggtcggactcgtaggtagaaccggcgaattccacctaatcctccaagagaaccaaacgaccaaagaacttacacttgttaattgacaaatgaaacacgccgtgacggaggacgacggacncgggtccgtaggttattagttggtcgcgtaacgaagttgtggaataagtacggacttacgttacgtaaggtagaacgtagggtaggttatggttaagtttcgg

SEQ ID NO: 370694 - DNA, 558 bp, Homo sapiens
  misc_feature: GZ8MTXP01ASRH5.15.67.G01.1.454.CMB.2.raw
  modified_base (507)..(507): a, c, t, g, unknown or other
  modified_base (523)..(523): a, c, t, g, unknown or other
  modified_base (534)..(534): a, c, t, g, unknown or other
  modified_base (540)..(540): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagtattggatgacctgggtcccgccaggctccgaggggaaggggctgggagtgggtggccaaacataaacgaaagacggaagtacaagaaaaacctatgtggactcgtagtgaacggcgattcaccatcctcagacacaacgccaagaattcactgtatttgactaaatgaaacacgccgtaggaggaggcggaaggacgacggtccgtagtattagtgtgcgngagagtgagtaggtanacgttcaacgngtacgngagggtgttatgaatttg

SEQ ID NO: 370695 - DNA, 592 bp, Homo sapiens
  misc_feature: GZ8MTXP01CEU7P.15.67.G01.1.454.CMB.2.raw
  modified_base (538)..(538): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtccctgagactctcctgtgcagtctctggattcacccttagaagtattggatgacctgggtcccgccaggctccgaggggaaggggctgggagtgggtggccaaacaataaaacgaaagaacggaaagtacaaagaaaaaaccctagtagtaggactcgtagtagaaccggcgaattccaccatcctaccagacgacaacgaccaaagaacttcaacttgttatttagactaaatagaaacacgaccgtaggaagagggacggaaggaccgaacgggtccgtagtaattagtgtgcgngagatgagtaagtagacttcgttaacaagtagcgtagggtgttagtgaagtttg

SEQ ID NO: 370696 - DNA, 665 bp, Homo sapiens
  misc_feature: GZ8MTXP01C9146.15.67.G01.1.454.CMB.2.raw
  modified_base (548)..(548): a, c, t, g, unknown or other
  modified_base (628)..(628): a, c, t, g, unknown or other
  modified_base (638)..(638): a, c, t, g, unknown or other
  modified_base (646)..(646): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttccttgttgttattttagaaggtgtccagtgtgaggtgcacgttggtggaggtcgtgggggaggtcgttgggtccgagggcccgggggggtccctggacgactctcctgtgcagtctctggtattccacccttagtaagttattggatcgaccgtgggtcccgccaggctaccgagggggaaggggcgtggggaggttgggggtacggaccaaaacgaaactaaaacgaaaaggaaccgggaaacgtacgaaaacggaaaaaaaccctagtagtggtaactcgtaaggttacggaaccgggcgtaactttaccaaccctactaccgtacaaggaacgaaacaaaccggaccaaagtaacttacaacttgtttaatttcgaacttaaaacncgaaaacgacgacctaggacggaaggcgaaggaaccgacggtccgttagtattagtggtgcgaagagatgaatacggtanacgttcttanaagtaggngtaggtgttatgttaagtg

SEQ ID NO: 370697 - DNA, 552 bp, Homo sapiens
  misc_feature: GZ8MTXP01D8JR5.15.67.G01.1.454.CMB.2.raw
  modified_base (422)..(422): a, c, t, g, unknown or other
  modified_base (546)..(546): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcacccttagaagtattggatgacctgggtccgccaggctccgaggggaaggggctgggaggtgggtggccaaacataaacaaagacggaaagtacaagaaaaacctatgtaggactctgtagaacgggccgattcaccatctccaganacaacgccaagattcactgtatttgacaaatgaaacagccgtagacggaggacgaggacgacggccgtagtattattgtgcgcgagatgatagtagacttcttacaagtagctgggtgttatgngttcgg

SEQ ID NO: 370698 - DNA, 583 bp, Homo sapiens
  misc_feature: GZ8MTXP01CWU4G.15.67.G01.1.454.CMB.2.raw
  modified_base (529)..(529): a, c, t, g, unknown or other
  modified_base (534)..(534): a, c, t, g, unknown or other
  modified_base (563)..(563): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactgaccatggagttggggctgagctgggttttccttgttgttattttagaaggtgtccagtgtgaggtgcacttggtggagtcgtggggggaggcgtttggtccgaggccgggggggtccctggagactctcctgtgcagtctctggatcacccttagaatatggatgactgggtccgccgaggctccgaggggaagggcgtggagtgggtggccaaacaaataaaacgaaaagaacggaaagtacaaagaaaaaacctagtagtggaactcgtaaggtcgaacggccgaattaccaccatcctaccaagacgaacaacggacaaagaattacaactgtatttgacaaatagaacagaccgtagaggaagacgaggacgacggcgtagtattagttgtgcgngaagntagagtaagtagaacgttcttacaagagngaggtgttagtgaagtttgg

SEQ ID NO: 370699 - DNA, 577 bp, Homo sapiens
  misc_feature: GZ8MTXP01BV94V.15.67.G01.1.454.CMB.2.raw
  modified_base (387)..(387): a, c, t, g, unknown or other
  modified_base (554)..(554): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtggggggaggcgtttgggtccgagggcccgggggggtccctggagactctcctgtgcagtctctggattcacccttagaagttattggatgacctgggtccgccaggctccgaggggaagggctgggagtgggtggccaacaataaacgaaagacggaagtacaaagaaaacctntgtggactgtagtagaacggccgattcaccatctaccagagacaacgaccaagattcaactgtattgacaaatgaacagccgtagaaggaggcggaaggaccgacgggccgtagttattagttggtagcgaacggagagtagagtagtaggacttcttacaagtagngtaggtgttagtgttaacgtttg

SEQ ID NO: 370700 - DNA, 587 bp, Homo sapiens
  misc_feature: GZ8MTXP01ALAQ7.15.67.G01.1.454.CMB.2.raw
  modified_base (377)..(377): a, c, t, g, unknown or other
  modified_base (410)..(410): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctctgtgcagtctctggattcacccttagaagtattggatgacctgggtccgcaggctccgaggggaggggctgggaggtgggtggccaacaataaaacaaagacggaagtacaagaaaaacctntgtaggactctagtagaacggcgattcacatcnccagagacaacgcaagaatcactgtatttgataaatagaacagaccgtaggaaggaggacggaaggaccgacggaccggttagtatttaagttggttcggcgaacgagatagagttaacggtaagttaccttacgttaccgaagggtagcgtagggtaggttagtggttaagtttgg

SEQ ID NO: 370701 - DNA, 595 bp, Homo sapiens
  misc_feature: GZ8MTXP01CQ6KQ.15.67.G01.1.454.CMB.2.raw
  modified_base (546)..(546): a, c, t, g, unknown or other
  modified_base (576)..(576): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtccctgagactctcctgtgcagtctctggattcacccttagaagtatggatgaccgtggtccgccaggctccgaggggaaggggcgtgggaggtgggtcggaccaaacaaataaaaccgaaaaggaacgggaaagtacgaaaagtaaaaaaccctagtaggtaggactcgtaagtacggaaccgggcctaattccacatctccaagagaacaacgacaaagaatacattagtattgacaaatgaaacacgccgtagaaggaggacggaagaccgacggtccgtagttattagttggcgcgaagagntagagtagtacttacttcttacgaagtagngtaggtagttagtgttgtg

SEQ ID NO: 370702 - DNA, 601 bp, Homo sapiens
  misc_feature: GZ8MTXP01E1X9L.15.67.G01.1.454.CMB.2.raw
  modified_base (452)..(452): a, c, t, g, unknown or other
  modified_base (541)..(541): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgtttattttagaaggtgtccagtgtgaggtgcacttggtggaggttcggtggggggaggtcgttgggtccgagggccgggggggtccctgagactctcctgtgcagtctctggattcacccttagaagttattggatgacctgggtccgccaggctccgaggggaaggggctggaggtgggtggaccaaacaattaaaacgaaagaaccggaagtaccaaagaaaaaacccgtatggtaggaactcgtaggttacgaacggccgaatttcacccatcctacaganaacaacgaccaaagaacttcaacttgttatttgacaaataggaacagccgtagaggaggagaggacgacggccgtagtagttattgggngcgaagagatgagtaagtacgacttcgttacgtaagtagtggtaggtgttatgttaagtg

SEQ ID NO: 370703 - DNA, 564 bp, Homo sapiens
  misc_feature: GZ8MTXP01DPHV2.15.67.G01.1.454.CMB.2.raw
  modified_base (423)..(423): a, c, t, g, unknown or other
  modified_base (513)..(513): a, c, t, g, unknown or other
  modified_base (517)..(517): a, c, t, g, unknown or other
  modified_base (532)..(532): a, c, t, g, unknown or other
  modified_base (543)..(543): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggaggtcgtggggggaggcgttggtccgaggcccggggggggtccctggagactctcctgtgcagtctctggattcacccttagaagtatggatgacctgggtccgccaggctccgaggggaaggggctgggagtgggtggccaacaataaacaaagacggaagtacaagaaaaacctatgtggactctagtgaaccggcgattcaccatctccaganacaacgaccaagaattacactgtatttgacaaatgaaacagccgtagaagggaggcggaagggacacgggccgtagtattattggtgcgngagntgagtagtagacttnttacgaagtgngtaggtgttatgttaagttcg

SEQ ID NO: 370704 - DNA, 505 bp, Homo sapiens
  misc_feature: GZ8MTXP01CRY36.15.67.G01.1.454.CMB.2.raw
  modified_base (258)..(258): a, c, t, g, unknown or other
  modified_base (291)..(291): a, c, t, g, unknown or other
  modified_base (296)..(296): a, c, t, g, unknown or other
  modified_base (304)..(304): a, c, t, g, unknown or other
  modified_base (307)..(308): a, c, t, g, unknown or other
  modified_base (310)..(310): a, c, t, g, unknown or other
  modified_base (312)..(312): a, c, t, g, unknown or other
  modified_base (314)..(314): a, c, t, g, unknown or other
  modified_base (318)..(318): a, c, t, g, unknown or other
  modified_base (320)..(320): a, c, t, g, unknown or other
  modified_base (323)..(323): a, c, t, g, unknown or other
  modified_base (329)..(329): a, c, t, g, unknown or other
  modified_base (331)..(331): a, c, t, g, unknown or other
  modified_base (333)..(333): a, c, t, g, unknown or other
  modified_base (338)..(338): a, c, t, g, unknown or other
  modified_base (340)..(340): a, c, t, g, unknown or other
  modified_base (342)..(342): a, c, t, g, unknown or other
  modified_base (352)..(352): a, c, t, g, unknown or other
  modified_base (357)..(358): a, c, t, g, unknown or other
  modified_base (363)..(363): a, c, t, g, unknown or other
  modified_base (365)..(365): a, c, t, g, unknown or other
  modified_base (373)..(373): a, c, t, g, unknown or other
  modified_base (377)..(377): a, c, t, g, unknown or other
  modified_base (385)..(385): a, c, t, g, unknown or other
  modified_base (387)..(387): a, c, t, g, unknown or other
  modified_base (389)..(389): a, c, t, g, unknown or other
  modified_base (391)..(391): a, c, t, g, unknown or other
  modified_base (393)..(393): a, c, t, g, unknown or other
  modified_base (435)..(435): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttcgtgtagtatttagaagtgtcagtgtgagtgcattggtggagtcgtgggggagtcgttggtccgaggccgggggggtccctgagctctctgtgcagtctntggattcaccttagagtatggatgacgtggccncagcncgaggggnggnngngngnacananaanagaganananaacangngntgagagcgcntcacnncacananacacacanatanatatatanananananagacgagagagacgacgacgacgtacgtagtagtagtgtcgngaagagagtagttagtaagtacgttacgttacttacgtaagtagaaggtaggtaggttagtaagttgttg

SEQ ID NO: 370705 - DNA, 679 bp, Homo sapiens
  misc_feature: GZ8MTXP01A808E.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgagggcccggggggtccctgagactctcctgtgcagtctctggattcacccttagaagttattggatgacctcgggtccgccgaggctccgaggggaaggggcgtggggagtggggtggacccaaacgaataaaacgaaaggaaccgggaaagtacaaaggaaaaaaccctagtaggtaggaacttccgtagttcggaaccgggccgtaattaccaccaatcctacccgaaagacgaaccgaaaccgacccaaaagtaacttacaaccgtttggttaattttcgaactaaaaagttcgaaaacgacggaccccgttagggaacggaaggggccggaagggaacccgaaccgggtcccgttaggtaatttaagttggttcggcggaacgtaagatggttaaattaggtagttaccttcttacgaagtagctagggtgttagtgttaacgttg

SEQ ID NO: 370706 - DNA, 667 bp, Homo sapiens
  misc_feature: GZ8MTXP01EF5UF.15.67.G01.1.454.CMB.2.raw
  modified_base (336)..(336): a, c, t, g, unknown or other
  modified_base (343)..(343): a, c, t, g, unknown or other
  modified_base (350)..(350): a, c, t, g, unknown or other
  modified_base (374)..(374): a, c, t, g, unknown or other
  modified_base (377)..(377): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggtcgttggtccgaggcccggggggtccctggagactctcctgtgcagtctctggtattcacccttagaagtatggatgacctgggtccgcaggctcgaggggaggctggagtggngaccaanaataaanaagacgaagtacaagaaaaacctntgngactcgtagtagaacggccgtaattccaaccatccctacgaagaacgaacaaaccgacccgaaaagtaactttactaaacctttagttaagttttacggaacctaaaagttaggaaaaccgtacggacccggttaggaaagggaaggggaccgaagggaaccgtaaccggggtaccgttaggttaatttagttggtcggccggaacgtaagggttattaggttaagtaaggtaacgaaccttcgttaacgtaaggtacgaacgtagggtaggttagtaagttaacgtttg

SEQ ID NO: 370707 - DNA, 607 bp, Homo sapiens
  misc_feature: GZ8MTXP01EBXAU.15.67.G01.1.454.CMB.2.raw
  modified_base (289)..(289): a, c, t, g, unknown or other
  modified_base (346)..(346): a, c, t, g, unknown or other
  modified_base (542)..(542): a, c, t, g, unknown or other
  modified_base (572)..(572): a, c, t, g, unknown or other
tcagtctacgtagccacgaccggtgctcgatttagagtatacatattgggtttggggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtgggggaggcttggtccgaggccgggggggtccctgagactctcctgtgcagtctctggattccaccttagaagttntggatgaccgtgggtccgccaggctccgaggggaggggctggaggtgggtgaccaanaataaaacaaaggaggaagtacaaagaaaaactgtaggtaggactcgtgtacgaacgggccgtattccactatctaccgagacgacaacgaccaaagaattcactgtttattagacaaattagaacagccgtaggggaggaacggggccggaagggaaccaccggggtccgttagttaagtttacgttggtagcgngaatgttagaattacgagtattaccgttanaggtaagagtaaggttggtattgtaacttggtttg

SEQ ID NO: 370708 - DNA, 555 bp, Homo sapiens
  misc_feature: GZ8MTXP01BGNWT.15.67.G01.1.454.CMB.2.raw
  modified_base (530)..(530): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggcccggggggggtccctgagactctcctgtgcagtctctggattcacccttagaagttattggatgacctgggtccgccaggctccgaggggaggggctggagtgggtggccaacataaacaaagacggaagtacaagaaaaacctatgtggactcgtagtgaacggccgaattcaccatctccagagacaacgacaagaattcactgttatttgacaaatgaaacagccgtagacggaggacggaggacgacggccgttagtattagttgtgcgcgagatgagtagtagacttcttanaagtagcgaggtggttatggaattg

SEQ ID NO: 370709 - DNA, 545 bp, Homo sapiens
  misc_feature: GZ8MTXP01EU0YQ.15.67.G01.1.454.CMB.2.raw
  modified_base (498)..(498): a, c, t, g, unknown or other
  modified_base (524)..(524): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagtatggatgacctgggtccgccaggctccgaggggaagggctggagtgggtggccaacataaaacgaaagacggaaagtacaagaaaaacctatagtggactctagtgaacggccgattcaccatctccagagaacaacgcaagaattcaactgtattgacaaatgaacagccgtgagaggcgaggacacggccgtgtattattgtgcgcgagntgagttagagacttcttacaagtagngagggtgttatgttaagttcg

SEQ ID NO: 370710 - DNA, 547 bp, Homo sapiens
  misc_feature: GZ8MTXP01DCQTD.15.67.G01.1.454.CMB.2.raw
  modified_base (304)..(304): a, c, t, g, unknown or other
  modified_base (342)..(342): a, c, t, g, unknown or other
  modified_base (418)..(418): a, c, t, g, unknown or other
  modified_base (451)..(451): a, c, t, g, unknown or other
  modified_base (492)..(492): a, c, t, g, unknown or other
  modified_base (512)..(512): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctggagactctcctgtgcagtctctggattcacccttagaagtatggatgacctggtccncaggctccgaggggagggctggagtgggtggaccaaanaataaaacaaagacgaaagtacaaagaaaaaacctgtagtggactcgtagtagaacggccgatcaccatcacaganacaacgacaagaattcaactgtattgacaaatnaacagcgtgagagcgagcgacggcgtagtattagtgtgcgngagatgaagtagtagacttnaacgtaagtagcgtagggtgttagtgttaagttcg

SEQ ID NO: 370711 - DNA, 730 bp, Homo sapiens
  misc_feature: GZ8MTXP01AGE3E.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttccttgttgttattttagaaggtgtccagtgtgaggtgcacttggtggagtcgtgggggaggtcttggtccgaggcccggggggtccctgagacctctcctgtgctagtctcgtggtacttccacccttaagaagttagttaggatcgaccgtgggtccccgccgaggcctcccggagggggaacggggtcgtagggaggtggggtacgggacccaaacgaagtaaaaaaccgaaaggaaccggaaagttaccgaaaaggtaaaaaaccccttgtggtaggaaccttcgtagggtacggaaccgggtcccgtactttccaaccctattccgtaccaagaacgaaccgaaaccgacctaaaaggtaacttacgaacgttagttaattttaggactaaaatacggaaaccacggtaccgtaggaagggacgggacccggaagggaaccgacgggtacccggttagttaagtttgttgtacggcgaacggaagagtagagttaaggttaacgacgttcccgttaacgtaaggtagtaaccggtaagggttaggttaagtaagttgtttaaccggg

SEQ ID NO: 370712 - DNA, 664 bp, Homo sapiens
  misc_feature: GZ8MTXP01CZ4LO.15.67.G01.1.454.CMB.2.raw
  modified_base (620)..(620): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttccttgttgttattttagaaggtgtccagtgtgaggtgcacgttggtggagtcgtgggggaggcttggtccaggccggggggtccctgagactctcctgtgcagtctctggattcacccttagaagtattggatgaccgtgggtcccgccgaggcctccggaggggaagggcgtgggaggtggggtcggacccaaacgaactaaaacgaaaaggtaaccggaaagtacaaagtaaaaaaccctagtagtaggaccttcgtaagggtacgaaccgggaccgtaactttccaaccctatcctaccaagacgaacaaaccgaccaaagtaattacgaacttagttaatttagaactaaaagtagaaacacggaccgttaggaaggaacgggacggaacgggaccgaaccgggccgttaggttaagttagtttggcggcggtcggaagttatggaattaagggtanaacttcttaacgaaggtagcgtagggtggttattcgggaatttg

SEQ ID NO: 370713 - DNA, 555 bp, Homo sapiens
  misc_feature: GZ8MTXP01CPPI8.15.67.G01.1.454.CMB.2.raw
  modified_base (481)..(481): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggccggggggggtccctgagactctcctgtgcagtctctggattcacccttagaagtattggatgacctgggtccgccaggctccgaggggaaggggctgggagtgggtggccaaacaataaacgaaagacggaaagtcaagaaaaaacctatgtggactcgtagtgaacggccgattcaccatctaccagacgacaacgcaagaattcactgtattgacaaatagaacagccgtgagaggcgaggacncggcgtgtattagtgtgcgcgagagtagagtaagtagacttcttacgtaagtagcgagggtggttatgaagttg

SEQ ID NO: 370714 - DNA, 570 bp, Homo sapiens
  misc_feature: GZ8MTXP01BB5E3.15.67.G01.1.454.CMB.2.raw
  modified_base (374)..(374): a, c, t, g, unknown or other
  modified_base (413)..(413): a, c, t, g, unknown or other
  modified_base (511)..(511): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccgaggcccggggggggtccctgagactctcctgtgcagtctctggattcacccttagaagtattggatgacctgggtccgccaggctcgaggggagggctggagtgggtgccaacataaacaaagacggaagtacaagaaaacctntagtggactctagtgaacggcgattcaccatctacaganacaacgaccaagaattcactattattagacaaatgaaactacgaccgtaggaaggaggacggaaggaccgaacgggccgtagtattagttggtgcggngagagtagagtagtacgacgttcacgtaagtacgtgtagggtggttagtgttaagtttg

SEQ ID NO: 370715 - DNA, 641 bp, Homo sapiens
  misc_feature: GZ8MTXP01DDMF5.15.67.G01.1.454.CMB.2.raw
  modified_base (345)..(345): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccgaggccgggggggtccctgagactctcctgtgcagtctctggattcacccttagaagtattggatgaccgtgggtccgccgaggctccgaggggagggcgtggagtgggcgaccaaanaataaacgaaagacggaagtcaaagaaaaaacctgtagtaggaactcgtaggtacgaacggcccgtattacccacctatcctaccaagaacgaaccaaaccggaccaaagtaactttaccgaactttagttaatttagacaaaagtacgaaacgtacgaccgttaggaaggacgggacggaaacgggaacccgtacgggtccgttaggttaatttaggttgtcgccggaagaaggttatagttaagtaagtaacgacttcgaacgtgtagcgtaggggtaggttatggaatttcgg

SEQ ID NO: 370716 - DNA, 702 bp, Homo sapiens
  misc_feature: GZ8MTXP01D4XPJ.15.67.G01.1.454.CMB.2.raw
  modified_base (614)..(614): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggaggtcgtggggggaggcgttggtccgaggccggggggtccctggagactctcctgtgcgtagtctcgtgtactactaccgtagtagtagtgatcgtacgtcgggtccgcgacggccgtacggaggggaggtcgtagggtaggtgggtacggaaccaaacgtaaaacgtaaaacgaaaggaaccggtaaagtaacgaaaaaacgtaaaaaccgttagtggtaacggtacctcggtaaggtaacgaacccgggctaacttccaacctatccacgaacgacgaaccaaccgacaaagtactacgtattagttattacgaattaaagacgaaacgacgtacgtaaggaacgggaacgggacggaacgggaaccgtacggggtaccgtttaagtttagtttaagttgcgggnggaacggtattaggtacgaaaggttaaggtaacttaccgttacttaacggtaagtacgaacggtagggtaggttatcgttaagtttgg

SEQ ID NO: 370717 - DNA, 564 bp, Homo sapiens
  misc_feature: GZ8MTXP01BFIVW.15.67.G01.1.454.CMB.2.raw
  modified_base (546)..(546): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggcccgggggggtccctgagactctcctgtgcagtctctggattcacccttagaagtattggatgacctgggtcccgccaggctccgaggggaaggggcgtgggaggtgggtggccaaacataaacgaaagacggaagtacaagaaaaacctatagtggactcgtagtacgaacggccgattccacctatctacagagacaacgaccaagaattcactgtatttgactaaatgaacacgccgtgaggaggacgaaggcgacggcgtgtattagtgtcgtcggcgagagtgagtagtagacttcttacgaagtacgngaggtggttatgaagttg

SEQ ID NO: 370718 - DNA, 583 bp, Homo sapiens
  misc_feature: GZ8MTXP01AMC47.15.67.G01.1.454.CMB.2.raw
  modified_base (383)..(383): a, c, t, g, unknown or other
  modified_base (532)..(532): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccgaggccgggggggtccctgagactctcctgtgcagtctctggattcacccttagaagtatggatgacctgggtccgccaggctccgaggggaaggggctgggaggtgggtggaccaaagaataaaacgaaagacggaagtacaagaaaaacctntgtggactcgtagtagaacggccgaattccacctaatcctaccaagacgaacaacggtaccaaagtaacttcgaacttgttaatttgacaaaatgaaacagaccgtaggaggaggacgaggaccgacgggccgtgtattagttgtgcgngaggatgagtagtagacttcttacgaagtagcgtagggtgttatgaagttg

SEQ ID NO: 370719 - DNA, 857 bp, Homo sapiens
  misc_feature: GZ8MTXP01BFCVH.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtcctgagactctcctgtgcagtctctggattcacccttagaagttattggatgaccgtgggtcccgccgaggcctccgaggggaaggggcgtgggaggtgggtggaccaaacaataaaaccgaaaaggaacggaaagtacgaaagtaaaaaaccctataggtaggtaacctccgtaggttacgggaaccgggtcccggtaacgtttaccaacccctaattcccgtaccccgaaaggaacgaaacccgaaaccggaccccaaaaggtaaactttacctaaaccgtttaggtttaattttaacgggaactaaaaaacgttacgaaaacccgaacgggtaccccggttaaggggaaacggggaaacggggacccggggaaacgggggaaccccggtaacccgggggtaccccgggtttaagggtttaaacgtttttaaacggttttacggggtttagggccccggggtaacgggtaaacgggttaaaggttaacgggttaaacgtttaaagggggttaacttaaacccgggtttaccttaaacccgggttaagggtaaacgggtaaccgggtaagggggtttagggggtttaacgttaacgggttaaacgtttttcggggg

SEQ ID NO: 370720 - DNA, 544 bp, Homo sapiens
  misc_feature: GZ8MTXP01CMDDS.15.67.G01.1.454.CMB.2.raw
  modified_base (442)..(442): a, c, t, g, unknown or other
  modified_base (478)..(478): a, c, t, g, unknown or other
  modified_base (528)..(528): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctgagactctcctgtgcagtctctggattcacccttagaagtattggatgacctgggtccgccaggctccgaggggaaggggctgggacgtgggtggccaacaataaaacgaaagacggaaagtcaagaaaaaacctatgtggactctagtgaacggccgattccaccatctccagagacaacgccaagattcactntatttgcaaatgaacagccgtgagaggacgaggacncggccgtgtattattgtagcgcgagatgataagtgacttcacaagtacgngaggttggatgaattg

SEQ ID NO: 370721 - DNA, 612 bp, Homo sapiens
  misc_feature: GZ8MTXP01B624N.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtgggagtcgtggggggaggcttgggtccaggcccggggggggtccctggagactctcctgtgcagtctctggattcacccttagaagttattggatgaccgtgggtcccgccgaggctccgaggggaggggctggaggtgggtggaccaaacaataaaacgaaaaggacggaaagtacaaagtaaaaaaccctagtaggtagggactcgtaggtacgaaccgggccgaatttcccacctatcctaccgaagaacgaacaaaccggaccaaagtaacttcaacttgttatttgacaaatagaacagccgtagaggagacggagacgcggcgtagtattagtgtcgcggcgagttagtgagttagtagacgttcttacaaggtagcgagggtggttatggttaagtttcgg

SEQ ID NO: 370722 - DNA, 749 bp, Homo sapiens
  misc_feature: GZ8MTXP01BWFFC.15.67.G01.1.454.CMB.2.raw
  modified_base (303)..(303): a, c, t, g, unknown or other
  modified_base (339)..(339): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcgttggtccaggccgggggggtccctgagactctcctgtgcagtctctggattcacccttagaagtatggatgacctgggtccnccaggctccgaggggagggctggagtgggtgccaanataaacaaaggacgaagtacaagaaaaacctatgtaggactcgtaagtacgaacgggccgaattaccaaccctatcctacccgaagacgaaaccaaaccgacccgaaagtaaactttacaaccgttaggtttaatttacggaacctaaaagttacgaaaacgaacggtacccggttaggaaacggaacggggaccgggaaacgggaaccccgaaccgggggtacccggtttaaggtttaaacgttttaaggttttcgggtacgggtacccgggaacgggtaaaggttaaggtttaagggttaaacgtttaaagggttaaacgggaacccgtttaccgttaaaccggttaaggggtttaagaaccgggtaaggggttacggggtttaagtttgggttaaacggtttttggg

SEQ ID NO: 370723 - DNA, 643 bp, Homo sapiens
  misc_feature: GZ8MTXP01BSE9L.15.67.G01.1.454.CMB.2.raw
  modified_base (606)..(606): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgtttatttagaaggtgtccagtgtgaggtgctacgttggtggagtcgtgggggaggcgttggtccgagggcccggggggtccctgagacctctcctgtgcagtctcgtggtattccacccttagtaagttattggatgaccgtgggtccgccgaggctccgagggggagggcgtgggaggtgggtggccaaacaataaaacgaaagacggaagtacaagaaaaaacctatagtggactcgtaggtacgaacgggccgtacttccaaccattcctacgaacgacgaacaaaccggaccaaagtaacttcgaacttaggtttaactttgaacctaaatagaaacgacgaccgtaggaagggaggacggaacggaccgacgggtccgtaggttattagttcgtaggccgaagagttagtagttagtagtagaccttcgttanaaggttagcgtagggttaggttagtgttaagtttcgg

SEQ ID NO: 370724 - DNA, 617 bp, Homo sapiens
  misc_feature: GZ8MTXP01BGXVA.15.67.G01.1.454.CMB.2.raw
  modified_base (270)..(270): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttatttagaaggtgtccagtgtgaggtgcacttggtggagtcgtgggggaggcttgggtccgaggcccgggggggtccctgagactctcctgtgcagtctcnggattcaccttagaagtatggatgaccgtgggtccgccaggctaccgagggggaaggggcgtgggaggtgggggtggaccaaacgaataaaacgaaaggacggaaagtacaaaggaaaaaccctagtgtaggacctcgtagtacggaaccggccgtaacttccacctactcctaccagaacgacaaacgaccaaagtacttcacttgttatttcgaactaaatggaacagaccgtaggacggaggacggaggaccgacggccgtagtacttagttggtcgcgaagagagtagagtaacgtagttacgttcttagaagtagaagtagggtggttactgggttaattgg

SEQ ID NO: 370725 - DNA, 711 bp, Homo sapiens
  misc_feature: GZ8MTXP01C5ELE.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgtttattttagaaggtgtccagtgtgaggtgctacgttggtggagtagtgggggaggcgttgggtccgagggcccggggggtccctgacgactctcctgtcgctagtctcgtggtacttcctacccgttagtaagttattggatcggaccgttgggtccccgccgaggccgtaccggagggggaaggggtcgtggggaaggtggggtacggaccaaaacgaaagtaaaaacgaaaaggaacggaaagtacaaaagaaaaaaccttgtaggtggaacctcgtaaggtacgaaccggccgtaacttaccgaaccacttcctaccgaagaacgaaccgaaaccggaccaaaagtaactttaccgaacgttaggtttatttacgaactaaaagtcgaaaactcggaccgtaggaaggaacggacggaacggaaccgtaccgggccgttaggttatttagttgcgtcgaagtaagacgtagttaagttaaggtagttaccgttcgttaacgaaggttaaggcggttagggttgttagttggttaagttg

SEQ ID NO: 370726 - DNA, 552 bp, Homo sapiens
  misc_feature: GZ8MTXP01DNXQH.15.67.G01.1.454.CMB.2.raw
  modified_base (527)..(527): a, c, t, g, unknown or other
  modified_base (532)..(532): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattcacccttagaagtatggatgacctgggtccgcaggctccgaggggaagggctgggagtggggtggaccaacaataaaacaaagacggaaagtcaagaaaaaacctatagtggactctagtagaacggccgattcaccatctccagagacaacgccaagaattcactgtatttgacaaatgaaacagccgtgaggaggcgaggacacggcgtagtattattgtgcgaagagatagataaggagacttcgttaacngtagngtagggtggttatgaagttg

SEQ ID NO: 370727 - DNA, 562 bp, Homo sapiens
  misc_feature: GZ8MTXP01ADSXU.15.67.G01.1.454.CMB.2.raw
  modified_base (309)..(309): a, c, t, g, unknown or other
  modified_base (347)..(347): a, c, t, g, unknown or other
  modified_base (409)..(409): a, c, t, g, unknown or other
  modified_base (412)..(412): a, c, t, g, unknown or other
  modified_base (417)..(417): a, c, t, g, unknown or other
  modified_base (524)..(524): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgtttattttagaaggtgtccagtgtgaggtgcacttggtggagtcgtggggggaggcttgggtccgaggccgggggggtccctgagactctcctgtgcagtctctggattcacccttagaagttatggatgacctgggtccncaggctccgaggggaagggctggagtgggtggaccaanaataaacgaaagacggaagtcaaagaaaaacctatgtggactctagtgaacggcgattcacntcncaganacacgcaagattcactgtattgacaatagaacagccgtaggaaggaggacgaaggacacggccgtagtaattagttggtgcgtcgaagttagtggaagtaagggtanacttcaacgtaaggtagcgtagggtgttatggaattgg

SEQ ID NO: 370728 - DNA, 619 bp, Homo sapiens
  misc_feature: GZ8MTXP01A47QU.15.67.G01.1.454.CMB.2.raw
  modified_base (562)..(562): a, c, t, g, unknown or other
  modified_base (569)..(569): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttatttagaaggtgtccagtgtgaggtgcacttggtggagtcgtgggggaggcgttggtccgagggcccgggggggtccctggacgactctcctgtgcagtctctggattcacccttagaagtatggatgaccgtgggtccgccgaggcgtccgaggggagggcgtggaggtgggtggaccaaacaagtaaaaccgaaaaggaccggaaagtacgaaagtaaaaaacctgtagtgggacctcgtaggtaggaaccgggcccgaattccaacccatccctaccaaggacaacgaaaccgaccaaagtaaattcaacttgttatttagacaaaagtcgaaacagaccgtaggaggaagggccggaaggaccgaacggccgttaggtattagtgtgcgnggtaagntagagttaggtagacttcttagaagtgcgtagggtgttagtgttaagttg

SEQ ID NO: 370729 - DNA, 581 bp, Homo sapiens
  misc_feature: GZ8MTXP01BQILO.15.67.G01.1.454.CMB.2.raw
  modified_base (306)..(306): a, c, t, g, unknown or other
  modified_base (345)..(345): a, c, t, g, unknown or other
  modified_base (377)..(377): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggagcttggtccagggcccgggggggtccctgagactctcctgtgcagtctctggattcacccttagaagtattggatgacctgggtccnccaggctccgaggggaggggctgggagtgggtggccaanataaacgaaagacggaagtacaagaaaacctntagtggactcgtagtcgaacggccgattccacctatcctccgaagacgaaccaacggaccaaagaattcacttagttatttggactaaagtgaaacagccgtagaggaggccgaggaccgacggcgtgttattagtggtgcgcgagatgaataggtacgacttcgttaacgaaggtagcgtaggggtgttagtgttaagtttgg

SEQ ID NO: 370730 - DNA, 552 bp, Homo sapiens
  misc_feature: GZ8MTXP01C7LRC.15.67.G01.1.454.CMB.2.raw
  modified_base (503)..(503): a, c, t, g, unknown or other
  modified_base (526)..(526): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcgttggtccgaggccgggggggtccctgagactctcctgtgcagtctctggattcacccttagaagtattggatgaccgtgggtccgccaggctcccgaggggaaggggctgggagtgggtggccaaacgaataaacgaaagacggaaagtcaagaaaaacctatagtggaactctagtgaacggcgattcaccatctccagacgacaacgaccaagaattcactgtatttgacaaatgaaacagacctgagagcgagacacggccgtagtattatgtgcgngagatgagtagtgacttcttacngtaagcgtaggtggttatgaagtttg

SEQ ID NO: 370731 - DNA, 570 bp, Homo sapiens
  misc_feature: GZ8MTXP01AZM6F.15.67.G01.1.454.CMB.2.raw
  modified_base (386)..(386): a, c, t, g, unknown or other
  modified_base (517)..(517): a, c, t, g, unknown or other
  modified_base (521)..(521): a, c, t, g, unknown or other
  modified_base (550)..(550): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggccgggggggtccctgagactctcctgtgcagtctctggattcacccttagaagtatggatgacctgggtccgcaggctccgaggggaaggggctgggagtggggtggaccaaacaataaaacgaaagaacgggaagtacaaggaaaaaacctntagtggactctaggtagaaccggccgattccaccatctaccaagacgacaaacgccaaagaattcactgttatttgacaaatgaaacagccgtgaggaggcgaggacgacggccgtagtattagtgtgcgngagntgagtagtagttacttcttacaaggtagngtagggtgttatgaagttgg

SEQ ID NO: 370732 - DNA, 538 bp, Homo sapiens
  misc_feature: GZ8MTXP01A5HHQ.15.67.G01.1.454.CMB.2.raw
  modified_base (338)..(338): a, c, t, g, unknown or other
  modified_base (366)..(366): a, c, t, g, unknown or other
  modified_base (369)..(369): a, c, t, g, unknown or other
  modified_base (375)..(375): a, c, t, g, unknown or other
  modified_base (394)..(394): a, c, t, g, unknown or other
  modified_base (483)..(483): a, c, t, g, unknown or other
  modified_base (488)..(488): a, c, t, g, unknown or other
  modified_base (498)..(498): a, c, t, g, unknown or other
  modified_base (506)..(506): a, c, t, g, unknown or other
  modified_base (513)..(513): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctggtttcctgttgttatttagaaggtgtcagtgtgaggtgcacttggtggaggtccggggggaggcgttggtccgaggccgggggggtccctgagactctctgtgcagtctctgattcacccttagaattatggatgacctgggtcccgccaggctccgagggaggggctgggagtgggtggaccaanataaacaaagacgaagtcaagaaaactntgngactcngtagaacgcgatcacatcncagagacaacgaccaagatcacttgtatttgactaaatagaacagccgtaggagagggcgaggacgacggccgtgttattagtgtgcgngaagnttgattaganttcgttanagtaagngtaaggtggtattgaagttcgtttg

SEQ ID NO: 370733 - DNA, 600 bp, Homo sapiens
  misc_feature: GZ8MTXP01B5IRN.15.67.G01.1.454.CMB.2.raw
  modified_base (260)..(260): a, c, t, g, unknown or other
  modified_base (306)..(306): a, c, t, g, unknown or other
  modified_base (494)..(494): a, c, t, g, unknown or other
  modified_base (548)..(548): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaggtgtccagtgtgaggtgcacttggtggagtcgtgggggaggcttggtccgaggccgggggggtccctgagactctcctgtgcngtctcgtggacttcacccttagaagtatggatgaccgtcgggtccnccgaggcctccgaggggaaggggctgggaggtggggtggacccaaacgaataaaaaccgaaaggaaaccggaaagtacgaaaggtaaaaaacctgtaggtaggaactcgtaggtacgaacggccgtattccaccagtctaccaagacgacaaccgacaagtaattcaacttgttatttcgacaaagtnaaactgacgtgaggagacggaggacgacggcgtagtattatgtacgcgaagganagtgataaggtgaccttcgacgtaaggtagcgagggtgttatggaagtttgg

SEQ ID NO: 370734 - DNA, 590 bp, Homo sapiens
  misc_feature: GZ8MTXP01DSEEA.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccaggcccggggggtccctgagactctcctgtgcagtctctggattcacccttagaagtattggatgacctgggtccgccaggctccgaggggaaggggcgtgggagtgggtggaccaacaataaacgaaagacggaaagtcaagaaaaacctatgtaggactcgtagtagaaccggccgattaccaccatcctccaagacgacaaacgaccaaagaattacactgttatttgacaaatagaaacacgaccgtagaggaggcggaaggacgacggccgtagtatttaagttggtgcggaacgagagtgaagtagtaagacgttcttaacgaagtaggcgtaagggttggttattggaagtttg

SEQ ID NO: 370735 - DNA, 583 bp, Homo sapiens
  misc_feature: GZ8MTXP01BV0UG.15.67.G01.1.454.CMB.2.raw
  modified_base (388)..(388): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcgttgggtccgagggcccgggggggtccctgagactctcctgtgcagtctctggattcacccttagaagttatggatgacctgggtccgccaggctccgaggggaaggggctgggagtgggtggccaaacataaaacaaagacggaaagtacaagaaaaaaccctntaggtaggactcgtagtagaaccgaccgtaattccaacctatcctaccaagacgaacaaacggaccaaagaattcaacttgttaatttgacaaaatgaaacagccgtagaggaggcgaggacgacggccgtgtattagtgtgcgcgagatgagtagtagacttcttaacgaagtagcgagggtgttatgaatttg

SEQ ID NO: 370736 - DNA, 594 bp, Homo sapiens
  misc_feature: GZ8MTXP01B5QUC.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggaggtcgtggggggaggcttgggtccgaggcccgggggggtccctgagactctcctgtgcagtctctggattcacccttagaagtattggatgacctgggtccgccaggctccgaggggaaggggctgggaggtggggtggccaacaataaaacgaaagacggaagtacaaggaaaaaaccctatagtggactcgtagtgaacggccgaattccaccatcaccagacacaacgacaagaattcacttgtatttgactaaatgaaacacgccgtaggaggaggacggaggacgacgggaccgttagtattagttagtgcgcggaagatagagtaagtaacgttacgttcttaacgaagttagaacgtagggtggttatggttaacgttgg

SEQ ID NO: 370737 - DNA, 647 bp, Homo sapiens
  misc_feature: GZ8MTXP01EUDTW.15.67.G01.1.454.CMB.2.raw
  modified_base (341)..(341): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgagggcccgggggggtccctgagactctcctgtgctagtctcgtggtattccaccttagaagtatggatgaccgtgggtcccgcaggctcgaggggaggcgtggaggtgggngaccaaacaataaaacgaaagacggaagtacaaagtaaaaacctgtagaggtactcgtagtacggaaccggcgtaacttccaacctattccaccgaaaggacgaacaaaccgaccgaaagtaacttactaacgttgtttaatttacgactaaaagtacgaaacgtacgtccgtaaggaacgggaggacggaaggtaccacgggtcgttagtagtttagttggacgcggaagaagttagtacgttaagtaaggttacgacttcgttaaacgtaaggtagaacgttagggtgttattgttaacgtttg

SEQ ID NO: 370738 - DNA, 552 bp, Homo sapiens
  misc_feature: GZ8MTXP01BRN9D.15.67.G01.1.454.CMB.2.raw
  modified_base (504)..(504): a, c, t, g, unknown or other
  modified_base (548)..(548): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccggggggggtccctgagactctcctgtgcagtctctggattcacccttagaagtattggatgacctgggtccgccaggctccaggggaaggggctgggagtggggtggccaaacataaacaaagacggaagtcaagaaaaacctatgtaggactctgtgaacggccgattcaccatctcagagacaacgaccaagaattcactgtatttgacaaatgaacagccgtgaggaggacggaggacgacggccgtagtattagtgtgcgcgagntgagtagtagacgttcttacaagtagcgagggtggttagtgttnttgg

SEQ ID NO: 370739 - DNA, 569 bp, Homo sapiens
  misc_feature: GZ8MTXP01BM2W2.15.67.G01.1.454.CMB.2.raw
  modified_base (370)..(370): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggcccgggggggtccctgagactctcctgtgcagtctctggattcaccttagagtatggatgacctgggtccgcaggctccgaggggagggctggagtgggtggccaacataaacaaagacggaagtcaagaaaaacctntgtaggactctgtagaaccggccgattcaccatctccagacgacaacgccaagaattcactgtatttgacaaatgaacacgccgtaggaggacggacggaggaccgacggccgtagtatttagtcgtagccggtgagagtgagtacgtaaggttacttcgttaacgaagtagcgtagggtgttagtcgttaagtttcgg

SEQ ID NO: 370740 - DNA, 570 bp, Homo sapiens
  misc_feature: GZ8MTXP01AR0UW.15.67.G01.1.454.CMB.2.raw
  modified_base (302)..(302): a, c, t, g, unknown or other
  modified_base (341)..(341): a, c, t, g, unknown or other
  modified_base (423)..(423): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagtatggatgactgggtccncaggctccgaggggaaggggctggagtggggtgaccaanaataaaacaaagacggaaagtcgaaagaaaaacctatgtaggacctcgtagtagaaccggccgattccacctatctacaganacaacgacaaagatcactgttatttagacaaatgaacagaccgtagaggaggcgaaggacgacggccgtagtacttgtagtgcgcgaagatgaagtaggtacgacttcttaaccgaagtagcgtaagggttgttaatgaagtttcgg

SEQ ID NO: 370741 - DNA, 556 bp, Homo sapiens
  misc_feature: GZ8MTXP01CFXYM.15.67.G01.1.454.CMB.2.raw
  modified_base (407)..(407): a, c, t, g, unknown or other
  modified_base (418)..(418): a, c, t, g, unknown or other
  modified_base (423)..(423): a, c, t, g, unknown or other
  modified_base (429)..(429): a, c, t, g, unknown or other
  modified_base (433)..(433): a, c, t, g, unknown or other
  modified_base (435)..(435): a, c, t, g, unknown or other
  modified_base (438)..(438): a, c, t, g, unknown or other
  modified_base (440)..(440): a, c, t, g, unknown or other
  modified_base (442)..(442): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcttgttgttattttagaaggtgtccagtgtgaggtgcacttggtggagtctgggggaggcttggtccagccggggggggtccctgagactctcctgtgcagtctctggatcacctagagtatggatgacctggtcgccagctccagggaagggctgggagtggggtggccaaacgaataaacaaaagacggaaagtcaagaaaaaaaccctatagtggaactcgtagtgaacggccgattcaccatcncagagacaacncaaanatcatntatnanaanananagacgtgagagacgagacgacgcgtagtagtagttgtgcgcgagagtagagtaagtaagttacgttacttacgtaagtaggtaacggtagggtaggttagtaagttaagttaag

SEQ ID NO: 370742 - DNA, 613 bp, Homo sapiens
  misc_feature: GZ8MTXP01C5UTW.15.67.G01.1.454.CMB.2.raw
  modified_base (393)..(393): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggaggtcgtgggggaggcttggtccgaggcccggggggtccctgagactctcctgtgcagtctctggattcacccttagaagtattggatgacctgggtccgccgaggctccgaggggaaggggctgggaggtggggtggaccaaacaataaaacgaaaaggaacggaaagtcaaaggaaaaaacctntagtggactcgtagtaggaaccggccgaattccaccatctaccagagacaacgccaaagaattacaactgttatttagactaaagtgaaacacgaccgtaggaacggagggacggaagggaccgaaccgggccgttagtagtttaagttgtgtccggaagagagttagagttaagtagacttcttaacgaagtagcgtagggtggttatgttaagtttcg

SEQ ID NO: 370743 - DNA, 749 bp, Homo sapiens
  misc_feature: GZ8MTXP01C28IM.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtccagtgtgaggtgcacttggtggagtcgtgggggaggcttgggtccgagggcccggggggtccctgagactctcctgtgcagtctcgtgtcttacctaccttagtaagttgtggatcgaccgtcgggtcccgcgaggcctaccggagggggacggcgtgggtaggtgggtacggaccaaacgtaaacgtaaaacgaaaaggaacggaaacggtacgaaaaacgtaaaaaccccttaggttaggtacggtaccttacgtaacgggtaacgggaacccgggaccgttaacttacccaccgtactccgtaccgaagaacgaaaccgaacccgaaccgaaagtaactttacaacgtttagtttacgtttacgaaactaaagtaacgaaacgtaccgaccgggtaaggaacggggacgggaccgggaaacggtaacccggacccggggttcgttagtttaagtttacgttggtcggaccgggtaagtaagttaggtacgaaggttaaagtacgttaaccgttacgttacgtaaggtcgtaacggtaaggggttgttagttaagttgttttgg

SEQ ID NO: 370744 - DNA, 588 bp, Homo sapiens
  misc_feature: GZ8MTXP01BSWU6.15.67.G01.1.454.CMB.2.raw
  modified_base (348)..(348): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggcccgggggggtccctgagactctcctgtgcagtctctggattcacccttagaagtattggatgacctgggtccgccaggctccgaggggaggggctgggagtgggtggaccaaanaataaaacgaaaggacggaaagtacaaagtaaaaaacctgtagtaggactcgtagtagaacgggccgtaattcaccatcaccagacgaacaacgaccaaagaattcaactgttaattgacaaatgaaacacgcgtgaagaggccgaagaccgacggcgtagtattagtgtgcgaacgtagattgaagtacgtaagttacgttccttagaaggtagcgtaagggtgttaatggttaattgg

SEQ ID NO: 370745 - DNA, 626 bp, Homo sapiens
  misc_feature: GZ8MTXP01A3EU0.15.67.G01.1.454.CMB.2.raw
  modified_base (595)..(595): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccgaggccgggggggtccctgagactctcctgtgcagtctctggattcacccttagaagttatggatgacctgggtccgccaggctccgaggggaaggggctgggagtggggtggccaaacaataaaacaaaggaacggaaagtacaagaaaaaacccttatggtgggacttcgtagtagaacgggccgtaatttccacctattccacgaacgaacgaaccgaaaccgacaaagtaacttactaacgtagtttattacgaacaaagtagaaacacgtaccggtaggaaggacggacggacggaacgaccggtaccggtagttattagttgtagcggaagagatgagtagtaacgacttcacgtaaggngtaacggtagggtaggttagtgaagtttcgg

SEQ ID NO: 370746 - DNA, 656 bp, Homo sapiens
  misc_feature: GZ8MTXP01A7EYR.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggagcttggtccgaggcccggggggtcccagactctcctgtgcagtctctgattcaccttagattatggatcgaccgtgggtccgccgaggctaccggaggggaacggggctgggaggtggggtacgaccaacgaagtaaaacgaaaggaacggaaagtacgaaagtaaaaactagtaggtaggactcgtggtaacgaaccggccgattccacctatcctacagacgaacaacgaccaaagtaacttacaacttagttatttagaactaaagttagaaacagtaccgtaggggaacggaggggaacggaacggaaccgaccgggtaccgttaggttaacgtttagttaggtcggcggtacgaaggtaagttggtaaattaaggtacgtaacttacgttacaggtaagacgtaagggttagtagttgtaagttcgtttaag

SEQ ID NO: 370747 - DNA, 546 bp, Homo sapiens
  misc_feature: GZ8MTXP01CM17Q.15.67.G01.1.454.CMB.2.raw
  modified_base (307)..(307): a, c, t, g, unknown or other
  modified_base (344)..(344): a, c, t, g, unknown or other
  modified_base (415)..(415): a, c, t, g, unknown or other
  modified_base (489)..(489): a, c, t, g, unknown or other
  modified_base (497)..(497): a, c, t, g, unknown or other
  modified_base (502)..(502): a, c, t, g, unknown or other
  modified_base (510)..(510): a, c, t, g, unknown or other
  modified_base (523)..(523): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggcccggggggggtccctgagactctcctgtgcagtctctggattcacccttagagtattggatgacctgggtccnccaggctccaggggaagggctggagtgggtggccaanaataaaacaaagacggaaagtcaaagaaaaacctatgtaggactcgtagtgaacggcaatcacatcctcanacgacaacgccaaagaattcactgtaatttgacaaatgaacagaccgtgagagcgaggaccaggcgtgtaattntagtgcgnaaggntggatagngaccgttttacgngtagcaaggtggttatggaattg

SEQ ID NO: 370748 - DNA, 601 bp, Homo sapiens
  misc_feature: GZ8MTXP01DG0FG.15.67.G01.1.454.CMB.2.raw
  modified_base (387)..(387): a, c, t, g, unknown or other
  modified_base (551)..(551): a, c, t, g, unknown or other
  modified_base (555)..(555): a, c, t, g, unknown or other
  modified_base (582)..(582): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggcccggggggtccctgagactctcctgtgcagtctctggattcacccttagaagttattggatgacctgggtcccgccaggctccgaggggagggcgtggagtgggtggaccaaacaataaaacgaaagaacggaaagtcaaagtaaaaaacctntagtggactcgtaggtagaacggccgtaattccacccatctaccaagacgaacaaaccgaccaaagtaacttacaacgttagttaatttagaactaaaatagaaacacgtaccgtaggaaggaaggacggaaggaaccgacggccgttagtatttagtgtgcgngagntagagtagtgacttcttaagaagtagngtaggtggttatgaagttg

SEQ ID NO: 370749 - DNA, 553 bp, Homo sapiens
  misc_feature: GZ8MTXP01D8HSU.15.67.G01.1.454.CMB.2.raw
  modified_base (534)..(534): a, c, t, g, unknown or other
  modified_base (536)..(536): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccggggggggtccctgagactctcctgtgcagtctctggattcaccccttagaagtattggatgacctgggtccgccaggctccgaggggaaggggctggagtgggtggccaacataaacaaagacgaagtcaagaaaaacctatagtgactctgtagaacggcgattccacatctcagacgacaacgaccaagattacacttgtatttgacaaatgaaacagccgtagacggagggcgaaggacgacgggccgtagtattattgtggcgcgagatgacgtagtagacttcttacaagtagngngggtggttatgaagttg

SEQ ID NO: 370750 - DNA, 552 bp, Homo sapiens
  misc_feature: GZ8MTXP01AIDX5.15.67.G01.1.454.CMB.2.raw
  modified_base (506)..(506): a, c, t, g, unknown or other
  modified_base (510)..(510): a, c, t, g, unknown or other
  modified_base (533)..(533): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtccagtgtgaggtgcacttggtggagtcgtggggggaggcttgggtccgaggccgggggggtccctgagactctcctgtgcagtctctggattcacccttagaagtattggatgacctgggtccgccaggctccgaggggaaggggctgggagtgggtggccaacataaacaaagacggaaagtcaagaaaaacctatgtggactctagtagaacggccgattcaccatctccagagacaacgccaaagaattcactgtactttgacaaatgaacagccgtaggagaggcgaggaccgacggtccgtagtattagtgtagccggngagntgagtagtagcttcacaagtcgngaggtaggttatgaagttg

SEQ ID NO: 370751 - DNA, 596 bp, Homo sapiens
  misc_feature: GZ8MTXP01BAG4B.15.67.G01.1.454.CMB.2.raw
  modified_base (306)..(306): a, c, t, g, unknown or other
  modified_base (396)..(396): a, c, t, g, unknown or other
  modified_base (573)..(573): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaggtgtccagtgtgaggtgcacgttggtggagtcgtggggggaggctttgggtccgagggcccgggggggtccctggagactctcctgtgcagtctctggattcacctagaagtatgatgacctgggtccncaggctccgaggggagggctggagtgggtggaccaacaataaacgaaagaacggaagtacaaaggaaaaacctatagtaggactcgtagngaacggccgattccacctatctaccaagacgaacaacgaccaagaacttcacttgtatttacgactaaagtgaaactagaccgtaggaaggagggacggaaggaaccgacgggtaccgtagttattagttggtcgcggaagagagtagagtagtacgacttcgttaacgtaagtagngagggttggttatgttaagtttg

SEQ ID NO: 370752 - DNA, 561 bp, Homo sapiens
  misc_feature: GZ8MTXP01DQXW8.15.67.G01.1.454.CMB.2.raw
  modified_base (532)..(532): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggcccgggggggtccctgagactctcctgtgcagtctctggattcacccttagaagtattggatgacctgggtccgccaggctccgaggggaaggggctggagtgggtggccaacataaacaaagacggaagtcaagaaaaacctatgtggactctagtgaacggccgattccaccatctcagagacaacgccaaagaattcactgtatttgacaaatgaaacagaccgtagaggaaggcgaggacgacggccgtagtattagttgtgtcgcgagatgaagtagtaaggacgttcttaacngttaagctagggtggttatgggaatttcg

SEQ ID NO: 370753 - DNA, 647 bp, Homo sapiens
  misc_feature: GZ8MTXP01AIZHK.15.67.G01.1.454.CMB.2.raw
  modified_base (259)..(260): a, c, t, g, unknown or other
  modified_base (487)..(487): a, c, t, g, unknown or other
  modified_base (575)..(575): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaagtgtccagtgtgaggtgcacttggtggagtcgtgggggaggcttggtccgaggccggggggtccctgagactctcctgtgnngtctgtgtcttctacctagtaagtgtgatgacgtcggtccgcgacgcgtccgaggggacgggcgtgggagggtgggtcggaccaaacgtaaacgtaaaacgaaaaggaacggaaagtacaaaagtaaaaacctagtggtaggacttcgtaaggtacggaaccgccgtacttacgaccctatcctacagacgaaccaaccgacaaagtacttactacgtagttatttnaaacgtaaataacgaacagccgtaggaacgggacgggacggaaggaaccgaccgggtacgtttagtattagtttggacgtccgggaanaggttagtagttaagtaagtacttacgttccttaagtaaggtgaaggtaggggtagttagtcgttgtttcgg

SEQ ID NO: 370754 - DNA, 537 bp, Homo sapiens
  misc_feature: GZ8MTXP01AL6AZ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccagccgggggggtccctgagactctcctgtgcagtctctggattcacccttagaagtatggatgacctgggtccgccaggctccgaggggaaggggctggagtgggtggccaacataaacaaagacggaagtacaagaaaaacctatgtggactctgtgaacggccgattcacatctccagacgacaacgccaagaattcactgtatttgacaaatgaacagcctagacgaggcgaggacacggccgtgtattagttgtgcgcgagatgagtagagacttcttacaagtgctagggtgttatgaagttcg

SEQ ID NO: 370755 - DNA, 562 bp, Homo sapiens
  misc_feature: GZ8MTXP01A1HPF.15.67.G01.1.454.CMB.2.raw
  modified_base (341)..(341): a, c, t, g, unknown or other
  modified_base (371)..(371): a, c, t, g, unknown or other
  modified_base (381)..(381): a, c, t, g, unknown or other
  modified_base (449)..(449): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcacccttagaagtatggatgactgggtcgcaggctccgaggggagggctgggagtgggtggccaaanataaaacaaagacgaagtcagaaaaacctntgtggactcngtgaacggccgattccaccatctcagagacaacgaccaagaattcaactgtatttgactaaatgaaanacgccgtagaggaggacgaggacgacggccgtggtattagttggcgcgcggagagtagacgtaagtacgacgttcttaacgaaggtacgcgtagggtaggttatgttaacgtg

SEQ ID NO: 370756 - DNA, 603 bp, Homo sapiens
  misc_feature: GZ8MTXP01A0BRK.15.67.G01.1.454.CMB.2.raw
  modified_base (543)..(543): a, c, t, g, unknown or other
  modified_base (579)..(579): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcgttggtccgagggcccgggggggtccctgacgactctcctgtgcagtctctggtattccacccttagaagtatggatgacctgggtccgccgaggcctccgaggggagggcgtggagtgggtcggaccaaagaataaacgaaagacggaaagtacaaaggaaaaaccctagtaggtgaactcgtagtacgaaccggcgtattccacctatcgaccaagacgaacaacgaccaaagtaacttcaacgttagttaatttacgacaaatgaaacacgccgtagaggaggacgaggaccgacggcgttagtattagtgtgcggngagttgtagagtagtacgaccttgacgaaggtacgngagggtagttatggttaacttggg

SEQ ID NO: 370757 - DNA, 642 bp, Homo sapiens
  misc_feature: GZ8MTXP01CXJ97.15.67.G01.1.454.CMB.2.raw
  modified_base (316)..(316): a, c, t, g, unknown or other
  modified_base (361)..(361): a, c, t, g, unknown or other
  modified_base (511)..(511): a, c, t, g, unknown or other
  modified_base (635)..(635): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttatttagaaggtgtccagtgtgaggtgcacgttggtggagtcgtgggggaggcgtttggccgacgggtcccgggggggtccctggacgtactctccgtgtgcagtctctggattcacccttagaagtatggatgaccgtgggtcccnccaggccgtaccgaggggaagggctgggaggtgggacgaccaaanataaaacgaaagacgaagtacaaagaaaaacctgtagtggactcgtaagtacgaaccgaccgtattaccaaccctatccgtaccgagaacgaaccaaacggtacccaaagtaacttacaacttgttaatttgaacctaaaagtcgaaacncgtaccgtaggaaggaaggaccggaaggaccgtacggccgttagttattagttgtacggcgtaagagttagtattaacgtagtaacgacccttgacgaagttaggcgttagggtagttagtcgngtttaag

SEQ ID NO: 370758 - DNA, 541 bp, Homo sapiens
  misc_feature: GZ8MTXP01C16T0.15.67.G01.1.454.CMB.2.raw
  modified_base (406)..(406): a, c, t, g, unknown or other
  modified_base (488)..(488): a, c, t, g, unknown or other
  modified_base (496)..(496): a, c, t, g, unknown or other
  modified_base (518)..(518): a, c, t, g, unknown or other
  modified_base (537)..(537): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagtattggatgacctgggtccgccaggctccgaggggaggggctgggagtgggtggccaacataaacaaagacggaagtcaagaaaacctatgtggactctgtgaacggcattcacatctcaganacaacgcaagattacactgttatttgacaaatgaaacagccgtaggagagggacgagggacacgggccgtagttattattgngcgcgagntgagtagtagacttcgttaacngtagcgtaggtggttatgngttg

SEQ ID NO: 370759 - DNA, 591 bp, Homo sapiens
  misc_feature: GZ8MTXP01AQ901.15.67.G01.1.454.CMB.2.raw
  modified_base (532)..(532): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttgggtccgaggcccgggggggtccctggagactctcctgtgcagtctctggattcacccttagaagtatggatgacctgggtccgccaggctccgaggggaaggggctgggagtgggtggccaaacaataaaacgaaagaaccggaaagtacgaaagaaaaaaccctataggtaggactcgtagtagaaccggccgagttcaccatctacccagacgacaacgaccaagaacttcactgtatttgactaaatagaacagccgtagaggagggcgaaggacacgggtccgtggttattagttggtgcgngagagtgagtagtacggacttcgttacgaaggttagcgagggttggttatgttaagttg

SEQ ID NO: 370760 - DNA, 627 bp, Homo sapiens
  misc_feature: GZ8MTXP01EVIRA.15.67.G01.1.454.CMB.2.raw
  modified_base (353)..(353): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttatttagaaggtgtccagtgtgaggtgcacgttggtggagtcgtggggggaggcgttggtccgagggcccgggggggtcctgagactctcctgtgcagtctctggattccaccttagaagttagttgggtcgaccgtgggtccgcaggctccgaaggggaggggctgggagtgggcgaccaaanaataaaacgaaaggacggaaagtacaaagaaaaactgtggtagactctggtaagaaccggcgtaatccactactcctacagacaacaacgaccaaagtaacttcacttagttatttagaactaaagtacgaaacacgtaccgtaggggaaggacgggacgaacgggacgacggtccgtagttatttagtggtacgcggtagaagtagttggaattagtaactacttacttagttaggtaagtcggtaaggttaggtattaggtaagttgtttgg

SEQ ID NO: 370761 - DNA, 603 bp, Homo sapiens
  misc_feature: GZ8MTXP01DIGQ8.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggccgggggggtccctgagactctcctgtgcagtctctggattcacccttagaagtatggatgaccgtgggtccgccaggctccgaggggaaggggctgggaggtggggtggaccaaacaaataaacgaaaggaaccggaaagtacaaagtaaaaaaccctagtgtaggactctaggtagaaccgggccgattaccaccatcctaccagaacgacaacgaccaaagaattcacttagtatttagacaaatagaaacagccgtagaaggagggacgaggacgacggcgtagttattagttgcgtcggcgagagtgaagttacggtaagaccttacacgtaagttacgaagtagggtaggttatgttaagtttg

SEQ ID NO: 370762 - DNA, 574 bp, Homo sapiens
  misc_feature: GZ8MTXP01DN4BW.15.67.G01.1.454.CMB.2.raw
tcagtctacgtagccacgaccggtgctcgatttagagtatacatattgggtttgaagtctcagagaggagccttagccctggactccaaggcctttccacttggtgatcagcactgagcacagaggactcaccatggagttggggctgagctgggttttccttgttgttattttagaaggtgtccagtgtgaggtgcacttggtggaggtcgtgggggaggcgttggtccgaggccgggggggtccctgagactctcctgtgcagtctctggattcacccttagaagtatggatgacctgggtccgccaggctccgaggggaaggggctgggagtggggtggacaaacaataaaacgaaagacggaaagtcaagaaaaacctatagtggaactctagtagaacggccgattcacctatctaccagagacaacgaccaaagaattacactgttatttgacaaatgaaacagaccgtaggaggaaggcgaggacacgggcgtagtattagttgtggcgtaagagatgattaagtagaacgttcttaacgaagtagcgagggtggttatgaagtttg

SEQ ID NO: 370763 - DNA, 538 bp, Homo sapiens
  misc_feature: GZ8MTXP01BILU2.15.67.G01.1.454.CMB.2.raw
  modified_base (498)..(498): a, c, t, g, unknown or other
  modified_base (520)..(520): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttgggtccaggccggggggtccctgagactctcctgtgcagtctctggattcacccttagaagtatggatgacctgggtccgccaggctccgaggggaaggggctgggagtgggtggccaaacataaacaaagactagaagtcaagaaaactatgtggactctgtggaacggccgattccacatctccagacgacaacgccaaagaattcaacttgtatttgacaaatgaacaggcctaggacgaggcgaggacacggcgtgtattatgtgcgcgagnttgatagagcttctaacagtgnagggttgtaagttgtaag

SEQ ID NO: 370764 - DNA, 591 bp, Homo sapiens
  misc_feature: GZ8MTXP01CF83O.15.67.G01.1.454.CMB.2.raw
  modified_base (341)..(341): a, c, t, g, unknown or other
  modified_base (350)..(350): a, c, t, g, unknown or other
  modified_base (390)..(390): a, c, t, g, unknown or other
  modified_base (466)..(466): a, c, t, g, unknown or other
  modified_base (468)..(468): a, c, t, g, unknown or other
  modified_base (470)..(470): a, c, t, g, unknown or other
  modified_base (472)..(472): a, c, t, g, unknown or other
  modified_base (474)..(474): a, c, t, g, unknown or other
  modified_base (515)..(515): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggttttcttgttagttatttagaaggtgtcagtgtgaggtgcacttggtggagtcgtggggggagcttgggtccgaggccgggggggtccctggacgactctcctgtgcagtctctggattcacccttagaagtattggatgaccgtgggtcccgcaggctaccgaggggaagggcgtggaggtgggnggaccaaanaataaaaccgaaaggacggaaagtcaaagtaaaaaacctntgtaggacctgtagtagaacggcctattcaccaatcctccaagacgaacaacgaccaaagattaccattgtattanananananagacgagagagagagacgacgacgtagtagttagtgtgcgngagttagtagttagtaagtaacgttacgttacgttacgtaaggtaggtaacggtagggtaggttagtgttgttaag

SEQ ID NO: 370765 - DNA, 538 bp, Homo sapiens
  misc_feature: GZ8MTXP01C02VX.15.67.G01.1.454.CMB.2.raw
  modified_base (321)..(321): a, c, t, g, unknown or other
  modified_base (324)..(324): a, c, t, g, unknown or other
  modified_base (412)..(412): a, c, t, g, unknown or other
  modified_base (485)..(485): a, c, t, g, unknown or other
  modified_base (493)..(493): a, c, t, g, unknown or other
  modified_base (503)..(503): a, c, t, g, unknown or other
  modified_base (520)..(520): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccggggggggtccctgagactctcctgtgcagtctctggattcacccttagaagtatgatgacctggtccgccagctccagggagggcnggngtgggtggccaacataaaacaaagacggaagtacaagaaaaacctatagtggactctagttagaacggcgattcaccagtctccaganacaacgaccaagaattcactgtattgacaaatgaacagccgtgaggagcggagacgacggcgtagtattatgngtgcgagntgagtagtanacgttcttacaagtagntagggtgttatgaagttg

SEQ ID NO: 370766 - DNA, 582 bp, Homo sapiens
  misc_feature: GZ8MTXP01CX9YN.15.67.G01.1.454.CMB.2.raw
  modified_base (534)..(534): a, c, t, g, unknown or other
  modified_base (565)..(565): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggcccggggggggtccctggagactctcctgtgcagtctctggattcacccttagaagtatggatgaccgtgggtccgccagactccgaggggaaggggctgggaggtgggtggaccaaacaataaaacgaaaagaacgggaaagtacaaggaaaaaacctataggtggaactcgtaggtacgaacggccgaattccaacccatcctaccagagaacaaacgccaaagaacttacacttagttatttagacaaatgaacagccgtagagaggacgagaccgacggcgtagtattattgtgcgngagattgagtagtagacttcttacaagtagnagggtgttatggaattg

SEQ ID NO: 370767 - DNA, 616 bp, Homo sapiens
  misc_feature: GZ8MTXP01B3ZLC.15.67.G01.1.454.CMB.2.raw
  modified_base (262)..(262): a, c, t, g, unknown or other
  modified_base (560)..(560): a, c, t, g, unknown or other
  modified_base (597)..(597): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcttgttgttattttagaaggtgtccagtgtgaggtgcacgttggtggagtcgtgggggaggcgttggtccgagggccggggggtcctgagactctcctgtgcngtctctggattcacccttagaagtattggatgacctgggtccgccgaggctccgaggggaaggggctgggaggtgggtggaccaaacaataaaacgaaaggaacggaaagtacaaagtaaaaaaccctgtaggtaggactcgtaggtacgaaccgggccgtaattccaccctatcctaccgaaagacgaaaccgaaaccgacccaaagtaaacttacaacttagttaatttacgacaaaatgaaacacgaccgtagaaggacggacggaaggaccgacggccgttagttattagttgngcgaagagatgagtaagtagacttcttacgaagtagngtaggtgttatgaagtttg

SEQ ID NO: 370768 - DNA, 598 bp, Homo sapiens
  misc_feature: GZ8MTXP01AWBBQ.15.67.G01.1.454.CMB.2.raw
  modified_base (426)..(426): a, c, t, g, unknown or other
  modified_base (469)..(469): a, c, t, g, unknown or other
  modified_base (471)..(471): a, c, t, g, unknown or other
  modified_base (474)..(474): a, c, t, g, unknown or other
  modified_base (476)..(476): a, c, t, g, unknown or other
  modified_base (484)..(484): a, c, t, g, unknown or other
  modified_base (523)..(523): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcttggtccgaggccgggggggtccctgagactctcctgtgcagtctctggacttcacccttagaagtatggatgacctgggtccgccgaggctccgaggggaaggggctgggagtgggtcggaccaacaataaaacgaaaggacggaagtacgaagaaaaaccctataggtggaactcgtagtacgaaccggtcacttcaaccntacacccgagacgaacaacgacaagaacttacactagtattananaananacagacgngagagacggacgacgacgcgtagtagtagtagtcgcggngagagtagttagtaagtaacgttacgttacgttacgtaaggtaggtaacggtagggttaggttagtaagttgttg

SEQ ID NO: 370769 - DNA, 589 bp, Homo sapiens
  misc_feature: GZ8MTXP01B369M.15.67.G01.1.454.CMB.2.raw
  modified_base (497)..(497): a, c, t, g, unknown or other
  modified_base (544)..(544): a, c, t, g, unknown or other
  modified_base (568)..(568): a, c, t, g, unknown or other
  modified_base (574)..(574): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacgttggtggagtcgtggggggaggtcttgggtccgaggcccggggggtccctgagactctcctgtgcagtctctggtattcacccttagtaagtattggatgacctgggtccgccgaggctccgaggggaaggggctgggagtggggtggacccaaacaataaaacgaaagaaccggaaatacgaaagaaaaacctagtgtggaactcgtaggtacgaaccgggccgatttcaccctatcctacccaagagaaccaaaccggaccaagaacttcaactgttaatttgactaaatacgaanacgcgtagaggaggacgaggacgacggtcgtagtattagttgtgcgngagatgagtagacgacttcttaangtgcgnggtgttatgaagttg

SEQ ID NO: 370770 - DNA, 659 bp, Homo sapiens
  misc_feature: GZ8MTXP01EJTDT.15.67.G01.1.454.CMB.2.raw
  modified_base (285)..(285): a, c, t, g, unknown or other
tcagtctacgtagccacgaccggtgctcgatttagagtatacatattgggtttgaggtctcagagaggagccttagccctggactccaaagcctttccacttggtgatcaacactgagcacagaggactcaccatggagttgggctgagcttgggttttccttgttgttattttagaaggtgtccagtgtgaggtgcacgttggtggagtcgtgggggagtcttggtccagggccggggggtccctgagctctctgtgcagtctctgattccaccttagaagttntggatcgaccgtgggtccgccgaggcctccggaggggaaggggcgtggggaggtgggtacggaccaaacgaataaaacgaaaggacggaaagtacaaagtaaaaactgtgtaggactcgtgtaacgaacggccgtattccaacctactcctaccgaagaacgaaccaacgaccaaagtaacttaccagttagttaagtttagaactaaattagaaacctagaccgtaggggaaggaggaccggaacgggacgaccgggtcgttagttaagtttagttggtagccggaggaagtagttacggaaattaggtaacgtaccttaccgttagaacggttgacgtaagggttggtaagttgttaagttccgttttaagg

SEQ ID NO: 370771 - DNA, 553 bp, Homo sapiens
  misc_feature: GZ8MTXP01AV7NG.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccggggggggtccctgagactctcctgtgcagtctctggattcacccttagaagtattggatgacctgggtccgcaggctccgaggggaaggggctggagtgggtgaccaacataaacaaagacggaagtacaagaaaacctatgtgactcagtgaacggcgattacaccatctaccagacgacaacgaccaagaattcactgtatttgacaaatagaacagaccgtgaggaggcgaggacgacgggaccgtgtattagtgtgcggcgagagtgagtagtagacttccgttaacaaggtagcgtagggtggttatgaacgttg

SEQ ID NO: 370772 - DNA, 580 bp, Homo sapiens
  misc_feature: GZ8MTXP01EI8C2.15.67.G01.1.454.CMB.2.raw
  modified_base (513)..(513): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcaccttagaagtatggatgacctgggtccgcaggctccgaggggagggctggagtgggtggccaaacaataaaacgaaagacggaagtacaaagaaaaaacctgtagtggactcgtagtacgaaccgggcctattccaccatctaccagacgacaacgccaaagattacactgttatttgactaaatgaaacacgaccgtagaggaggacgaggacgacggcgtatagttagttgtgcggngagttagtgaagttaagtagacgttcttacgaaggttagaacgtaggtaggttatgttaacgtttgg

SEQ ID NO: 370773 - DNA, 558 bp, Homo sapiens
  misc_feature: GZ8MTXP01ASVST.15.67.G01.1.454.CMB.2.raw
  modified_base (512)..(512): a, c, t, g, unknown or other
  modified_base (523)..(523): a, c, t, g, unknown or other
  modified_base (529)..(529): a, c, t, g, unknown or other
  modified_base (540)..(540): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccgaggccgggggggtccctgagactctcctgtgcagtctctggattcacccttagaagtattggatgacctgggtccgccaggctccgaggggaaggggctggagtgggtggaccaaacaataaaacaaagaacggaaagtacaagaaaaaaccctataggtggaactctagtgaacggccgattcaccatctccagagacaacgccaaagaattcaactgtatttgacaaatagaacagccgtgaggaggaccggaggacgacggccgtagtattatgtgcgngagatgatagnacgttnttacaagtagnaggtggttatggaattgg

SEQ ID NO: 370774 - DNA, 603 bp, Homo sapiens
  misc_feature: GZ8MTXP01CQ3VJ.15.67.G01.1.454.CMB.2.raw
  modified_base (594)..(594): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttggtccgaggcccgggggggtccctgagactctcctgtgcagtctctggattcacccttagaagtattggatgacctgggtccgccaggcctccgaggggaaggggcgtgggaggtgggtggccaaacaataaaacgaaaggaacggaaagtacaaagaaaaaaccctatgtggactcgtagtacggaacggccagttccaccatcctaccaagacgaacaaacgaccaaagaattacacttgtatttgactaaatgaaacagccgtagaggaggacgaggaccgacggtcgtagtatttgtagtgcggcgagatagagttaaggagttaccttcgttaactaaggtagtcggtaagggtggttagttgngttttaagg

SEQ ID NO: 370775 - DNA, 516 bp, Homo sapiens
  misc_feature: GZ8MTXP01EBROS.15.67.G01.1.454.CMB.2.raw
  modified_base (288)..(288): a, c, t, g, unknown or other
  modified_base (293)..(293): a, c, t, g, unknown or other
  modified_base (304)..(304): a, c, t, g, unknown or other
  modified_base (306)..(306): a, c, t, g, unknown or other
  modified_base (308)..(308): a, c, t, g, unknown or other
  modified_base (310)..(310): a, c, t, g, unknown or other
  modified_base (312)..(312): a, c, t, g, unknown or other
  modified_base (317)..(317): a, c, t, g, unknown or other
  modified_base (319)..(319): a, c, t, g, unknown or other
  modified_base (322)..(322): a, c, t, g, unknown or other
  modified_base (329)..(329): a, c, t, g, unknown or other
  modified_base (331)..(331): a, c, t, g, unknown or other
  modified_base (334)..(334): a, c, t, g, unknown or other
  modified_base (339)..(339): a, c, t, g, unknown or other
  modified_base (341)..(341): a, c, t, g, unknown or other
  modified_base (343)..(343): a, c, t, g, unknown or other
  modified_base (364)..(364): a, c, t, g, unknown or other
  modified_base (367)..(367): a, c, t, g, unknown or other
  modified_base (369)..(369): a, c, t, g, unknown or other
  modified_base (377)..(377): a, c, t, g, unknown or other
  modified_base (389)..(389): a, c, t, g, unknown or other
  modified_base (391)..(391): a, c, t, g, unknown or other
  modified_base (393)..(393): a, c, t, g, unknown or other
  modified_base (395)..(395): a, c, t, g, unknown or other
  modified_base (397)..(397): a, c, t, g, unknown or other
  modified_base (399)..(399): a, c, t, g, unknown or other
  modified_base (436)..(436): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttcgtgtaggtatttagaagtgtcagtgtgagtgcagttggtggagtgtggggggagcttggtccaggccgggggggtcctgagctctcctgtgcagtctgtggattcacctagagtatggatgactggccncagcncgagggagggngngngngngacananaanaagagananaanaacangngntgtagagcgacatacacatcncananacacacanatatatatatananananananacgagagagacgagacgacgacgtagtagttgtgtgngaagagttagtagttagtaagtaacgttacgttacgttacgtaagtacggtaaggtaggtaggttagttaagttgttaag

SEQ ID NO: 370776 - DNA, 572 bp, Homo sapiens
  misc_feature: GZ8MTXP01BNUMH.15.67.G01.1.454.CMB.2.raw
  modified_base (289)..(289): a, c, t, g, unknown or other
  modified_base (306)..(306): a, c, t, g, unknown or other
  modified_base (344)..(344): a, c, t, g, unknown or other
  modified_base (381)..(381): a, c, t, g, unknown or other
  modified_base (531)..(531): a, c, t, g, unknown or other
  modified_base (547)..(547): a, c, t, g, unknown or other
  modified_base (554)..(554): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgagggcccggggggtccctgagactctcctgtgcagtctctggattcacccttagaagtntggatgacctgggtccnccaggctccgaggggagggctggagtgggtggaccaanaataaaacgaaagacggaaagtacaagaaaaaacctntagtggacttcgtaggtacgaacggccgtaattccacccattccaccaagacgaacaaacgaccaaagtaattcaactgttatttgacaaaatgaaacagaccgtagaaggaggacgagggaccacggccgtagtattatgtgcgtgagntgagtagtgacttcanaagtagngagggtgttatgaattcg

SEQ ID NO: 370777 - DNA, 576 bp, Homo sapiens
  misc_feature: GZ8MTXP01BBD8Z.15.67.G01.1.454.CMB.2.raw
  modified_base (512)..(512): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagtatggatgacctgggtccgccaggctccgaggggaaggggctgggagtggggtggccaaacataaacaaaggacggaagtacaagaaaaacctgtgtggactctagtgaacggccgattccaccatctccagacgacaacgaccaagaattcaactgttatttgacaaatagaacagccgtaggacggagggacgaaggacgacggtccgtagtattagtgtcgcggngagatagacgtaagtagacttcgttaacgaaggtacgaagagggtaggttatggttaagtttgg

SEQ ID NO: 370778 - DNA, 576 bp, Homo sapiens
  misc_feature: GZ8MTXP01A393D.15.67.G01.1.454.CMB.2.raw
  modified_base (524)..(524): a, c, t, g, unknown or other
  modified_base (554)..(554): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggaggtcgtggggggaggcttggtccgaggccgggggggtccctgagactctcctgtgcagtctctggattcacccttagaagtattggatgacctgggtccgccaggctccgaggggaaggggctggaggtgggtggaccaacaataaacaaagacggaagtacaaggaaaaacctatagtggactctagtacgaacggccgaattcaccagtctaccgagacgacaacgaccaaagaattcaactagtatttgacaaatagaaacagccgtagaagaggacgaggacgaccggccgtagtattgtagtgcgcgtaagntagagttagtagacttcttacgaagtacgngagggtggttatggttaagttg

SEQ ID NO: 370779 - DNA, 633 bp, Homo sapiens
  misc_feature: GZ8MTXP01DYT97.15.67.G01.1.454.CMB.2.raw
  modified_base (393)..(393): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttgggtccgagggcccgggggggtccctgagactctcctgtgcagtctctggtattcacccttagaagtattggatgacctgggtccgccgaggctccgaggggaggggcgtgggaggtgggtggaccaacaataaaacgaaaggacggaaagtacaaagaaaaaacctntagtaggactcgtagtgaacgggtcaacttccacctatctcaagacgaacaaacgaccaaagaacttacaacgttagttaatttagactaaaatagaaacacgccgtagaaggggaggacggaacggacgacgggtccgtaggttattagttaggtgtcggaacgtaagttaagtacgttaagtaagtaacgaccttcttaagaaggtagaacgtagggtaggttatggttaacgtttgg

SEQ ID NO: 370780 - DNA, 847 bp, Homo sapiens
  misc_feature: GZ8MTXP01ETDDF.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagagaactcaccatggagttggggctgagctgggttttccttgttgttatttagaggtgtccagtgtgaggtgcacgttggtggaggtcgtggggggaggtcgttgggtccgacgggcccgggggggtccctggacgactctcctgtgctagtctcgtggtacttccacccttagtaagttagttggatcgaccgtgggtcccgccgaggcctccggagggggagggcgtgggaggtggggtcgaccaaacaagtaaaacgaaaggacggaaagtacgaaagtaaaaaacctgtaggtacgggacttacgtagggttacggaaccgggtccgtaacttacccgaaccctaacttccgacccgaaaggaacgaaaccgaaacccggaacccaaaaggtaaactttaccgaaaccgttttagtttaaacgttttaggaaaccttaaaagttacggtaaaaccgacggtacccggttaagggaacggggaacggggaccgggaaacggggtaacccggaaacccggggttcccgggtttaaggttttaaacgttttaaaggttttcgggttacgggacccgggtaacggtaaagggttaacgttacgggttaaacgtttaaagggtttaacgttaaaccgtttacgttaaacccgggttaagggttaagggtaaccgggttaaagggggtttgggggttaatttaacggggtttaagtttttaacgggg

SEQ ID NO: 370781 - DNA, 573 bp, Homo sapiens
  misc_feature: GZ8MTXP01CH795.15.67.G01.1.454.CMB.2.raw
  modified_base (517)..(517): a, c, t, g, unknown or other
  modified_base (551)..(551): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggaggtcgtggggggagggcgttgggtccgaggcccggggggggtccctgagactctcctgtgcagtctctggattcacccttagaagtattggatgacctgggtccgccaggctccgaggggaagggctgggagtgggtggccaacataaacaaagacggaaagtcaagaaaaacctatgtggactctaggtagaacggccgattcaccatctcagagacaacgcaaagaattcactgtatttgactaaatagaacacgaccgtggaaggacgggacggaaggaccgacggccgtagtagttattggtgcgngagatgagtaagtagacttcttaacgaagtacgngtagggtggttatgaacgtttg

SEQ ID NO: 370782 - DNA, 627 bp, Homo sapiens
  misc_feature: GZ8MTXP01D480P.15.67.G01.1.454.CMB.2.raw
  modified_base (562)..(562): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggtcgttggtccgaggcccgggggggtccctgagactctcctgtgcagtctctggattcaccttagaagtatggatgaccgtgggtccgccaggctccgaggggaagggctgggagtgggtggaccaaacaataaaacgaaaggacggaaagtacaaagaaaacctgtgtggactcgtagtacgaacggccgattacccacctatacctcgaagacgaaccaaccgaccaaagtaactttacgaacttagtttaatttgaactaaaatcgaaacacgaccgttaggaaggaacgggcgaaggaccgacgggtccgtagttattagttggtcgcggaagtagngtagagttaggtaacgttaccttcttaacgaaggtaagcgtaggggtgttatcggttaagtttgg

SEQ ID NO: 370783 - DNA, 597 bp, Homo sapiens
  misc_feature: GZ8MTXP01DBQE7.15.67.G01.1.454.CMB.2.raw
  modified_base (303)..(303): a, c, t, g, unknown or other
  modified_base (332)..(332): a, c, t, g, unknown or other
  modified_base (339)..(339): a, c, t, g, unknown or other
  modified_base (362)..(362): a, c, t, g, unknown or other
  modified_base (375)..(375): a, c, t, g, unknown or other
  modified_base (533)..(533): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccggggggtccctgagactctcctgtgcagtctctggattcacccttagaagtatggatgacctggtccnccaggctccgaggggaggctggagtgggngaccaanaataaacaaagacgaagtcaaanaaaaaccggggtntacgtggactcgtaaggtagaaccggccgaatttccgaacactctaccaaggacaaccaaacgaccaaagtaacttaccaagttgttaatttacgacaaaatacgaacacgaccgtagaggaggacgaggacgacggccgtgtagttattagtgcggngagagtgagtaagtagttacgttcttacgtaagtagcgtaggtaggttagtgttaagtttaagg

SEQ ID NO: 370784 - DNA, 601 bp, Homo sapiens
  misc_feature: GZ8MTXP01DOWUK.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggccgggggggtccctgagactctcctgtgcagtctctggattcacccttagaagtattggatgaccgtgggtccgccgaggctccgaggggaaggggctgggagtgggtggaccaaacgaataaaacgaaagaacggaagtcaaggaaaaacctatagtggactcgtagtagaacggccgattccaacctatctccagacgaacaacgaccaaagaattacacttgtatttgacaaaatgaaacacgccgtagacggaggacgaggaccgacggccgtagttattagttgtgcgtaagagagtgagttaagtaggaaccttcgttaaaccaaggttaaggcggtagggttggttagtggttaagttcg

SEQ ID NO: 370785 - DNA, 642 bp, Homo sapiens
  misc_feature: GZ8MTXP01DJZUI.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacgttggtggaggtcgtggggggaggtcgttgggtccgagggcccgggggggtccctgagactctcctgtgcagtctctggattcacccttagaagtattggatgacctgggtccgccaggctccgaggggaaggggcgtgggaggtgggtacggaccaaacaaagtaaaacgaaaggaacgggaaagtacaaagtaaaaaaccctagtaggtaggaccttcgtagggttacgaaccgggcccgtaacttccaaccctaatcctaccgaagaacgaaccaaaccgaccaaagtaacttaccaacttgttatttagactaaaagtagaaacacgccgtaggaaggaagggacggaagggaaccgacgggtccgttagttattagttgtgcgaacgagatgaagtagtagacttcttaacgaagtagcgtagggtgttatgaagtttg

SEQ ID NO: 370786 - DNA, 644 bp, Homo sapiens
  misc_feature: GZ8MTXP01BYP0O.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccgaggccgggggggtccctgagactctcctgtgcagtctctggattcacccttagaagttatggatgacctgggtccgccaggctccgaggggaaggggctgggaggtgggtcggaccaaacaagtaaaacgaaaggaacggaaagtcaaagaaaaaaccttatggtaggactcgtgtaggaaccggccgatttccaccctatcctaccgagacgaacaacgaccaaagaattacaacttgtatttagactaaaatacggaaacacgaccggtaggaaggacgggacggaagggaccgacgggtccgttaggttatttaagttcggtggcggtaacgaaggttagtagacgttaaggtaacgttaccttcgttaacgtaagtacggcgtaaggggtggttagtggttaacgtttaagg

SEQ ID NO: 370787 - DNA, 644 bp, Homo sapiens
  misc_feature: GZ8MTXP01EQ7J8.15.67.G01.1.454.CMB.2.raw
  modified_base (296)..(296): a, c, t, g, unknown or other
  modified_base (300)..(300): a, c, t, g, unknown or other
  modified_base (302)..(302): a, c, t, g, unknown or other
  modified_base (305)..(305): a, c, t, g, unknown or other
  modified_base (338)..(338): a, c, t, g, unknown or other
  modified_base (364)..(364): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtggggggagcttggtccgagggccggggggtccctgagactctcctgtgcagtctctggattcaccttagaagtatggatgacnggcncngcnccgagggaagggctggaggtgggtggaccaaanaataaaacgaaagacggaagtaacgnaacgaaaactaagtagtaggacgtacgtagtcggaaacggaccgtactaccacctactacctaccaacgaacgaaccgaaaccgaaccgaaacgtaaacttaactaacgttacgttaacgttaacgtaactaaagtaacgaaacgaacggacgtaacggaacggaacgggacggaacggaacgaccggtaccgtacgttagttagttgtggcgacgagtagttagtaagtaagttacgttacttactaacgtagtaagacgtaggttagtaagttgtaag

SEQ ID NO: 370788 - DNA, 655 bp, Homo sapiens
  misc_feature: GZ8MTXP01DOZER.15.67.G01.1.454.CMB.2.raw
  modified_base (317)..(317): a, c, t, g, unknown or other
  modified_base (631)..(631): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttccttgttgtttattttagaaggtgtccagtgtgaggtgcacgttggtggaggtcgtggggggaggcgtttgggtccgagggcccgggggggtccctggagactctcctgtgcagtctctggtattccacccttagaagtattggatgacctgggtccnccgaggctccgaggggagggctgggagtgggtcggaccaaacgaataaacgaaaggacggaagacaaagaaaaaccctagtggtaggactcgtaggtacgaaccgggcccgtaaatttcccaacccgtattccctaccaaaggacgaaaccgaaaccggaccaaaagtaactttaccaacgttagttaatttacgactaaaatacgaaactacggtccgtaggaagggaagggacggtaacggaccgtacggtccgttagtatttagtggtgcggaagagagtgaagtaagtattacgttcttacgtaagtagnggtagggtggttatggaactttgg

SEQ ID NO: 370789 - DNA, 644 bp, Homo sapiens
  misc_feature: GZ8MTXP01DCGFR.15.67.G01.1.454.CMB.2.raw
  modified_base (580)..(580): a, c, t, g, unknown or other
  modified_base (621)..(621): a, c, t, g, unknown or other
  modified_base (636)..(636): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgtttattttagaaggtgtccagtgtgaggtgctacgttggtggaggtcggtggggggaggcgtttgggtccgagggcccgggggggtccctggagtacctctccgtgtgctagtctctggattcacccttagtaagtattggatgaccgtgggtccgccaggctccggaggggaaggggcgtgggaggtgggtcgaccaaacaaataaaacgaaaggaacgaaaggtacaaagtaaaaaaccctagtaggtaggtactctaagggtacggaaccggtccgtaacttccaaccactcctaccgaagaacgaacaacgaaccaaagtaacttaccaattgtttatttagactaaaatcgaaacacgtccgtaggaggagggacggagcgacggtcgttagtattagtggtcgcgnggtagagtgttagtaacgtagttacttcttaacgaagtagngtagggtgttagtgngtttaagg

SEQ ID NO: 370790 - DNA, 681 bp, Homo sapiens
  misc_feature: GZ8MTXP01B6Q13.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggttttcctgttgttatttagaaggtgtcagtgtgaggtgcacttggtggagtctgggggagcttggtccaggccgggggggtccctgagactctcctgtgcgtagtctcgtggtacttcctaaccgttagtaagttagtggtatcggtaccgtcggggtcccgccgaggtcccgcggaagggggacgggcgtgggtaggtggggtacggaccaaacgtaaagtaaaacgaaaggaaccggtaagtacgaaaagtaaaacctagtggtacggtactcgtaggtaacggaacccgggactacttacccacctacttccaccgagaacgaaccgaaccggaaccaaagtaacttaccaagttgttatttacgaactaagtaacgaacgacgaccggtacggaaggaacgggacgggaacggaccggaaccgggtccggtagttagttaagttagttggcggaacgagagtagttagtaagtaggttacgttcttacgtaagtagtaagtaggtggttagtaagttaagttg

SEQ ID NO: 370791 - DNA, 588 bp, Homo sapiens
  misc_feature: GZ8MTXP01A5M7Z.15.67.G01.1.454.CMB.2.raw
  modified_base (332)..(332): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggaggtcggtgggggggggcttgggtccgaggccggggggtcctgagactctcctgtgcagtctctggattcacccttagaagttatggatgacctggtccgccaggctccgagggagggctggagngggtcggcaacaataaaacgaaaggacggaaagtcaaagaaaaactgtagtggactctgtagaacggcgatcaccatctaccagacgacaacgaccaaagaattacacttagtatttagacaaattgaaacagacctggaaggaggacgacgggacgacggtccgtagttattagttcgtgccgtgaagtattggtaattgtaacgtacttcgttagacgttaagagtaagggttgtagttacgtaagttgtttgg

SEQ ID NO: 370792 - DNA, 591 bp, Homo sapiens
  misc_feature: GZ8MTXP01CTH87.15.67.G01.1.454.CMB.2.raw
  modified_base (567)..(567): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggctttgggtccaggccgggggggtccctggagactctcctgtgcagtctctggattcacccttagaagtattggatgacctgggtccgcaggctccgaggggaaggctggagtgggtggccaaacataaaacgaaagacggaaagtacaaagaaaaaacctatagtggaactcgtaggtacgaaccgggccgtaattccaaccatcctaccaagacgaacaacggaccaaagaattcaacttgtatttgacaaatgaaacagccgtagagaggacgaggacgacggcgtagtatagttggcgcgaagagagtagaacgtaagtaattacgttcgttaacgaagtagnggtagggtagttagtgttaagttg

SEQ ID NO: 370793 - DNA, 606 bp, Homo sapiens
  misc_feature: GZ8MTXP01A0V8H.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcacccttagaagttattggatgacctgggtccgccaggctccgaggggaggggctgggagtggggtggaccaaacaataaacaaaagacggaaagtacaagaaaaaaccctatagtaggactcgtagtagaacggccgattccaccatcctaccagacgaacaacgacccaaagaacttcaactgtatttgacaaatagaaacagccgtagaggaggcgaggaccgacggccgtagtattagtgtcgcggtcgaagttgtagagttaacggtaagttacccttagttaccgtaaggtagaacggtaagggttggttagtcggttaagtttgg

SEQ ID NO: 370794 - DNA, 649 bp, Homo sapiens
  misc_feature: GZ8MTXP01CP1YO.15.67.G01.1.454.CMB.2.raw
  modified_base (389)..(389): a, c, t, g, unknown or other
  modified_base (623)..(623): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtgggggaggcgttggtccgagggcccggggggtccctgagactctcctgtgcagtctctggacttcacccttagaagtattggatgacctgggtcccgccaggctccgaggggaagggctgggagtgggtgaccaaacaataaaacgaaagacggaaagtacaaagaaaaaacctntaggtggaacttcgtaaggttaggaaccggccgtaattccgaaccatccctaccaagaacgaaccaaaccgacccaaagtaaacttacgtaacctttaggttaattttacgaacctaaaagttacgaaaccgaacgtccgtagggaaggacgggacgggaaaggaccgaccgggtccggtagttaattagttgtcgcgaacgagatgagtagtagacttcgaacgtaagtacgnggtaaggtggttaatgttaacgtttg

SEQ ID NO: 370795 - DNA, 554 bp, Homo sapiens
  misc_feature: GZ8MTXP01CEJFD.15.67.G01.1.454.CMB.2.raw
  modified_base (304)..(304): a, c, t, g, unknown or other
  modified_base (340)..(340): a, c, t, g, unknown or other
  modified_base (530)..(530): a, c, t, g, unknown or other
  modified_base (535)..(535): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcacccttagaagtatggatgactgggtccnccaggctcgaggggagggctggagtgggtggccaanataaacgaaagacggaaagtcaagaaaaacctatagtggactcgtagtcgaacggccgattcaccatctaccagagaacaacgaccaaagaattcaactgttatttagactaaatgaacagaccgtagaggaggcggaggacgacggaccgtgtattagttgtgcggcgagatgatagtgacttcttacngtagngaggtgttatcggaattgg

SEQ ID NO: 370796 - DNA, 552 bp, Homo sapiens
  misc_feature: GZ8MTXP01AQLNF.15.67.G01.1.454.CMB.2.raw
  modified_base (373)..(374): a, c, t, g, unknown or other
  modified_base (376)..(378): a, c, t, g, unknown or other
  modified_base (391)..(391): a, c, t, g, unknown or other
  modified_base (395)..(395): a, c, t, g, unknown or other
  modified_base (410)..(410): a, c, t, g, unknown or other
  modified_base (422)..(422): a, c, t, g, unknown or other
  modified_base (424)..(424): a, c, t, g, unknown or other
  modified_base (426)..(426): a, c, t, g, unknown or other
  modified_base (428)..(428): a, c, t, g, unknown or other
  modified_base (475)..(475): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgtttattttagaaggtgtccagtgtgaggtgcacttggtggagtcgtggggggaggcgttggtccgagggcccgggggggtccctgacgactctcctgtgcagtctctggtattcaccttagaagtatggatgaccgtggtccgcaggctccgaggggagggctgggagtcgggcgacgacaagtaacgagagtagcagaaactgnngnnngagcgacgctacncacncacagacacacacanatatatatatananananacacgacgagagacgacgacgacgacgtacgtagtagttgtagtcgngaacggtagagtagagtaacgtaacgttacgttacgttacgtaagtagtaacggtaggtaggttagtaagttaagtg

SEQ ID NO: 370797 - DNA, 542 bp, Homo sapiens
  misc_feature: GZ8MTXP01A0BME.15.67.G01.1.454.CMB.2.raw
  modified_base (503)..(503): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccaggccgggggggtccctgagactctcctgtgcagtctctggattcacccttagaagtattggatgacctgggtccgccaggctccgaggggaagggggctgggagtgggtggccaacataaacaaagacggaagtacaagaaaaaacctatgtggactctgtgaacggccgattccaccatctaccagagacaacgaccaagaattcactgtatttgacaaatgaacagccgtagagaggcgaaggacacggccgtagtatattgtgcgcgagntgatagtagacgttcacaagtagcgaggtggatgaattg

SEQ ID NO: 370798 - DNA, 586 bp, Homo sapiens
  misc_feature: GZ8MTXP01ADDGZ.15.67.G01.1.454.CMB.2.raw
  modified_base (313)..(313): a, c, t, g, unknown or other
  modified_base (500)..(500): a, c, t, g, unknown or other
  modified_base (522)..(522): a, c, t, g, unknown or other
  modified_base (534)..(534): a, c, t, g, unknown or other
  modified_base (538)..(538): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtggggggagggctttgggtccgagggccgggggggtccctggacgactctcctgtgcagtctctggattcacccttagaagtattggatgacctgggtccncaggctccgaggggagggctggagtgggtggccaaacaataaacgaaagaacggaagtacaaagaaaaacctagtgtaggactcgtagttacgaacggtccgaattcacccatctaccgaagacgaaccaaccggaccaaagtaacttacaacttgtattttagaccaaatgaacagccgtaggagnggacgaggacacggccgtagtnttagtgtgccgngagnttcgagtagtacgacttcttacgaagtagcgaggtgatgttaacgttg

SEQ ID NO: 370799 - DNA, 570 bp, Homo sapiens
  misc_feature: GZ8MTXP01DTL2H.15.67.G01.1.454.CMB.2.raw
  modified_base (450)..(450): a, c, t, g, unknown or other
  modified_base (462)..(462): a, c, t, g, unknown or other
  modified_base (512)..(512): a, c, t, g, unknown or other
  modified_base (535)..(535): a, c, t, g, unknown or other
  modified_base (549)..(549): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttatttagaaggtgtccagtgtggaggtgcacgttggtggagtcgtgggggaggcttggtccgaggccggggggtcctgagactctcctgtgcagtctctggattcacccttagaagtattggatgacctgggtccgccaggctccgaggggaaggggctgggaggtgggtcggaccaaacaataaaacaaaagacggaaagtacaaagaaaaaacctatgtaggaactctagtagaacggccgattcaccaatctcagagacaacgccaagaattcaactntattgacaaatnaacagaccgtagagacggcgaagacgacggcgtagtattagttgtgcggngtagatagagtagtaagaccttnttaacgaagttagnagggtaggttatgttaagttg

SEQ ID NO: 370800 - DNA, 606 bp, Homo sapiens
  misc_feature: GZ8MTXP01D0X7J.15.67.G01.1.454.CMB.2.raw
  modified_base (306)..(306): a, c, t, g, unknown or other
  modified_base (392)..(392): a, c, t, g, unknown or other
  modified_base (578)..(578): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgtttattttagaaggtgtccagtgtgaggtgcacttggtggagtcgtggggggaggcttggtccagggcccggggggtccctgagacctctcctgtgcagtctctggattcacccttagagtatggatgacctgggtccncaggctccgaggggagggctgggaggtgggtggaccaaacaataaacaaaggacggaagtacaaagaaaaacctgtggtagacttntagtgaaccggccgacttccacctatctaccagagaacaacgaccaagtaattacacttgttatttgactaaatgaaacagccgtaggaggagggacgaggaacgacggtcgtagttatttagttggtggtcgaaggtagagtgttaagttaagtaacgttaacgttccttaaacgtaaggtacgngtaaggggtgttaagttgttaagtttgg

SEQ ID NO: 370801 - DNA, 533 bp, Homo sapiens
  misc_feature: GZ8MTXP01EGCKT.15.67.G01.1.454.CMB.2.raw
  modified_base (305)..(305): a, c, t, g, unknown or other
  modified_base (486)..(486): a, c, t, g, unknown or other
  modified_base (516)..(516): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggggttttccttgttgttattttagaaggtgtccagtgtgaggtgcacttggtggagtcgtggggggaggcttgggtccaggccgggggggtccctgagactctcctgtgcagtctctggattcacccttagaagtatggatgactgggtccncaggctcagggagggctggagtgggtggcaacataaacaaagacggaagtcaagaaaaaacctatgtaggactctagtgaacggcgattcacatctcagagacaacgcaaagaattcaactgtatttgacaaatgaacagaccgtgagaggacgaggacacggcgtagtattattgtgcgngagatgatagtagacgttcttacaagtagnaggtggttatgaagttg

SEQ ID NO: 370802 - DNA, 605 bp, Homo sapiens
  misc_feature: GZ8MTXP01A2RVZ.15.67.G01.1.454.CMB.2.raw
  modified_base (353)..(353): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttggtccgagggcccgggggggtccctgagactctcctgtgcagtctctggattcacccttagaagttattggatgaccgtgggtccgccgaggctccgaggggaagggctgggagtgggtggaccaaanaataaaacgaaaggacggaaagtacaaagaaaaaacctgtaggtaggactcgtaggtacgaacgggccgaattccacctatctaccaagacgaacaaaccggaccaaagtaaacttcaacttgttaatttagactaaatagaaacacgccgtaggaaggagggacgaaggaccgacggtccgtaggtattagtgtagcggaagagatgagtagtacgacgttcacgaagtagcgagggtgttatgaagtttg

SEQ ID NO: 370803 - DNA, 606 bp, Homo sapiens
  misc_feature: GZ8MTXP01B3BS8.15.67.G01.1.454.CMB.2.raw
  modified_base (394)..(394): a, c, t, g, unknown or other
  modified_base (543)..(543): a, c, t, g, unknown or other
  modified_base (561)..(561): a, c, t, g, unknown or other
  modified_base (581)..(581): a, c, t, g, unknown or other
  modified_base (592)..(592): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggtcgttggtccgaggcccgggggggtccctgagactctcctgtgcagtctctggattcacccttagaagtattggatgacctgggtccgccgaggctccgaggggaaggggcgtgggaggtgggtgggaccaaacaactaaaacaaaggaacggaaagtcaaagaaaaaccctntagtggactctgtagaacggccgattcaccatctccagacgacaacgaccaagaacttcacttgttaatttgacaaagtcgaaacacgtaccgttgaagggaggacggagggaccggaccggtccggttagtatttagtcgttgccggngagagtgagtagggtaanacgttcttacgaaggtaagngtaggtggttntaagttaagtttgg

SEQ ID NO: 370804 - DNA, 589 bp, Homo sapiens
  misc_feature: GZ8MTXP01EIKIB.15.67.G01.1.454.CMB.2.raw
  modified_base (431)..(431): a, c, t, g, unknown or other
  modified_base (475)..(475): a, c, t, g, unknown or other
  modified_base (507)..(507): a, c, t, g, unknown or other
  modified_base (520)..(520): a, c, t, g, unknown or other
  modified_base (540)..(540): a, c, t, g, unknown or other
  modified_base (561)..(561): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacgttggtggagtcgtgggggaggcgttggtccgagggccgggggggtccctggacgactctcctgtgcagtctctggattcacccttagaagtattggatgacctgggtccgccaggctccgaggggaaggggcgtgggaggtgggtggaccaaacaataaaacgaaaggacggaaagtacaagaaaaaacctgtagtggactcgtagtagaacggcgattcaccatctcaganacaacgaccaagaatcgaacttgttatttgactaaatgaaacanccggtagaggaggcgaggacgcggcgtagttnttagttgtggcgngagatggttaagtaaggtanaacgttccgaacaaggttagngtagggtaggttacgtggttaagtttgg

SEQ ID NO: 370805 - DNA, 532 bp, Homo sapiens
  misc_feature: GZ8MTXP01DJU80.15.67.G01.1.454.CMB.2.raw
  modified_base (306)..(306): a, c, t, g, unknown or other
  modified_base (371)..(371): a, c, t, g, unknown or other
  modified_base (485)..(485): a, c, t, g, unknown or other
  modified_base (507)..(507): a, c, t, g, unknown or other
  modified_base (514)..(514): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccgaggccggggggggtccctgagactctcctgtgcagtctctggattcacccttagaagtattggatgactgggtccncagctcaggggagggctggagtgggtgccaaacataaacaaagacggaatcaagaaaaaccatgnggactctagtgaacggccgattacaccatctccagagacaacgccaaagaattcacttgtattgacaaatgaacagccgtagaggagacgaggacacggcgtgtattatgtgcngagatgatagtagacttcttanaagtagnagggtggttatgaacgtg

SEQ ID NO: 370806 - DNA, 558 bp, Homo sapiens
  misc_feature: GZ8MTXP01CY6B6.15.67.G01.1.454.CMB.2.raw
  modified_base (296)..(296): a, c, t, g, unknown or other
  modified_base (321)..(321): a, c, t, g, unknown or other
  modified_base (328)..(328): a, c, t, g, unknown or other
  modified_base (350)..(350): a, c, t, g, unknown or other
  modified_base (362)..(362): a, c, t, g, unknown or other
  modified_base (376)..(376): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (437)..(437): a, c, t, g, unknown or other
  modified_base (440)..(440): a, c, t, g, unknown or other
  modified_base (482)..(482): a, c, t, g, unknown or other
tcagtctacgtagccacgaccggtgctcgatttagagtatacatattgggtttgaggtctcagagaggagccttagccctggactccaaggccctttccacttggtgatcagcactgagcacagaggactcaccatggagttggggctgagcttgggttttccttgttgttattttagaaggtgtccagtgtgaggtgctacttggtggagtcgtgggggagcttggtccgaggccggggggtccctgagactctcctgtgcagtctctgattcaccttagatatgatgactggcncagctcgagggaggctggagtgggngacaaanaataaaacaaagacgaaagtanaagaaaaaactntagtgactctaagngaacggctattacaccatcacagagacaacgactaaagaatatactatattanaanaananaanacgacgagagagacgagacgacgacgtagtagttagttgtgngaagaagagtagttaagtaaagtaagttaacgttacttaacgtaagtaggaaggtaggtaggttagtaagttgttg

SEQ ID NO: 370807 - DNA, 596 bp, Homo sapiens
  misc_feature: GZ8MTXP01D6G2X.15.67.G01.1.454.CMB.2.raw
  modified_base (304)..(304): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccagggcccgggggggtccctgagactctcctgtgcagtctctggattcacccttagagtatggatgactgggtccncaggctccgaggggagggctggagtgggtggaccaaacaataaaacgaaagaaccggaagtacaaagaaaaaacctataggtggactcgtagtacggaaccgggccgtaatttacccaaccattcctacccgaagacgaaccaaccggacccaaagtaaacttcaacttgttaatttgacaaatgaaacagccgtagagaggcgaggaccgacggcgtagtattatgtgcgaacgagatggataggtaagacgttcttaacgaagtaagcgtaaggtggttatggaatttgg

SEQ ID NO: 370808 - DNA, 546 bp, Homo sapiens
  misc_feature: GZ8MTXP01ES6BU.15.67.G01.1.454.CMB.2.raw
  modified_base (303)..(303): a, c, t, g, unknown or other
  modified_base (335)..(335): a, c, t, g, unknown or other
  modified_base (391)..(391): a, c, t, g, unknown or other
  modified_base (434)..(434): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggattttccttgttgttattttagaaggtgtccagtgtgaggtgcacttggtggagtcgtgggggaggcttggtccaggccgggggggtcctgagactctcctgtgcagtctctggattcacccttagaagttatggatgacctgggtccncagctcgagggagggctggagtgggtgccaanataaacaaagacggaagtacaagaaaactatgtgactctgtgacgccgattcaccntctcagagacaacgccaaagattacacttgtatttgactaaancgaacaggccgtagagaggcgagacgacggccgtgtacttagttggtgcgcggagacgttgagtaaggttacgacttctaacgagttaacgcgagggttggtaattggtaag

SEQ ID NO: 370809 - DNA, 559 bp, Homo sapiens
  misc_feature: GZ8MTXP01CXUYD.15.67.G01.1.454.CMB.2.raw
  modified_base (419)..(419): a, c, t, g, unknown or other
  modified_base (424)..(424): a, c, t, g, unknown or other
  modified_base (458)..(458): a, c, t, g, unknown or other
  modified_base (495)..(495): a, c, t, g, unknown or other
  modified_base (502)..(502): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggcccggggggggtccctggagactctcctgtgcagtctctggattcacccttagaagtattggatgacctgggtccgccaggctccgaggggagggcgtggaggtgggtggccaacaataaacgaaagacggaagtcaaagaaaaaccctgtagtggactctaggtgaacggccgattcaaccatcncaganacaacgaccaagattcactgtatttgacaaatanaaacagcctaggagaggcgagacgacgcgtagtattnttagggngcgcgagttagtagagttagtagacgttcgagtaagtagcgtaggtgttatgttgtg

SEQ ID NO: 370810 - DNA, 578 bp, Homo sapiens
  misc_feature: GZ8MTXP01CY99M.15.67.G01.1.454.CMB.2.raw
  modified_base (396)..(396): a, c, t, g, unknown or other
  modified_base (431)..(431): a, c, t, g, unknown or other
  modified_base (439)..(439): a, c, t, g, unknown or other
  modified_base (531)..(531): a, c, t, g, unknown or other
  modified_base (553)..(553): a, c, t, g, unknown or other
  modified_base (559)..(559): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttccttgttgttattttagaaggtgtccagtgtgaggtgcacttggtggagtcgtgggggaggcgtttggtccgagggcccgggggggtccctgacgactctcctgtgcagtctctggacttcacccttagaagttattggatgaccgtgggtccgccaggcctccgaggggaaggggctgggaggtggggtggaccaaacaataaaacaaagaccggaaagtcaaagaaaaaaccctntagtggaactctaagtgaacggccgaattcaccanctacaganacaacgaccaagaattacacttgtatttgacaaatgaacagaccgtgaaggaggacgaggacgacggcgttagtattagttgtgcgtgaagntgagtacgtagacttcttacgngtacgngaggtggttatgaacgttg

SEQ ID NO: 370811 - DNA, 590 bp, Homo sapiens
  misc_feature: GZ8MTXP01EPL41.15.67.G01.1.454.CMB.2.raw
  modified_base (568)..(568): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggaggtcgtgggggaggcttggtccaggccgggggggtccctgagactctcctgtgcagtctctggattcacccttagaagttattggatgaccgtgggtccgccaggctccgaggggaaggggctgggaggtgggtggaccaacgaataaaacgaaagacggaaagtacaagaaaaaacctatagtggactcgtagtacgaaccgggccgattccacctaatcctccgaagacgacaacgaccaaagaattcaactgttaatttgacaaatgaaacagccgtagaggacgggacgaggacacggccgtagtattattgtagcggcgagttatagagtaggtaagacttgttaacaaggtacgngtagggtggttatgttaagttg

SEQ ID NO: 370812 - DNA, 585 bp, Homo sapiens
  misc_feature: GZ8MTXP01A9KEF.15.67.G01.1.454.CMB.2.raw
  modified_base (346)..(346): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggccgggggggtccctgagactctcctgtgcagtctctggattcacccttagaagtatggatgacctgggtccgccaggctccgaggggaaggggctggagtgggtggccaaanataaacaaagacggaaagtacaagaaaaacctatgtggactcagtgaacgccgattcaccatctcagacgacaaacgacaaagaattcaactgttatttgacaaatgaaacagccgtaggaggaggacggaacggaccgtacgggaccgttagttagttaagttgttcggcggtggagttagtgaagtacggtagaacgttcttacgaagttagcgaaggggttgttagtgttaagttg

SEQ ID NO: 370813 - DNA, 679 bp, Homo sapiens
  misc_feature: GZ8MTXP01DFJ7V.15.67.G01.1.454.CMB.2.raw
  modified_base (340)..(340): a, c, t, g, unknown or other
  modified_base (346)..(346): a, c, t, g, unknown or other
  modified_base (379)..(379): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtgggagtcgtggggggaggcgtttgggtccgaggccgggggggtccctgagactctcctgtgcagtctctggattcacccttagaagtattggatgaccgtgggtcccgcaggctcgaggggagggctggagtgggngccaanaataaacaaagacgaagtcaaagtaaaaacctntagtgactgtaagtgaacggcagttcaccatctcagacgacaacgacaagaattcaactgttatttgaacaaagtacgaaactacgaccggttaggaaggaacggggacgaaacgggaccgtaaccggggtacccgtttagggttaactttaaggtttggtacggtaccggtaacggaaggttaagttaccgggttaaagttaaagggttaacggttaacccgttgttaaaccggaagggtttaaaggtaaccgggttaagggggttagggttaggttaacggtttaaagttttccgggg

SEQ ID NO: 370814 - DNA, 565 bp, Homo sapiens
  misc_feature: GZ8MTXP01EZNDT.15.67.G01.1.454.CMB.2.raw
  modified_base (308)..(308): a, c, t, g, unknown or other
  modified_base (513)..(513): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgagggcccgggggggtccctggagactctcctgtgcagtctctggattcacccttagaagtatggatgacctgggtccnccaggctccgaggggagggcgtggagtgggtggaccaaacaataaaacgaaagacggaaagtacaaagaaaaacctagtgtggactcgtagtagaacggcgattccacatcacagagacaacgccaaagattcactgttattgacaaatgaaacagccgtaggaaggagggacgaggaccgacggccgtaggtattagtgtgcgnagatgagtagtacgacttcttacgaagtagcgtagggtgttagtgaagtttg

SEQ ID NO: 370815 - DNA, 592 bp, Homo sapiens
  misc_feature: GZ8MTXP01DGWSN.15.67.G01.1.454.CMB.2.raw
  modified_base (541)..(541): a, c, t, g, unknown or other
  modified_base (574)..(574): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattcacccttagaagttatggatgacctgggtccgccaggctccgaggggaaggggctgggaggtgggtgggaccaaacaataaaacgaaaggaacggaaagtacaaagaaaaaacctataggtaggactccgtaggtacgaaccgggccgaattaccaacccactactaccagaacgaacaaacgaccaaagaaattacaactagttatttagacaaaatgaaacagacctagaggaggcgaaggacacggccgtagtattattgtgcgngagatgaagtagtagacttcttaacgaagtagngaggtggttatgaagttg

SEQ ID NO: 370816 - DNA, 581 bp, Homo sapiens
  misc_feature: GZ8MTXP01EKBAU.15.67.G01.1.454.CMB.2.raw
  modified_base (434)..(434): a, c, t, g, unknown or other
  modified_base (532)..(532): a, c, t, g, unknown or other
  modified_base (560)..(560): a, c, t, g, unknown or other
  modified_base (567)..(567): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacgttggtggagtcgtggggggagtcgttgggtccgacgggcccggggggtccctgacgactctcctgtgcagtctctggtattcacccttagaagtatggatgaccgtgggtccgccgaggcctccgaggggaaggcgtggaggtgggtgaccaaacaataaaacgaaagaaccggaaagtacaaagtaaaaacctatgtagactcgtagagaacggcgtattcaccatcctcaganacaacgaccaagaactcaacttgttatttgacaaagtgaaactacgccgtaggaggacggacgacggacgacggccgttagttattagtgtgcgaagngagtgacgtagtagacttcagtaagagngtaaggngttatgttaagttg

SEQ ID NO: 370817 - DNA, 590 bp, Homo sapiens
  misc_feature: GZ8MTXP01EWHCZ.15.67.G01.1.454.CMB.2.raw
  modified_base (379)..(379): a, c, t, g, unknown or other
  modified_base (525)..(525): a, c, t, g, unknown or other
  modified_base (532)..(532): a, c, t, g, unknown or other
  modified_base (549)..(549): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagtatggatgacctgggtccgcaggctccgaggggaagggctgggagtgggtggccaaacaataaacgaaagacggaagtacaaagaaaaaacctntagtggaacttcgtagtagaaccgggtccgaattcaaccattccaccaagacgaacaaacggacccaaagtaacttcaacttgttattagacaaaatgaaacagcctaggaacgaggcgaaggcacggtcgtagtattagttgcgngcgaagntagttaagtacggtaanacttcttacgtaagtagaagagggtggttatgaagtttcgg

SEQ ID NO: 370818 - DNA, 660 bp, Homo sapiens
  misc_feature: GZ8MTXP01ACUXE.15.67.G01.1.454.CMB.2.raw
  modified_base (364)..(364): a, c, t, g, unknown or other
  modified_base (580)..(580): a, c, t, g, unknown or other
  modified_base (591)..(591): a, c, t, g, unknown or other
  modified_base (632)..(632): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggaggtcggtggggggaggtcgttgggtccgagggccggggggtccctgagactctcctgtgcagtctctggattccacccttagaagttatggatgaccgtgggtccgccgaggcctccgagggggaaggggctgggaggtggggtacggaccaaanaataaaacgaaaggacggaaagtcaaagaaaaaaccctgtaggtaggaacttcgtaggtacgaaccggggccctaattaccaccctatcctaccaaggaacgaaccaaaccggacccaaagtaactttacacttagttaatttgaaccaaaattagaaacacgaccgtaggaaggagggacgaggaccgacgggccgttagtagtttagtgtcggngtcggaagttntaggaacgttaaggtaacgaccttcttaacgtaaggtacgnggtaagggtggttaatggttaactttgg

SEQ ID NO: 370819 - DNA, 548 bp, Homo sapiens
  misc_feature: GZ8MTXP01D1CQH.15.67.G01.1.454.CMB.2.raw
  modified_base (412)..(412): a, c, t, g, unknown or other
  modified_base (417)..(417): a, c, t, g, unknown or other
  modified_base (499)..(499): a, c, t, g, unknown or other
  modified_base (513)..(513): a, c, t, g, unknown or other
tcagtctacgtagccacgaccggtgctcgatttagagtatacatattgggttttgaggtctcagagaggagccttagccctggactccaaggcctttccacttggtgatcagcactgagcacagaggactcaccatggagttggggctgagctggggttttccttgttgttattttagaaggtgtccagtgtgaggtgcacttggtggagtctggggggaggcttggtccagccgggggggtccctgagactctcctgtgcagtctctggattcacccttagaagtattggatgacctgggtccgccaggctccaggggaggggctggagtgggtggccaacataaacaaagacggaaagtcaagaaaaaccctatgtaggactccgtagtgaaccggccgattcaccatcncaganacaacgccaagaattacactcgtatttgacaaatgaaacagccgtgagaggacgaggacacggccgtagtattatgtgcgcngatgagtaaggtanacgttcttacgaagtagcgaggtggttatgcgttg

SEQ ID NO: 370820 - DNA, 671 bp, Homo sapiens
  misc_feature: GZ8MTXP01ENKFU.15.67.G01.1.454.CMB.2.raw
  modified_base (391)..(391): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccagggccgggggggtccctgagactctcctgtgcagtctctggattcaccttagaagttatggatcgaccgtgggtccgccgaggctaccgaggggaagggcgtgggaggtgggtcggaccaaacaataaaacgaaaggacggaaagtacaaagaaaaacctntagtaggactcgtaggtacgaacggccgtattccaccatcctaccagacgaacaacgaccaaagtaaacttctaacgttagttaatttacgaacaaaagtacgaaaacacggacccgttagggaaggaacgggacggaacgggaaacccgacggggtacccgttaggtaactttaagttcggtggccggaacggaaagttagtaggaaagttaaaggtaacgaacgttcttaaacgtaaggtagaaggtaagggttaggttagttaagggttaactttgg

SEQ ID NO: 370821 - DNA, 720 bp, Homo sapiens
  misc_feature: GZ8MTXP01A9TQA.15.67.G01.1.454.CMB.2.raw
  modified_base (311)..(311): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgtttattttagaaggtgtccagtgtgaggtgcacttggtggagtcgtgggggaggcttggtccgacgggccggggggtccctgagactctcctgtgcagtctctggacttcacccttagaagtattggatcgacctgggtcccncaggctccgaggggacgggctgggagtggggtcggaccaaacaaataaaacgaaaggaacggaaagtacaaaggtaaaaaacccttgtaggtacggaacttccgtaggtacggaaccggcccgtaaatttcccaacctatcctacccaaagacgaaccaaaccgacccgaaagtaaacttactaaacgttaggtttaactttaggaaacctaaaagttacggaaaaccgacggtacccggtaggggaaacgggaacggggaccgggaaacgggaaccgaccggggtacccggttaaggttaacgtttaagtttcggtcggccggtaacggaaggttagttacgggaattaaaggtaacgttaccttacgttaacaaggttagcgtaagggtgttagtgttaagtttcgg

SEQ ID NO: 370822 - DNA, 591 bp, Homo sapiens
  misc_feature: GZ8MTXP01ARB70.15.67.G01.1.454.CMB.2.raw
  modified_base (471)..(471): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggccgggggggtccctgagactctcctgtgcagtctctggattcacccttagaagttattggatcgacctgggtccgcaggctccgaggggaagggctgggagtggggtggaccaacaataaacgaaagacggaagtcaagaaaacctagtgtgactcgtagtacgaacggccgtattccaccatctaccagacgacaacgccaaagaacttcaactgttatttgacaaagtagaaacngaccgtgaaggacgggacgaggacgacggtccgtagtattagtgtcggcgaagagatagagttaaggtagacgttcttaacgaaggttagaacgtagggtggttaatggttaacgtttgg

SEQ ID NO: 370823 - DNA, 704 bp, Homo sapiens
  misc_feature: GZ8MTXP01ARHX8.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccagggccggggggtccctgagactctcctgtgcagtctctggattcacccttagtaagttattggatgacctgggtccgcgaggctccgaggggaagggcgtggaggtggggtgaccaacaataaaacgaaaggaacggaaagtacgaaaggtaaaaaacctagtagtacggtaactcgtaaggtacggaaccggaccgaatttaccaaccctatcctaccaagaacgaacaaaccgaccaaagtaaacttactaacgttagttaatttacgaaccaaaagtaacgaaacgacggtacccggtaggaagggaacgggaccggaaacggggaacccgtaaccgggcccggtttagttaacgtttaaggttaggttcgccggaacggtaggaagttacgaaagttaaggtaacgttaccgttaccgttaacggtaagtacgtaacggtagggttaggttaagttcggttaagttttgg

SEQ ID NO: 370824 - DNA, 597 bp, Homo sapiens
  misc_feature: GZ8MTXP01D7SLD.15.67.G01.1.454.CMB.2.raw
  modified_base (574)..(574): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccggggggtccctgagactctcctgtgcagtctctggattcacccttagaagtattggatgaccgtgggtcccgccgaggctccgaggggagggctgggagtgggtggaccaacaataaacgaaagacggaagtacaaagaaaaacctgtgtagactctagtagaacggccgtattaccaccatctaccgaagacgaacaaacgaccaaagtaacttcaactttgttaatttgactaaaagtgaaacacggccgtaggacggaagggcggaaagggaccgacgggtccgtagttattagttgtgcggcgagatgaataggtagacttcttaacgaagtagngtagggtagttagtgttaagttg

SEQ ID NO: 370825 - DNA, 567 bp, Homo sapiens
  misc_feature: GZ8MTXP01AQKKF.15.67.G01.1.454.CMB.2.raw
  modified_base (384)..(384): a, c, t, g, unknown or other
  modified_base (387)..(387): a, c, t, g, unknown or other
  modified_base (463)..(463): a, c, t, g, unknown or other
  modified_base (506)..(506): a, c, t, g, unknown or other
  modified_base (510)..(510): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggattcacccttagaagtattggatgacctgggtcccgccaggcctccgagggggaggggctgggaggtgggtggaccaacaataaacgaaaggacggaagtacaagaaaaacctntgnggactcaggtcgaacggccattccaccatcctcagacgacaacgaccaagaattcactgtatttgacaaatagaanagccgaggaggaggacggaggacgacggccgtagtattatggngcgngagatgagtagtagacgttcttaacgaaggtagcggtaggtggttatgttaagttgg

SEQ ID NO: 370826 - DNA, 592 bp, Homo sapiens
  misc_feature: GZ8MTXP01B98F4.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttggtccgagggccgggggggtccctgagactctcctgtgcagtctctggattcacccttagaagtattggatgacctgggtccgccaggctccgaggggaaggggcgtgggaggtggggtgggaccaaacaataaaacgaaagaacggaaagtacaagaaaaaaccctatagtggactctagtagaacggccgattccaccatcctaccagacgacaacgaccaaagaattcacttagtatttgacaaatagaacagaccgtagaggaggacggaggacgacggccgtagtattagttagtgcggcgagataggagttaagtagacttcgttacgtaagtagcgtagggtggttatggttgtttaagg

SEQ ID NO: 370827 - DNA, 567 bp, Homo sapiens
  misc_feature: GZ8MTXP01A1A4E.15.67.G01.1.454.CMB.2.raw
  modified_base (345)..(345): a, c, t, g, unknown or other
  modified_base (382)..(382): a, c, t, g, unknown or other
  modified_base (515)..(515): a, c, t, g, unknown or other
  modified_base (520)..(520): a, c, t, g, unknown or other
  modified_base (530)..(530): a, c, t, g, unknown or other
  modified_base (536)..(536): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcacccttagaagtattggatgacctgggtccgcaggctccgaggggaaggggctggagtgggtggccaaanataaaacaaaggacggaaagtacaataaaaaaccctntagtaggactcgtagtacgaacggccgattccacctatcctaccagacgacaacggtaccaaagaacttcactgtatttgacaaatgaacagcctagagaggacgaggacacgggccgtagtattatgtgcgngaagntgataggtanacgttnacaagtagcgtaggtggttatggttaacttg

SEQ ID NO: 370828 - DNA, 583 bp, Homo sapiens
  misc_feature: GZ8MTXP01B7IG9.15.67.G01.1.454.CMB.2.raw
  modified_base (300)..(300): a, c, t, g, unknown or other
tcagtctacgtagccacgaccggtgctcgatttagagtatacatattgggtttgaggtctcagagaggagccttagccctggactcccaaggcctttccacttggtgatcagcactgagcacagaggactcaccatggagttggggctgagctgggttttcctgttgttattttagaaggtgtccagtgtgaggtgcacttggtggagtctggggggagcttggtccaggccgggggggtccctgagactctcctgtgcagtctctggattcacccttagaagtatggatgacctggtcncaggctccagggaggctggagtgggtggccaacataaacaaagacggaatcaagaaaaaacccctgtgtaggactcgtagtcgaacgggccattcacctatctaccagagacaacggccaaagaattcacgtgtatttgacaaatgaacagctgagtagcgaggcacggccgtaggtattagtgttcggcgcggtaagagttgaaccgttaagggttacgaaccgttcttaaccgtaagttaaacggccgttagggtagggttaccttaagggaacctttggg

SEQ ID NO: 370829 - DNA, 673 bp, Homo sapiens
  misc_feature: GZ8MTXP01BQA2I.15.67.G01.1.454.CMB.2.raw
  modified_base (647)..(647): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggaggtcgtgggggaggcgttggtccgaggcccgggggggtccctgagactctcctgtgcagtctctggtattcacccttagaagttattggatgaccgtgggtcccgccgaggcctccgaggggaacggggctgggagtggggtggaccaaacaataaaacgaaaggaacggaagtacaaagtaaaaacctagtggtaggactcgtaagtacggaacgggccgtaaacttccgaaccacttacctccaaaggacgaaccaaaccggacccaaaagtaaacttacaacttaggttaatttacgaacaaaacttagaaacgaacggccgtaaggaacgggaacggacggaacgggaaccgaccgggtaccggttaggttattaagtttggtacggtcggaacggtagagtgttagtaagtagttacttcgttaacgtaagtacgngtagggtagggttactgttaagtttg

SEQ ID NO: 370830 - DNA, 570 bp, Homo sapiens
  misc_feature: GZ8MTXP01A3187.15.67.G01.1.454.CMB.2.raw
  modified_base (307)..(307): a, c, t, g, unknown or other
  modified_base (380)..(380): a, c, t, g, unknown or other
  modified_base (383)..(383): a, c, t, g, unknown or other
  modified_base (537)..(537): a, c, t, g, unknown or other
  modified_base (554)..(554): a, c, t, g, unknown or other
  modified_base (567)..(567): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttatttagaaggtgtccagtgtgaggtgcacttggtggagtcgtggggggaggctttgggtccaggcccgggggggtccctgagactctcctgtgcagtctctggattcacccttagaagtattggatgactgggtccncaggctccgaggggagggctggagtggggtggaccaacaataaaacaaagacggaaagtacaagaaaaacctntgnggactcgtagtgaacggcgattccaccatctaccagacgacaacgccaaagaattcacttagtatttagacaaaatgaaacacgcctaggaaggacggacggaaggaccgaacgggccgttagtattagttgtggcgcgagatggatacggtanacttcttacaagtaggngtaggtgttatgngtg

SEQ ID NO: 370831 - DNA, 559 bp, Homo sapiens
  misc_feature: GZ8MTXP01DLNV9.15.67.G01.1.454.CMB.2.raw
  modified_base (419)..(419): a, c, t, g, unknown or other
  modified_base (501)..(501): a, c, t, g, unknown or other
  modified_base (505)..(505): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggcccgggggggtccctgagactctcctgtgcagtctctggattcacccttagagtattggatgacctgggtccgccaggctccgaggggaagggcgtgggaggtgggtggccaacaataaacaaagacggaagtacaagaaaaacctatagtggactctgtagaacggccgattcaccatctcaganacaacgccaaagattcactgtatttgacaaaatgaaacagccgtagaggaggacggaggacgacggccgttagtattattgngcgnggagatgagtagtagttaacttcttactaagtagcgaggtggttatgaagttcg

SEQ ID NO: 370832 - DNA, 584 bp, Homo sapiens
  misc_feature: GZ8MTXP01BLLA6.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggccgggggggtccctgagactctcctgtgcagtctctggattcacccttagaagtatggatgacctgggtcccgccgaggcctccgaggggaaggggcgtgggagtggggtggccaacaataaacgaaagacggaaagtacaagaaaaacctgtgtagggacttcgtaagtagaacggccgattcaccatctcagacaacaacgacaagaattcaacttgtatttagacaaatggaaacacgccgtaggaaggacggacgagggacacgggcgtaggtattagttgcgtcgcgagatagagtaggtagttacttcttacaagtagaacgtagggtggttatcggttaattgg

SEQ ID NO: 370833 - DNA, 578 bp, Homo sapiens
  misc_feature: GZ8MTXP01BIDRD.15.67.G01.1.454.CMB.2.raw
  modified_base (308)..(308): a, c, t, g, unknown or other
  modified_base (347)..(347): a, c, t, g, unknown or other
  modified_base (386)..(386): a, c, t, g, unknown or other
  modified_base (423)..(423): a, c, t, g, unknown or other
  modified_base (428)..(428): a, c, t, g, unknown or other
  modified_base (466)..(466): a, c, t, g, unknown or other
  modified_base (517)..(517): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttcttgttgttattttagaaggtgtccagtgtgaggtgcacttggtggagtcgtggggggaggcttgggtccaggcccgggggggtccctggagactctcctgtgcagtctctggattcacccttagaagtattggatgacctgggtccncaggctccgaggggagggctgggaggtgggtggaccaanataaacgaaagacggaaagtcaaagaaaaaacctgtagnggactcgtagtacgaacgggcctattaccaccatccncaganacaacgccaaagattcactgttatttgacaaatgaaanagacctggaggaggacgaggacgtacgggcctaggtattagttgtagcggngtagattgagtaagtagttacgttcacgaagttagcgtaggggttgaagttgaacgtttgg

SEQ ID NO: 370834 - DNA, 804 bp, Homo sapiens
  misc_feature: GZ8MTXP01C6T9G.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccaggccgggggggtccctgagactctcctgtgcagtctctggacttcacccttagaagttatggatgacctgggtccgcaggctccgaggggaaggggcgtggaggtggggtcggaccaaacgaataaaacgaaaggaaccgggaaagtacgaaagtaaaaaacctagttaggtgggtaactcgtaacggttacggaaccgggcccgtaatttccaaccctatacctaccgaaacgaggaaccaaaccggacctaaaggtaaacttactaacgtttagtttaattttacggaacctaaaaagttacgaaaaccgtacggtaccccggttaacggaaggggaaacggggacgggaaaccggggaacccggaacccgggggtacccggtttaacggttttaaacgttttaaaggttttgggtttcggggacccgggtaacggtaaagggttaagttacgggttaaacgtttaaagggttaaacggttaacccgttttaacgttaaacccgttaaacggggtaggttaaccgggttaagggggttagggtttaaacgttaagggttaacgttttttaaggg

SEQ ID NO: 370835 - DNA, 586 bp, Homo sapiens
  misc_feature: GZ8MTXP01AOXBX.15.67.G01.1.454.CMB.2.raw
  modified_base (350)..(350): a, c, t, g, unknown or other
  modified_base (530)..(530): a, c, t, g, unknown or other
  modified_base (565)..(565): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgtttattttagaaggtgtccagtgtgaggtgcacttggtggagtcgtgggggaggcttgggtccgaggccgggggggtccctgagactctcctgtgcagtctctggattcacccttagaagtattggatgacctgggtaccgccaggctccgaggggaagggctgggaggtgggtcggccaaanaagtaaaacgaaagacggaaatcaaaggaaaaaaccctgtgtagactctagtacgaacggcgattcacctatctaccagacgaacaacggccaaagacttacactgttatttagacaaatacggaacagccgtaggaaggaggcggaacggacgacgggccgttgtattgttagtgccgngagagtgagtagtagaccttcacgaagttaacggngtagggtgttagtgttcgttg

SEQ ID NO: 370836 - DNA, 635 bp, Homo sapiens
  misc_feature: GZ8MTXP01DIERJ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgtttattttagaaggtgtccagtgtggaggtgctacgttgggtgggaggttcggtggggggagggtcgtttgggtcccgagggcccgggggggtccctggagtactctcctgtgcagtctctggattcacccttagaagttattggatggacctgggtccgccaggctccgaggggagggctggagtgggtggaccaacaataaacaaagaacggaagtcaaagaaaaacctatagtggaactcgtagtagaaccgggccgtaatccgaccatctaccagacaacgaacgacaaagaattacacttagtatttgaactaaatagaaacagccgtaggaaggacggacgaagggaccgacgggtccgttagttaagtttagttacggtcgtggtaacggaagttagtagagttaaggtacgttacgttcttaacgtaagtaagtcgtaggtggttatggttaatttcgg

SEQ ID NO: 370837 - DNA, 536 bp, Homo sapiens
  misc_feature: GZ8MTXP01BBDW0.15.67.G01.1.454.CMB.2.raw
  modified_base (344)..(344): a, c, t, g, unknown or other
  modified_base (374)..(374): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggattttccttgttgttattttagaaggtgtccagtgtgaggtgcacttggtggagtcgtggggggaggcttgggtccgaggccgggggggtccctgagactctcctgtgcagtctctggattcacccttagaagttatggatgacctgggtccgccaggctccgagggaggggctggagtgggtgcccaanataaacaaagacggaagtacaagaaaactntgtggactctgtgaacggccgattcacatctccagacacaacgccaagatacactgtattgacaaatgaacaggcctgagaggcgaggacacggccgtgtattagtgtgcgcgaggattgaatagagcttactaacaggtgcgagggttggtaagttgtaag

SEQ ID NO: 370838 - DNA, 651 bp, Homo sapiens
  misc_feature: GZ8MTXP01DEQ0H.15.67.G01.1.454.CMB.2.raw
  modified_base (343)..(343): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctctgtgcagtctctggattcacccttagaagtattggatgacgtggtccgcaggctccgaggggaagggctgggagtgggtcggaccaanaataaaacgaaaggacggaaagtacaaaggtaaaaaacctagtaggtagggaaccttcgtaaggttggaacccggcccgtaaatttaccaaccactcctacccaaagaacgaactaaaccggaccctaaaagaacttacaaccttaggttaatttcgaacttaaaacgtaacgaacgacgacggtaggaggacggacggaacggacggacggtacggtagttagttagttagtcgcgcgagagtagttagtaagtaacgttacgttacttacgtaagtagtaacgtaggtaggttagtaagttaagtg

SEQ ID NO: 370839 - DNA, 587 bp, Homo sapiens
  misc_feature: GZ8MTXP01E37DZ.15.67.G01.1.454.CMB.2.raw
  modified_base (582)..(582): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagtatggatgacctgggtcccgccaggctccgaggggaagggggcgtgggaggtgggggtggacccgaaacaataaaaccgaaaaggaacggaaagtacgaagaaaaaacctagtagtggactcgtaggttggaaccggccgattccaccatctaccagagaacaacgacccaaagaattcactgtatttagacaaatagaacagcccgtagaggacgggacggaaggaccgacgggcccgtagttaattagttgtgcggcgaagatgataggtagacttcacaagtagcgaggtggatgngtttg

SEQ ID NO: 370840 - DNA, 625 bp, Homo sapiens
  misc_feature: GZ8MTXP01CL6KG.15.67.G01.1.454.CMB.2.raw
  modified_base (441)..(441): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacgttggtggagtcgtgggggaggcgttgggtccgagggcccgggggggtccctggagactctcctgtgcagtctctggattcacccttagaagttattggatgaccgtgggtccgccgaggctccgaggggaaggggctggggagtggggtgaccaaagaaataaaaccgaaagacggaaagtcaaagtaaaaaaccctagtgtaggaactcgtaagttacggaaccggccgtaattccaaccntcctaccaagaacgaacaaaccggaccaaagaacttcaacttagttaatttagactaaaatagaaacagccgtaggaaggaggacgaggaaccgacggtccgttagtatttagtgtcgcgcgagatagagtaagagttacttcgttaacaaggtagaacgtaggggtgttagtgttgtttaagg

SEQ ID NO: 370841 - DNA, 578 bp, Homo sapiens
  misc_feature: GZ8MTXP01CFVNP.15.67.G01.1.454.CMB.2.raw
  modified_base (307)..(307): a, c, t, g, unknown or other
  modified_base (352)..(352): a, c, t, g, unknown or other
  modified_base (387)..(387): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacgttggtggagtcgtgggggaggcgttggtccgagggcccgggggggtccctgagactctcctgtgcagtctctggattcacccttagaagtatggatgacctgggtccnccaggctccgagggggaaggggctgggaggtggggtggaccaaanaataaaacaaagacggaaagtacaagaaaaacctntgtggactctagtcgaacggccattcaccatctaccagacgacaaccgaccaaagaattacacttagttatttagactaaaatgaaacagccgtagaaggaggacggaggacgacggcgtagtattagttgtgcgaacggagatgaattagtagacgttcttacgaagtagcgaggtggttatggaatttg

SEQ ID NO: 370842 - DNA, 685 bp, Homo sapiens
  misc_feature: GZ8MTXP01ETKD8.15.67.G01.1.454.CMB.2.raw
  modified_base (304)..(304): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctgagactctcctgtgcagtctctggattcacccttagaagtatggatgacctgggtccncaggctccgaggggagggcgtggagtgggtgaccaacaagtaaaacaaagacggaagtacaagaaaaaacctgtgtagggactcgtaggtacgaacggccgaattccgaccagttccaccgaagaacgaacaaaccgacccaaagtaaacttctaaccgtagttaacttttggaactaaaagttacgaaacgacgacccgttaggaaggaacgggcgggaaacgggaaccgaaccggggtcccggttaggttaagtttaagttgggttcggcggcgggtaagttaaggttcggttaaagttagggtaacgttaaccgttcgttaaaccgaagggtttaacgcggttaaggggtagggttacttaagggttaagttttgggg

SEQ ID NO: 370843 - DNA, 617 bp, Homo sapiens
  misc_feature: GZ8MTXP01EBTG2.15.67.G01.1.454.CMB.2.raw
  modified_base (316)..(316): a, c, t, g, unknown or other
  modified_base (394)..(394): a, c, t, g, unknown or other
  modified_base (580)..(580): a, c, t, g, unknown or other
  modified_base (592)..(592): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacgttggtggagtcgtggggggaggtcgtttgggtccgagggcccgggggggtccctggacgactctcctgtgcagtctctggattcacccttagaagtattggatgacctgggtccgcnggctccgaggggaggggctgggaggtgggtggaccaaacaataaaacgaaagacggaaagtacaaagtaaaaaacctntaggtggactcgtaagtacgaacggccgtattccaccatctacaagacaacaacgaccaaagaacttacaacttgttatttgactaaagtcgaaacagccggtagaaggagggacggaaggaccgacgggtaccgtagttaattagttggtcggcgaacgaggatggttagtaagtagttacgttnttacgaagtagngtagggtaggttatgttaagtttgg

SEQ ID NO: 370844 - DNA, 573 bp, Homo sapiens
  misc_feature: GZ8MTXP01EW5KH.15.67.G01.1.454.CMB.2.raw
  modified_base (246)..(246): a, c, t, g, unknown or other
  modified_base (553)..(553): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtcccngagactctcctgtgcagtctctggattcacccttagaagtatggatgacctgggtccgccaggctccgaggggagggctggaggtgggtggaccaacaataaacgaaagacggaaagtacaagaaaaacctatgtggactcgtagtgaacggccgattcacctatctacgagagacaacgaccaagaacttacaacgttgttactttagactaaaatgaaacagaccgtaggaaggagggcgaaggaccgacggccgttagtattattggtgcgcgagatggaataggtaacgacttcgataagtgngtagggtgttatgaagttgg

SEQ ID NO: 370845 - DNA, 717 bp, Homo sapiens
  misc_feature: GZ8MTXP01AP3LJ.15.67.G01.1.454.CMB.2.raw
  modified_base (306)..(306): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgaggccggggggtccctgagactctcctgtgcagtctctggacttcacccttagaagtattggatgacctgggtccnccgaggctccgaggggaagggcgtggaggtgggtggacccaaacaagtaaaacgaaaggaacgggaaagtacgaaaagtaaaaaccttagtggtacggacctcgtaggttacggaacggccgtaactttccgaaccccattccctacgaaagaacgaaaccaaacggacccaaagtaacttactaacttagttaactttggaactaaaagtacgaaactacgaccggtaggaaggaacggcggaaacggacccgtaacgggtacccgttaggttatttagttcgggtcgccggaacggaagggttagttacggaaagttaaaggttaacggttaccgttacgttaaacccggaaggttaaccgggtcgttaagggggttaggttaagtttaacggggttaagttttccggg

SEQ ID NO: 370846 - DNA, 603 bp, Homo sapiens
  misc_feature: GZ8MTXP01C6OBR.15.67.G01.1.454.CMB.2.raw
  modified_base (343)..(343): a, c, t, g, unknown or other
  modified_base (538)..(538): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagtatggatgacctgggtccgcaggctccgaggggaagggctggagtgggtggaccaaanaataaaacgaaagaacggaaagtacaaagaaaaaaacctagtagtaggaactcgtaagtacggaacggcccgaatttccaaccaatctaccaagaagaacaaacgaccaaagaacttcaacttgttaatttaggaacaaatagaacaagaccgtagaggaggacgaggacgacggccgtaggtattatagtgcgngagagtgagtaagtaaggacgttccttactaagtagaagaggtaggttagtaagttaagttaagg

SEQ ID NO: 370847 - DNA, 556 bp, Homo sapiens
  misc_feature: GZ8MTXP01AJXDW.15.67.G01.1.454.CMB.2.raw
  modified_base (381)..(381): a, c, t, g, unknown or other
  modified_base (390)..(390): a, c, t, g, unknown or other
  modified_base (503)..(503): a, c, t, g, unknown or other
  modified_base (535)..(535): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggcccgggggggtccctgagactctcctgtgcagtctctggattcacccttagaagtattggatgaccgtgggtccgccaggctccgaggggaagggctggagtgggtggcaaacccataaaccgaaagacggaatcaagaaaaacctntgtggactntagtgaacggccgattcaccatctacagacgacaacgccaaagattcactgtatttagacaaatgaacagccgtgaggaggacggaggacgacggcgtagtagttatgtgcgngagatgagtagtagacttcttacgaagtacgngagggtagttatgaagtttcg

SEQ ID NO: 370848 - DNA, 797 bp, Homo sapiens
  misc_feature: GZ8MTXP01BCSZB.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgctacgttggtggaggtcggtggggggaggtcgttggtccgacgggcccgggggggtccctgagactctccgtgtgctagtctcgtggattcacccttagtaagtattggatgaccgtgggtccgccgaggctccgaggggaaggggcgtggggaggtgggggtggacccaaacaaagtaaaacgaaaggaacggaaagtacgaaagaaaaaacccttgtaggtaggtactcgtaaggtacggaaccgggccgtaacttccgacccaattcctacccgaagaacgaaccaaaccggaaccctaaagtaaactttaccgaaccgttaggtttaacttttaggaacctaaaaagttacggaaaaccgtaaccggaccgggttaaggggaaaggggaacggggaccggggaaaccggggtaacggaacccggggtacccggttaggtttaacgtttaaggtttggttacgggcgggaaccggtaagggttaagttaaggttaaagttaaagggtaaccgttaacgtttacccgttaaacgtaaagggttacggtaacggttaagggggttagggttaacggtttaaggttaacgggttttaacggg

SEQ ID NO: 370849 - DNA, 736 bp, Homo sapiens
  misc_feature: GZ8MTXP01CSR03.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacgttggtggaggttcgtggggggagggtcgtttgggtcccgagggcccggggggggtccctggacgacctctcctgtgcagtctcgtggattcacccttagaagtattggatgaccgtgggtccgccgaggcctccggaggggaacggggcgtggggaggtgggggtacggaccaaacgaaactaaaaacgaaaaggaccggaaagtcaaaaggaaaaaaacccttagtaggtaggaaccttcgtaaggttacgggaaccgggcccgtaactttacccaaccactccctaccgaagaacgaaccaaaccggacccaaagtaaacttacaaccgtttagtttaattttacgaacctaaaagttacgaaacctaggacccgttaggaacgggacgggacggaacgggaaccgacgggccggtttagtaagtttaagtggtcggccgtaaggaagttagtaggaagttaaacggtcgttaaccgttcttaaccgtaaggtacggtaacgtagggggttaggttaagtcggttaagttttggg

SEQ ID NO: 370850 - DNA, 701 bp, Homo sapiens
  misc_feature: GZ8MTXP01CNUHY.15.67.G01.1.454.CMB.2.raw
tcagtctacgtagccacgaccggtgctcgatttagagtatacatattggttttgaggtctcagagaggagccttagccctggactccaaggcctttccacttggtgatcagcactgagcacagaggactcaccatggagttgggctgagctgggttttccttgttgttattttagaaggtgtccagtgtgaggtgcacttggtggagtcgtgggggaggcgttggtccgaggccggggggtccctgagactctcctgtgcagtctctggattcacccttagaagttattggatgaccgtgggtccgccaggctccgaggggagggcgtgggaggtgggtcggaccaaacgtaactaaaaacgaaaaggaaccgggaaaagtaccgaaaaggtaaaaaaaaccccttagtaggttagggtaaccttcgttaacgggttacggaacccgggcccgtaaatttaccaaccctatccctacccgaagacgaaaccaaaccgacccaaaagtaacttactacttagttatttacgaactaaaatagaaacagaccgtggaagagggacgaaggacgacgggtccgttagtatttagtggtcgtcggcggtaagagttagaagttaaaggtaacgttaaccgttcgttaaaccggtaaggtaaggtaacgggtaaggggttaggggttacttggttaagttttcggg

SEQ ID NO: 370851 - DNA, 545 bp, Homo sapiens
  misc_feature: GZ8MTXP01BA7RL.15.67.G01.1.454.CMB.2.raw
  modified_base (305)..(305): a, c, t, g, unknown or other
  modified_base (371)..(371): a, c, t, g, unknown or other
  modified_base (404)..(404): a, c, t, g, unknown or other
  modified_base (488)..(488): a, c, t, g, unknown or other
  modified_base (490)..(490): a, c, t, g, unknown or other
  modified_base (492)..(492): a, c, t, g, unknown or other
  modified_base (496)..(496): a, c, t, g, unknown or other
tcagtctacgtagccacgaccggtgctcgatttagagtatacatattgggtttgaggtctcagagaggagccttagccctggactcccaaggcctttccacttggtgatcagcactgagcacagaggactcaccatggagttggggctgagctgggttttccttgttgttattttagaaggtgtccagtgtgagtgcacttggtggagtcgtgggggagcttggtccaggccgggggggtcctgagactctcctgtgcagtctctggacttcacccttagaagtatcggattgacctgggtaccnccaggctccgagggggagggctggagtgggtgcaacataaacaaagacgaagtacaagaaaacctntgtggactcgtagtgaaccgcgactcaccatcnccgagacacaacgacctaagaacttcatgtatttgaacaaatgaactagccgtagaggagcgagacgacggcctagtatatggngngngagngtgagtagtagacgttcttacgtaagtagcgaggtaggttagtgttgtg

SEQ ID NO: 370852 - DNA, 593 bp, Homo sapiens
  misc_feature: GZ8MTXP01B8JPI.15.67.G01.1.454.CMB.2.raw
  modified_base (305)..(305): a, c, t, g, unknown or other
  modified_base (535)..(535): a, c, t, g, unknown or other
  modified_base (540)..(540): a, c, t, g, unknown or other
  modified_base (568)..(568): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgaggccgggggggtccctgagactctcctgtgcagtctctggattcacccttagaagtatggatgacctgggtccnccgagctccgaggggagggctgggaggtgggtgaccaacaataaacgaaaggacggaaagtacgaaagtaaaaaccctagtggtaggaactcgtaggtacgaaccgggcctagttccaccatcctaccagacgaacaaccgccaaagaattacacttagttatttagacaaagtagaaacagaccgtaggaaggaggacgaggacgacggtcgtagtattagtgtcgcgngaagngtagagtaagtgacttcactaaggtagngtagggtggttatgttaagtttcgg

SEQ ID NO: 370853 - DNA, 554 bp, Homo sapiens
  misc_feature: GZ8MTXP01ANUI6.15.67.G01.1.454.CMB.2.raw
  modified_base (300)..(300): a, c, t, g, unknown or other
  modified_base (337)..(337): a, c, t, g, unknown or other
  modified_base (408)..(408): a, c, t, g, unknown or other
  modified_base (450)..(450): a, c, t, g, unknown or other
  modified_base (497)..(497): a, c, t, g, unknown or other
  modified_base (521)..(521): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattcaccttagagtatggatgactggtccncgaggctccgaggggagggctggagtgggtgaccaanaataaacgaaaggacggaagtcaaagaaaaacctgtgtggactcgtagtacgaacggcgattcacctatcncagacgacaacgcaagaattcactgtattgactaaatgaacngaccgtagaggaggacgaggactacgggccgtagtattagtgtgcgngagagtagagtaacgtagaccttnttacgaagtagcgagggtgttatgttaacgttg

SEQ ID NO: 370854 - DNA, 626 bp, Homo sapiens
  misc_feature: GZ8MTXP01AOH4A.15.67.G01.1.454.CMB.2.raw
  modified_base (568)..(568): a, c, t, g, unknown or other
  modified_base (603)..(603): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccgaggccgggggggtccctgagactctcctgtgcagtctctggattcacccttagaagtatggatgacctgggtccgccaggctccgaggggaaggggctgggagtgggtggacccaaacaataaacgaaagacggaaagtacgaaagaaaaaccctataggtggaactcgtaggtacgaaccgggcccgtaattccacctactcctacccaaggacgaaacaaaccgacccgaaagtaacttaccaacgttagtttactttagactaaaatcgaaaccacgaccggtaggaaggagggaccggaagggaccgacgggccgttagtacttagtgtcgcgngagatggaagtagtacgacgttcttacgaagtagngtagggtgttatggaagtttcgg

SEQ ID NO: 370855 - DNA, 588 bp, Homo sapiens
  misc_feature: GZ8MTXP01ANYD3.15.67.G01.1.454.CMB.2.raw
  modified_base (374)..(374): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtccagtgtgaggtgcacttggtggagtcgtggggggagcttggtccgaggccggggggtccctgagactctcctgtgcagtctctggattcacccttagaagtatggatgacctgggtccgcaggctcgaggggagggctgggagtgggtggaccaacaataaaacaaaggacggaatcaaagaaaaaccctntggtggaactcttaggtagaacggccgattccaccatctaccagacgacaaacgccaaagtaacttcaacttgtatttagactaaaatgaaactagaccgtaggaaggacgggacgtaacgggacctacgggccgtagtattaagtgtcgcgtcgaagttagtgaagtagtagacttcttacgaagtagcgtaaggtgggttatggttaattgg

SEQ ID NO: 370856 - DNA, 810 bp, Homo sapiens
  misc_feature: GZ8MTXP01DLMZZ.15.67.G01.1.454.CMB.2.raw
  modified_base (312)..(312): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtcagtgtgaggtgcacgttggtggagtcgtgggggaggcgttggtccgaggcccgggggggtccctgagtactctcctgtgcagtctctggattctacccttagtaagttatggatgaccgtggggtcccnccgaggcctccgaaggggggaaggggcgtggggaaggttgggggtacggacccaaacaaataaaacgaaaaggacggtaaagtaccgaaaggaaaaaaccccttagtaggtacgggtaaccttcgtaagggttaacggaacccgggtcccgtaaactttacccaaacccctatacccgttaccgaacgaaacgaacccgaaaacccggacctaaaacggtaaactttacccgaaaccgtttagtttaaagtttttacggaaacaaaaacgttacgaaaacgaaccggtacccggttaaggaaacggggaacgggaccggtaaacgggggaaaccccgacggggttacccggttaaggtttaagttttaaggtttccggtaggtcccggaacggtaaggttagtttagaaaggttaaaggggtaacgttaacctttaccgttaacgtaacgggttaaggtcgggttagggttagggttattgggttaaacgttttgggg

SEQ ID NO: 370857 - DNA, 581 bp, Homo sapiens
  misc_feature: GZ8MTXP01B86IF.15.67.G01.1.454.CMB.2.raw
  modified_base (558)..(558): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggaggtcgtggggggaggcgttgggtccgaggcccggggggggtccctggagactctcctgtgcagtctctggattcacccttagaagtattggatgacctgggtccgccgaggctccgaggggaaggggctgggaggtggggtggaccaaacaataaacgaaagacggaaatcaagaaaaaccctatgtaggactcgtagtacgaacggccgtaattccaccatctaccaagagacaaacgccaaagaattcacttgtatttgacaaagtgaacagccgtagaggaggcgaggacacggcgtagtattagtgtgcgcgagagtgagtagtagaccttcgttacgtaagtacgngtagggttggttatggaagtttg

SEQ ID NO: 370858 - DNA, 810 bp, Homo sapiens
  misc_feature: GZ8MTXP01C9047.15.67.G01.1.454.CMB.2.raw
  modified_base (345)..(345): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttccttgttgtttatttagaaggtgtcagtgtggaggtgcacgttggtgggaggttcggtggggggagggtcgtttcgggtccgacggggtcccggggggggtccctggacgtaccttctcctggtcgctagtcttcgtggtacttcctaacccgttaagtaagttaattgggatcgacctgggtccnccgacggctccgagggggaagggcgtgggaggtggggtcggaccaaagaaacgtaaaaacgaaaaggaacggaaagtacaaaacgtaaaaaaacctagtggtaggacttacgtaggttaacggaaccggggacctaacgtttacccaaaccctacgtaccctaccgaaacggaaacgaaaccaaaccgaacccgaaaacgtaaactttaaccaacgttacggtttattttacggaaccttaaaagtaacgaaacgacgtaccggtaaggaaggggaacgggacgggaaacgggtaaccggaccgggtaccggttagttaaaccgtttaagttggtacgggtacggcggtaaaggttagttaacggaagttaaaggttaacggttaaccttacgttaacccggtaaagggtaacccggtaacggggttaaggggttagggttaaacgttgggttaacgtttttggg

SEQ ID NO: 370859 - DNA, 648 bp, Homo sapiens
  misc_feature: GZ8MTXP01AF1LS.15.67.G01.1.454.CMB.2.raw
  modified_base (586)..(586): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggttttccttgttgttattttagaaggtgtccagtgtgaggtgcacgttggtggagtcgtgggggaggcttggtccgaggccggggggtccctgagactctctgtgcagtctctggattcaccttagaagtattggatgactgggtcccgcaggctccgaggggagggcgtggaggtgggtcggaccaaacaataaaacgaagaacggaaagtacaaaggaaaaacctgtaggtaggaactcgtaggtacggaaccggccgtaactttccaacctacttaccgtaccccgaaagaacgaaaccaaaccggaaccaaaaggtaaacttacctaacttaggttatttagaccgtaaaagtacgaaacgtacgaccgtaggaagggacgggacggaacgggaccgacggtcccggttagtaatttagttggtggcgngtagatggagtaagtacgttacttacttacgaagtacgaagtagggtgttagtgttaagttg

SEQ ID NO: 370860 - DNA, 583 bp, Homo sapiens
  misc_feature: GZ8MTXP01EHF0B.15.67.G01.1.454.CMB.2.raw
  modified_base (522)..(522): a, c, t, g, unknown or other
  modified_base (552)..(552): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtcagtgtgaggtgcacttggtggagtcgtggggggaggcgttggtccaggcccgggggggtccctgagactctcctgtgcagtctctggacttcacccttagaagtattggatgaccgtgggtccgccgaggctccgaggggaggggctggagtgggtggaccaacaataaaacaaaggacggaagtacaagaaaaacctatagtggactcgtaggtagaacggccgattccaccatctccagagacaacgaccaagaattcactgttatttagacaaagtagaaacacgaccgtaggaggaggaccggaggaccgacggccgtagttattagtgtgcgngtagatgaattaggtacgttcttccttagngttagcgtagggttggttatggttaatttcg

SEQ ID NO: 370861 - DNA, 553 bp, Homo sapiens
  misc_feature: GZ8MTXP01DHGOZ.15.67.G01.1.454.CMB.2.raw
  modified_base (381)..(381): a, c, t, g, unknown or other
  modified_base (391)..(391): a, c, t, g, unknown or other
  modified_base (455)..(455): a, c, t, g, unknown or other
  modified_base (492)..(492): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtcagtgtgaggtgcacttgggtggagtctggggggaggcttgggtccaggcccgggggggtccctggagactctcctgtgcagtctctggattcacccttagagtattggatgacctgggtccgccaggctccgaggggaaggggctgggagtgggtggaccaaacataaacgaaagacggaagtacaagaaaaacctntgtggactcngtgaacggccgattccaccgatctccagagacaacgcaagattcactgtattgacaaatgaacncgctgagagcgaggcacggtcctagtatttagtgtgngcgagagtgagtagtaggttacgttccttacaagtagaagaggtggttagtgttaagtttg

SEQ ID NO: 370862 - DNA, 616 bp, Homo sapiens
  misc_feature: GZ8MTXP01CRK0O.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgtttgggtccgagggcccggggggggtccctggacgactctcctgtgctagtctctggattcacccttagaagtattggatgacctgggtcccgccgaggcctccgaggggaagggcgtgggaggtggggtacggaccaaacaataaacgaaagaacggaaagtacaaagaaaaaaccctgtagtggaactcgtaagtcgaacggtccgaattcaccctatcctccaagacgaacaaacgaccaaagaacttcaacttgttatttagacaaatagaaacagccgtaggagaaggcgaaggacgacggccgtagtattagttggtgcggtcgaagagtgaagttagtagttaccttcgttaacgtaagtagcgtaggtggttatgttaagtttgg

SEQ ID NO: 370863 - DNA, 560 bp, Homo sapiens
  misc_feature: GZ8MTXP01D65K8.15.67.G01.1.454.CMB.2.raw
  modified_base (428)..(428): a, c, t, g, unknown or other
  modified_base (517)..(517): a, c, t, g, unknown or other
  modified_base (530)..(530): a, c, t, g, unknown or other
  modified_base (539)..(539): a, c, t, g, unknown or other
  modified_base (544)..(545): a, c, t, g, unknown or other
  modified_base (557)..(557): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggagcgttggtccaggccgggggggtccctgagactctcctgtgcagtctctggattcaccctagagtatggatgaccgtgggtccgccaggctccgaggggaggggctgggagtgggtggccaacataaaacaaaagaacggaagtacgaagaaaaaacctatagtgggactcgtagtacgaacggccgtaattccaaccatctccaaganacaaacgccaaagaatcaacttgtatttgacaaatgaaacagccgtagagacgggacgaggaccgacggccggtagtattatgtcgcgngagatgatagganacgttcagngtagnnggtgttatgttnttg

SEQ ID NO: 370864 - DNA, 683 bp, Homo sapiens
  misc_feature: GZ8MTXP01AWYAU.15.67.G01.1.454.CMB.2.raw
  modified_base (401)..(401): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtgggggagcgttggtccgagggcccggggggtccctgagacctctccgtgtgctagtctcgtggtattcctacccttagaagttagttggatcgaccgtgggtcccgccgaggcctccgaggggagggctgggaggtgggtgacccaaacaagtaaaacgaaaggacggaaagtacaaagaaaaccctntaggtacgactcgtagtacgaacggcctacgtaccacctatcctacaagacaacaaccgacaaagtacttctactagttatttacgaactaaatacgaaacgtacgaccggtaggaaggacgggaccggtaacggaaccggaccggtaccggttagtttaacgtttaaggttcggttcggcgggtaacgaaggttaacggttaggaacgttaaggtaacgttaaccgttcgttaacgtaagtaccggtaacgtaggggtgttaagttggttaagttttaagg

SEQ ID NO: 370865 - DNA, 552 bp, Homo sapiens
  misc_feature: GZ8MTXP01BN768.15.67.G01.1.454.CMB.2.raw
  modified_base (377)..(377): a, c, t, g, unknown or other
  modified_base (460)..(460): a, c, t, g, unknown or other
  modified_base (502)..(502): a, c, t, g, unknown or other
  modified_base (527)..(527): a, c, t, g, unknown or other
  modified_base (532)..(532): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgtttggtccgaggcccgggggggtccctggagactctcctgtgcagtctctggattcacccttagaagtatggatgacctgggtccgccaggctccgaggggagggctgggagtgggtggccaacataaacaaagacggaatcaagaaaaacctntgtggactcgtagtgaacggcgaattcaccatcctcagacgacaacgccaagaattcgaacttgttatttgacaaatgaaacngaccgtgaaggaggacgaggacacggcgtgtattatgtgcgngagatgagtagtagacttcttacgnggtangtagggtgttatggaattcg

SEQ ID NO: 370866 - DNA, 593 bp, Homo sapiens
  misc_feature: GZ8MTXP01A5RML.15.67.G01.1.454.CMB.2.raw
  modified_base (514)..(514): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggaggtcgtggggggaggcgttgggtccgagggcccggggggggtccctggagactctcctgtgcagtctctggattcacccttagaagttattggatgacctgggtccgccgaggctccgaggggaaggggctgggaggtgggtggaccaaacaataaacgaaaggacggaaagtacaagaaaaacctataggtgactcgtagtcgaacggccgtaattccaaccatcctcaagacgacaacgacccaaagaattcaacttgttaatttgactaaatagaacacgccgtaggaggagggacgagggacncgggccgttagtattatgtgcgcgagatgagtagtacgacttcacgaaggttagaacgtagggtggttatgaagtttcg

SEQ ID NO: 370867 - DNA, 578 bp, Homo sapiens
  misc_feature: GZ8MTXP01EEGUF.15.67.G01.1.454.CMB.2.raw
  modified_base (299)..(299): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggcccgggggggtccctgagactctcctgtgcagtctctggattcaccttagagtatggatgactgggccncagctccgaggggagggctggagtgggtgcaacataaacaaagacggaagtacaagaaaaacctatgtaggactcgtagtagaacggccgtattaccacatctaccagacgacaacgaccaagtaacttctactagttattgacaaatagaaacacgccgtagaggacggcggaaggaccgacgggtccgtagttagttagttgtgccggaagagttagtagttaagtaaggtagaacttcttaacgaaggtagcgagggtgttagtgttaagtttcgg

SEQ ID NO: 370868 - DNA, 672 bp, Homo sapiens
  misc_feature: GZ8MTXP01AYW4D.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtgggggaggcttggtccgacgggcccggggggtccctgacgactctcctgtgcagtctctggattcacccttagaagttattggatgaccgtgggtcccgccgaggcctaccgagggggaaggggtctggggaggtggggtacggaccaaacaagtaaaacgaaaggaacggaaagtaccaaagaaaaaaccctagtggtaggactcgtaggttacggaaccggccgtaactttaccgaaccctatacctacccgaaaggaacgaaaccgaaaccgacccaaaagtaaccttactaaccttagttaatttacgaactaaagtaacgaaacgacgaccggtaggaaggacgggacggaaggaccgacggtccgtagttattagttcgtgcggaagagagtgaagtaagtacgaacttcgaacgtaagtacgaacggtagggtggttaactggttaattgg

SEQ ID NO: 370869 - DNA, 550 bp, Homo sapiens
  misc_feature: GZ8MTXP01B4JNG.15.67.G01.1.454.CMB.2.raw
  modified_base (414)..(414): a, c, t, g, unknown or other
  modified_base (524)..(524): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccggggggggtccctgagactctcctgtgcagtctctggattcaccccttagaagtattggatgacctgggtccgccaggctccaggggaaggggctggagtgggtggccaacataaacaaagacggaagtcagaaaaacctatgtggactctagtgaacggccgattcaccatctcaganacaacgaccaagaattcactgtattgacaaatgaaacagccgtgaggaggacggaggacgacggccgtagtattagtgtgcgcgagatgagtagtagacgttcttaacgngtagcgtaggtggttatgttaagttg

SEQ ID NO: 370870 - DNA, 548 bp, Homo sapiens
  misc_feature: GZ8MTXP01D4JPH.15.67.G01.1.454.CMB.2.raw
  modified_base (378)..(378): a, c, t, g, unknown or other
  modified_base (501)..(501): a, c, t, g, unknown or other
  modified_base (505)..(505): a, c, t, g, unknown or other
  modified_base (521)..(521): a, c, t, g, unknown or other
  modified_base (526)..(526): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcttggtccgaggcccggggggtccctgagactctctgtgcagtctctggattcacccttagaagtatggatgacctgggtccgccaggctccgaggggaaggggctgggagtggggtggccaaacataaaacaaagacgaagtacagaaaaaacctntgtggactctagtgaacggccgattcacctatctcagagacaacgaccaagaattcaactgtatttgacaaaatgaaacagccgtagagaggcgaggaacacggccgtagtattatcgtgcgngagngtgatagtagacgttnttacngtagcgaggtggatgaagttcg

SEQ ID NO: 370871 - DNA, 598 bp, Homo sapiens
  misc_feature: GZ8MTXP01CMOTT.15.67.G01.1.454.CMB.2.raw
  modified_base (320)..(320): a, c, t, g, unknown or other
  modified_base (370)..(370): a, c, t, g, unknown or other
  modified_base (381)..(381): a, c, t, g, unknown or other
  modified_base (557)..(557): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttgggtccgaggccggggggggtccctgagactctcctgtgcagtctctggattcaccttagagtatggatgacctggtccgcagctcgagggaggntggagtggtgacaaacataaacgaaagacggaagtacaagaaaaaacctntaggtggactntaggtagaacggcgattccacatctaccagaacgacaaacgaccaaagtaacttacaacttagttaatttgaacaaaatagaaacacgaccgtaggaaggaacgggacggaacggaccgacgggtccgttagttattaagttgtgcggaagaagatagagtaagtagttaccgttnttaacgaaggtaagcgtagggtaggttatcggttgtttaag

SEQ ID NO: 370872 - DNA, 634 bp, Homo sapiens
  misc_feature: GZ8MTXP01DCYZJ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggaggtcgtggggggaggcgttgggtccgaggccgggggggtccctgagactctcctgtgcagtctctggattcaccttagagtatggatgactggtccgccagctccgaggggagggcgtggagtgggtcggaccaaacgaataaaacgaaagaacggaaagtacgaaagtaaaaaacctagtagtaggactcgtaggtacggaaccggccgtaacttaccaccactcctaccagacgaacaaacgaccgaaagaacttacactagttagtttagacaaatagaaacacgtaccgtaggaaggaacgggacggaacgggaccgacggtaccggttagttagtttagttggtcggccgaagaggagtaggagttaagtagaacttccttaagtaaggtaagtcggtaagggtggttagtcgttgtttaag

SEQ ID NO: 370873 - DNA, 698 bp, Homo sapiens
  misc_feature: GZ8MTXP01BOJX9.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggtcttggtccgagggcccggggggtccctggagactctcctgtgcagtctctggacttcacccttagaagtatggatgaccgtgggtccgccgaggctccgaggggagggctggagtgggtcgaccaacaataaaacgaaaggacgaaagtacaaagtaaaaaacctgtaggtaggactcgtaagggtacggaacccggggccctaaactttcccaaccctacttaccgtacccaaaggaacgaaaccgaaaccggaacccaaaaggtaaactttccctaacttaggtttaactttacggaacctaaaagttacgaaacgaacggacccgttagggaaacggaacggggacggaaacggggaaccgaccggggtaccgttaggttaagtttagttggtcgccggaagaagttagtaggttagtaaggtacgttaacttcttaacgtaaggtagcgtagggttgttagtgttaagttgg

SEQ ID NO: 370874 - DNA, 730 bp, Homo sapiens
  misc_feature: GZ8MTXP01D9D7M.15.67.G01.1.454.CMB.2.raw
  modified_base (350)..(350): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgtttattttagaaggtgtccagtgtgaggtgcacgttggtggaggtcgtggggggaggtcgttggtccgagggccgggggggtccctggagactctcctgtgcagtctctggattcaccttagaagtatggatgaccgtggtccgccaggcctccgaggggagggctggaggtggtgccaaanaataaaacaagaacggaagtacaaagaaaacctatagcggatcgtaagtagaaccgggcgtattccacctatccgtaccaagacgaaccaaacggacccaaagtaaacgtttctaaaccgttaggtttaacttttacggaaccgtaaaaattacggaaaaacacgtaccccgggttaaggaaagggaacgggtacccggaaagggaacccgtacggggtaccccggtttaaggtttaaacgttttaacggttcggttagcccggggaaacggtaaggaaagtttaggaaaccgttaaggtaaccggttaaacttccgttaaaaccgtaagggttaccggcgttaaaggggtaggtttaagtaaccggttaagttttaagg

SEQ ID NO: 370875 - DNA, 598 bp, Homo sapiens
  misc_feature: GZ8MTXP01CN3KF.15.67.G01.1.454.CMB.2.raw
  modified_base (539)..(539): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggaggtcgtggggggaggcgttgggtccgaggccgggggggtccctgagactctcctgtgcagtctctggattcacccttagaagtattggatgacctgggtccgccaggctccgaggggaaggggctgggaggtggggtcggaccaaacaataaaacgaaagacggaaagtacaaagtaaaaaacctataggtggaacctcgtaggttacggaaccgggccgtaacgttaccaacccatcctaccaagacgaacaaacgaccaaagaaacttcaactgtatttgacaaatagaacagcgtagagaggcgaggacacggcgtagtattatgtgngcgtagatagagtaggtagacttcttaacgaagtagcgagggtgttagtgttaagtttg

SEQ ID NO: 370876 - DNA, 557 bp, Homo sapiens
  misc_feature: GZ8MTXP01BO0OK.15.67.G01.1.454.CMB.2.raw
  modified_base (359)..(359): a, c, t, g, unknown or other
  modified_base (404)..(404): a, c, t, g, unknown or other
  modified_base (407)..(407): a, c, t, g, unknown or other
  modified_base (409)..(409): a, c, t, g, unknown or other
  modified_base (456)..(456): a, c, t, g, unknown or other
  modified_base (492)..(492): a, c, t, g, unknown or other
  modified_base (497)..(497): a, c, t, g, unknown or other
tcagtctacgtagccacgaccggtgctcgatttagagtatacatattgggtttgggggtctcagagaggagccttagccctggactccaaggcctttccacttggtgatcagcactgagcacagaggactcaccatggagttggggctgagcgtgggttttccttgttgttatttagaaggtgtccagtgtgaggtgcacttggtggagtctgggggagcttggtccagccggggggtccctgagactctcctgtgcagtctctggattcacccttagagttatggatgacctgggtcccgccaggcctccgagggaggggctggagtgggtgccaacataaaccaaagacggaagtanaagaaaactatggtaggctctggtagaaccgggcgatcaccatcncananacaacgccaagattcactgtatttgacaaatgaacagcctagggagnggacgaggacacgggccgtggtattagtgtagcggngaagnttgattacgtatacttacgttacgaggtgtagtaagggttgtagttagtcgttgttaacg

SEQ ID NO: 370877 - DNA, 718 bp, Homo sapiens
  misc_feature: GZ8MTXP01C155B.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggcccggggggggtcccgtggacgactctcctgtgcagtctctggacttcaccttagaagttattggatcgaccgtgggtccgccgaggcctaccgaggggaaggggcgtgggaggtggggtcggacccaaacgaaataaaacgaaaaggaaccggaaagtacaaacggtaaaaaaacccttagtaggtacggtaacctcgttaaggtacggaacccgggggccctaaatttacccaaccctaacttccacccgaaagacgaaaccaaaccggacccaaagtaaactttacgaacttaggtttaattttacggaactaaaattacggaaacacggaccggtaggaagggaacgggaccggaaggtaaccggaacgggccggttaagtttaagttagtttggacgcggaacgtagaagttagagttaaagtagaaccgttcttaaacgaaggtaagtcggaagggttgttaagtcgttaagtttcgg

SEQ ID NO: 370878 - DNA, 627 bp, Homo sapiens
  misc_feature: GZ8MTXP01D7FKY.15.67.G01.1.454.CMB.2.raw
  modified_base (302)..(302): a, c, t, g, unknown or other
  modified_base (563)..(563): a, c, t, g, unknown or other
  modified_base (603)..(603): a, c, t, g, unknown or other
  modified_base (622)..(622): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcattggtggagtcgtgggggaggcgttggtccgaggccggggggtccctgagactctcctgtgcagtctctggattcaccttagaagtatggatgaccgtggtccncgaggctccgaggggaaggcgtgggagtgggtggaccaaacgaataaaacgaaagaccggaaagtacaaagtaaaaacctagtagtaggaacttcgtaaggttacgaacgggcccgtaaatttcccaaccgtaattcctacccgaagaacgaaccgaaacggacccaaaggtaaacttacgtaacttgttaatttgactaaaagtcgaaactacgccgtaggacggaagggacgaaggacgacggacgttagtattagtgngtcgaagagatgaagtagtacgacttcttaagaagttagngtggtaggttataaggttntttgg

SEQ ID NO: 370879 - DNA, 584 bp, Homo sapiens
  misc_feature: GZ8MTXP01D2FF2.15.67.G01.1.454.CMB.2.raw
  modified_base (567)..(567): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggcccggggggtccctgagactctcctgtgcagtctctggattcacccttagaagtatggatgacctgggtccgccaggctccgaggggaggggctgggagtgggtggaccaaacaataaaacaaaggacggaaagtacaaagaaaaacctagtagtaggactcgtaggtagaacgggccgattccaaccatcctaccaagacgaacgaacgaccaaagtaattacaacttgttaatttaggacaaaatggaaacacgccgtaggagaggacgaggacgacggccgtagtagttatggtgcgaacgagatgatagtagacttcttacaagtacgngaggtgttatgaagttg

SEQ ID NO: 370880 - DNA, 697 bp, Homo sapiens
  misc_feature: GZ8MTXP01CT0HF.15.67.G01.1.454.CMB.2.raw
  modified_base (292)..(292): a, c, t, g, unknown or other
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatcgacccagtcctccatcctccctgtctgcatctagtaggagacagactcaccatcacgttcgccgggacaagtcaggactatacgaactgtacttaggtgtatcgagcaagaaacgtacccgggaaacncccctaaggcctccgtagtacgtctggtacgcgtcgactacttacccttaaacgtttaacgaaacggttccggggtacccccctaggtacgtaggttacgacgggaccgtacgtaagggtacgtactccggttagggacctaacgtattacctttacctactaccctacaacccactacgacgcgtacgtccagacctacgtaccgtaagttaacggttactttaccggtaaccttaaacgtttaaccttcgttacgtaacttaaacgtacgttaaccttaactaaacccgtttccccggtaaggttaccccggttacgggaccgggaaacccgggtaaacggtacgggttaaacggttaacaaccgaaacgtacgtgtacgggcttacgaaccgttaactaacg

SEQ ID NO: 370881 - DNA, 556 bp, Homo sapiens
  misc_feature: GZ8MTXP01EMJE3.15.67.G01.1.454.CMB.2.raw
  modified_base (304)..(304): a, c, t, g, unknown or other
  modified_base (375)..(375): a, c, t, g, unknown or other
  modified_base (507)..(507): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtggggggaggcttgggtccaggccgggggggtccctgagactctcctgtgcagtctctggattcacccttagagtatgatgacctgggtccnccagctccgaggggaagggctggagtgggtggaccaacaataaaacaaagacggaatacaagaaaaacctntagtggactctagtgaacggcgattcaccatctaccagagacaacgtccaaagaattcaacttgttatttgacaaatgaacagccgtgaggaggacgaggacacgggccgtagtattatgtgtcgcgagttntgagtagtagacgttcttaacaaggtagctagggtggttatgaagtttg

SEQ ID NO: 370882 - DNA, 682 bp, Homo sapiens
  misc_feature: GZ8MTXP01ESYAZ.15.67.G01.1.454.CMB.2.raw
  modified_base (389)..(389): a, c, t, g, unknown or other
  modified_base (567)..(567): a, c, t, g, unknown or other
  modified_base (609)..(609): a, c, t, g, unknown or other
  modified_base (656)..(656): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagtcttgggttttccttgttgttattttagaaggtgtccagtgtgaggtgcacgttggtggaggtcggtggggggaggtccgtttgggtcccgacgggtcccggggggggttccctggacgaccttcctccgtggtcgcagttctcgtggtacttacctacccgttaagtaagttagttggatcggaccgttcggggtccccgccgaggccgtaccggaaggggggaaggggtcgtaggggnggtgggggtacgaaccaaaacgaaataaaaacgaaaggaacggtaaagtacgaaaagtaaaaacctgtaggtacggtactacgtaggtacgaaccgggctaatccactacttcacagaacgaacaacggacaaagtacttctaagtgttattagaacaaagtacgaaacagtaccggnggaacggaggccggaagccgaacggtcgttagttattagtgnggcgaagagttagtagttaagttaaggtcaacggttcttagtaaggngtaacgtgggtaaggttatgttcgtg

SEQ ID NO: 370883 - DNA, 570 bp, Homo sapiens
  misc_feature: GZ8MTXP01BT4WH.15.67.G01.1.454.CMB.2.raw
  modified_base (386)..(386): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttgggtccagccgggggggtccctgagactctcctgtgcagtctctggattcaccccttagaagtattggatgacctgggtccgccaggctccaggggaggggctggagtgggtggcaacataaacaaagacggaagtacaagaaaaacctatgtaggactctagngaacggccgattcaccatctccagagacaaacgcccaaagaattacactgtaatttgacaaatagaaacagaccgtgaacgagggacgaggaacacgggcccgttagtatttagttcgtggtcggcgagagtagagttaagtagacgttcttactaagtaggcaagggtggttattgaagttgg

SEQ ID NO: 370884 - DNA, 575 bp, Homo sapiens
  misc_feature: GZ8MTXP01EK4AG.15.67.G01.1.454.CMB.2.raw
  modified_base (379)..(379): a, c, t, g, unknown or other
  modified_base (416)..(416): a, c, t, g, unknown or other
  modified_base (466)..(466): a, c, t, g, unknown or other
  modified_base (511)..(511): a, c, t, g, unknown or other
  modified_base (551)..(551): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattcacccttagaagtatggatgacctgggtccgccaggctccgaggggagggctggagtgggtggaccaacgaataaacgaaagacggaagtacaaagtaaaaacctntagtaggactcgtagtagaacggcgtattcactatcncagagacaacgccaaagacttacacgttagtatttcgacaaagtagaacngaccgtagaggaggacgaggacacggcgtagtattagtgtcgcgngagagtagacgtaaggtacgttacttcttaacgaagtagngtagggtagttatgttaagtttcg

SEQ ID NO: 370885 - DNA, 873 bp, Homo sapiens
  misc_feature: GZ8MTXP01CYMV5.15.67.G01.1.454.CMB.2.raw
  modified_base (317)..(317): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttggttttccttgttgttatttagaaggtgtcagtgtgaggtgctacgttggtggaggtcgtggggggaggcgtttggtccgagggccggggggtccctggacgtactctcctgtgcagtctctggtacttcacccttaagaagttattggatgaccgtgggtcccnccaggctaccgaggggaagggcgtgggaggtgggtcggaccaaacgaataaaacgaaaggaaccggaaagtacgaaacgtaaaaaaacctgtaggtacggaacttcgtaagggttaacggaacccgggcccgtaaactttacccaaccctaagtccctaccgaaaggaacgaaaccgaaaccgaacccgaaaggtaaactttacgaaccgtttaggtttaaattttacggaaaccctaaaagttacgaaaaccgtaaccggtacccggttaagggaacggggaaacgggaccggggaaaacgggaaaccccggtaaccgggggtttaaccccggtttaaacgggttttaaaacgtttttaaagggtttcccggttagggggtaaaccccgggtaacgggaaaacgggttaacggtttaacggttaaaacggttttaaacggggttaaacggttaaaccgtttacccgttaaaacccggttaaaggggttaaaacccggtcgggtttaaagggggtttagggtttaaacgttaaccgggttaaagttttttaacggg

SEQ ID NO: 370886 - DNA, 573 bp, Homo sapiens
  misc_feature: GZ8MTXP01AS4VV.15.67.G01.1.454.CMB.2.raw
  modified_base (513)..(513): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggaggttggggctgagcttgggttttccttgttgttattttagaaggtgtccagtgtgaggtgcacgttggtggaggtcgtggggggaggtcgttgggtccgagggcccgggggggtccctggagactctcctgtgcagtctctggattcacccttagaagtatggatgacctgggtccgcaggctccgaggggaaggggctggagtgggtggaccaaacaataaaacaaagaacggaagtacaagaaaaacctatgtggactctagtacgaacggcgattccaccatcctcagagacacgaccaagaattcactgttatttgacaaatgaacagccgtgaggaggcgaaggacgacggccgtgtagtttattggtgnggtcgagatgttagtagtagacttcacgtaagtacgaagtaggtggttatgttaagttgg

SEQ ID NO: 370887 - DNA, 738 bp, Homo sapiens
  misc_feature: GZ8MTXP01EXBWD.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttccttgtttgtttattttagaaggtgtccagtgtggaggtgctacgttggtggtaggtcggtggggggaggtcgttcgggtccgacgggcccgggggggtccctggagtacctcctccgtgtgcagtctctggtacttcacccttagtaagttattggatcgaccgtcgggtcccgccgaggctaccggagggggaacgggcgtggggaggtgggtacggaccaaacgaaagtaaaaacgaaaggaacggtaaacgtaaccgaaagtaaaaaaccctagtaggtaggtaccttcgtaacggttacggaacccggaccggtacttacccacctacttccctacgaacgaacgaacgaaccgaaccgaaagtaacttactaacgttagtttaagtttacgaactaaagtacgaaactagacccgtaggaagggaacgggcggaaggaccgacgggtaccgtagtttaattaggttgtcggacggtcggtaagttagtagttaagtagtaaacggttaccttaccttaacggtaaggtaccggaacgggttaggggtaggtttaagtcggtttgtttaacggg

SEQ ID NO: 370888 - DNA, 625 bp, Homo sapiens
  misc_feature: GZ8MTXP01AY1FC.15.67.G01.1.454.CMB.2.raw
  modified_base (300)..(300): a, c, t, g, unknown or other
  modified_base (479)..(479): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggagctggtccaggccgggggggtcctgagactctctgtgcagtctctggattcaccttagaagtatggatgacctgggtaccncgaggctaccggaggggaggcgtggaggtgggcggacgaaacaaagtaaaacgaaaggaacggaagtaacgaaacgtaaaaaccgtaagtagtagtacgtacgtagtacgaacggaccgactacacactactacaacgaacgaacgaacgaacgaaacgaacttactactagttattanaacaaagtaagaacgaacgacggaggaggaggaggacggacgacggtacgtagtagttagtagtcggacggaacgaagagtagaagtaagtaagttacgttacgttacgtaagtacgaaggtaggtaggttagtaagttaagtaag

SEQ ID NO: 370889 - DNA, 795 bp, Homo sapiens
  misc_feature: GZ8MTXP01AG9YO.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtccctgagactctcctgtgcagtctcgtggtacttcacccttaagtaagttattaggatgaccgtgggtcccgccgaggccgtccgagggggaaggggcgtgggaggtggggtacggacccaaacgaaagtaaaaccgaaaaggaacgggtaaagtaccaaaagtaaaaaaccctagtaggtacggtaactcgtaaggtacggaaccgggccgtaaatttcccacctactcctacaaacgaacgaaccaaaccggaccaaaacggtaaacttacccgaacgttagttaacgttttacggaacctaaaagttacgaaaaccgtacggacccgggttagggaacggggacgggggaacccggggaaacggggtaaccccggaaccgggggtaccccggttttagggttaaaagtttttccggtttaagggttacccgggcgggtaaccgggtaaaggttaaggttagaaggttaaacgggttaacggttaacctttacggttaacgtaacgggttaaggccggtaaggggtttaggttaagttggttaagttttggg

SEQ ID NO: 370890 - DNA, 676 bp, Homo sapiens
  misc_feature: GZ8MTXP01AH4VX.15.67.G01.1.454.CMB.2.raw
  modified_base (346)..(346): a, c, t, g, unknown or other
  modified_base (632)..(632): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtccctgagactctcctgtgcagtctctggattcaccgttagaagttatggatgacctgggtccgcgacggctccgaggggaagggcgtggaggtgggtcgaccaanaataaacgaaagacggaagtacaagaaaaaccctgtagtggtactcgtagtacgaaccggccgtacttaccgaccctattccaccgaacggaacgtaaccgaaccggaccaaagtaaactttaccgaacgttagtaacttttacggacctaaaagtacgaaacacggacccgtagggaacgggacgggaccgaacggggaaccgtaccggggtacccgttaggttaactttacggttggtacggcggtaacgaagttagtaggttaagtaggttaacttaccgttnttaccgaaggttacgaacgtagggtaggttagtgttgtttaagg

SEQ ID NO: 370891 - DNA, 591 bp, Homo sapiens
  misc_feature: GZ8MTXP01DJGA2.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacttggtggagtcgtgggggaggcgttggtccgaggcccgggggggtccctgagactctcctgtgcagtctctggattcaccttagagtatggatgactggtccgcgaggctccgagggagggctggagtgggtggaccaaacaataaaacgaaagacggaaagtacgaaagaaaaaaccctgtaggtggactcgtagtagaacgggccgtattaccacctaatcctcaagacaacaacaccaaagaattcaacttgtatttgacaaatagaaacacgccgtaggaaggaaggcgaacggacacggccgtagtatttagtgtagccgaagagagtgaagtaggtagttacgttacttaacgaaggtagaacgtagggtggttaatggaagttttg

SEQ ID NO: 370892 - DNA, 705 bp, Homo sapiens
  misc_feature: GZ8MTXP01EJYH8.15.67.G01.1.454.CMB.2.raw
  modified_base (681)..(681): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtggaggtgcacgttggtggagtcgtgggggaggcgttggtccgagggcccggggggtccctggagactctcctgtgcagtctcgtggacttccacccttagtaagttattggatcgaccgtgggtcccgccgaggcctaccggaagggggaacgggggcgtgggtaggtgggggtacggaccaaacgaaataaaacgaaaaggaaccggaaagtaccgaaaagtaaaaaacctagtaggtaggacctcgtaggtacgaaccggccgtaaattccaaccctattcctaccgaaacggaacgtaaccgaaaccgacccaaagtaactttacgtaacttaggtttaactttagaacctaaaagttacgaaaacgtacgtaacggtagggaagggaacgggacgggacggaaccgtacgggtaccgttagttaatttaagttggtgccggtaagaagagtagaaagtagtaagttaccttcttaacgaagtacgngtaggtggttatcggttaatttgg

SEQ ID NO: 370893 - DNA, 802 bp, Homo sapiens
  misc_feature: GZ8MTXP01COIDS.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttatttagaaggtgtccagtgtgaggtgcacttggtggagtcgtggggggaggctttggtccgaggccggggggggtccctggacgactctcctgtcgctagtctcgtggtacttaccgtaacccgttaagtaagttagttaggaatcgtaccgtcgggtcccgccgaggccgtaccggaagggggaacgggcgtgggaggtcgggggtcggaccctaaagaaagtaaaaccgaaaggacggaaagtacgaaaagtaaaaaacccgtgtaggtgtacttacgtagggtaacggaacccggtcggtattaccaaccctacgttcccaccgaagaacgaaacccaaacggaacccctaaaaggtaactttaccccaaagggtttactttaagttttacggaaaacccgttaaaaagtaaacgtaaaccgtaaccgtaccggggtaacgggaacgggaacgggaacgggaaccgggaaccggtacccgggtaccggttaacgtttaacgtttacggttacggtcggtacggtaacggtaaggttaaggttaaggttaacggttaaacggtaacgttaacgttaccgttaacgtaacggtaacggtaacggtagggttaggttagttaagttaagttaag

SEQ ID NO: 370894 - DNA, 596 bp, Homo sapiens
  misc_feature: GZ8MTXP01CRRSH.15.67.G01.1.454.CMB.2.raw
  modified_base (531)..(531): a, c, t, g, unknown or other
  modified_base (539)..(539): a, c, t, g, unknown or other
  modified_base (576)..(576): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttgggtgggaggtcgtggggggaggtcgtttgggtcccgagggcccggggggggtccctgagactctcctgtgcagtctctggattcacccttagaagtattggatgacctgggtccgccaggctccgaggggaagggcgtggaggtgggtggccaaacataaaacgaaagacggaaagtacaagaaaaaaccctatagtggaactctaaggttgaacggccgtaattcaacccatcctcaagacgaacaacgacccaaagaacttcaacttagtatttagacaaatagaacagccgtagaggaggacgaggacgacggccgtagttattnttagtcgnggcgagatgagtaagtagacgttcttacaagtaaggngtaggtgttagtgttaagtg

SEQ ID NO: 370895 - DNA, 621 bp, Homo sapiens
  misc_feature: GZ8MTXP01CBG4Y.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgagggcccggggggggtccctggacgactctcctgtgcagtctctggacttcacccttagaagttattggatgaccgtgggtccgccgaggctccgaggggaaggggcgtgggaggtgggtacggaccaaacaataaacaaaggaacggaaagtacaaagtaaaaacctatagtaggactcgtagtacgaaccggccgtaattccaccatcctacaagacaacaacgaccaaagtaacttacaacgttagttagtttacgactaaatagaaacacgccggtagaaggaggcggaaggaccgacggcgttagtattagttggtcgcgcgagttagtagagtaagtagttacgttaccgttataaggtagcgtaggtaggttagttgaagtttg

SEQ ID NO: 370896 - DNA, 783 bp, Homo sapiens
  misc_feature: GZ8MTXP01BG37N.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtccctgagactctcctgtgcagtcctcgtggtacttcctaccgttaagtaagtagtggatcgaccgtcgggtcccgccgaggcctaccggaagggggacggggtcgtaggggtaggttgggggtacggacccgaaaactaaacgtaaaaaaccgaaaggaaccgggtaaagtaaccgaaaagtaaaaaccccgttagtaggtacggtaaccttcgtaacgggtaacggaacccgggtaccctaactttacccacctactccctaccgaagaacgaaaccgaaaccgaccgaaaagtaacttaccgtaacgtttaggtttactttacgaaactaaaagtacgaaacgtacgttacccggtaagggaacgggaacgggacgggaaacgggtacccggaaccggggttaccgtttaagggtttaaacttttaggttagggttcgggcccgggtaacgtaaaggttagttagttaaccgttaagggtaacgttaccttacgttaacgtaaggtacggtcgtaagggtttgttagtgttaaccgtttg

SEQ ID NO: 370897 - DNA, 642 bp, Homo sapiens
  misc_feature: GZ8MTXP01DLTF8.15.67.G01.1.454.CMB.2.raw
  modified_base (349)..(349): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacttggtggaggtcgtgggggaggcttggtccgaggccggggggtccctgagactctcctgtgcagtctctggattcacccttagaagttatggatgacgtgggtccgccaggcctccgaggggaagggcgtgggaggtggggtggaccaaanaataaaacgaaagacggaaagtacaaagaaaaacctagtgtaggactcgtagtacgaacgaaccgtattaccaaccatacctaccaagacgaacaaacgaccaaagtaatttacaactttagtttaactttagacctaaaagttacgaaacgacgaccggttaggaagggaacgggcggaaacgggacgaccggccgttagttacttagttgtcgcggaagagttatagagttaaggtacgttaacttcgttaacgaaggtagcgtagggtgttagttggttaacgtttaagg

SEQ ID NO: 370898 - DNA, 650 bp, Homo sapiens
  misc_feature: GZ8MTXP01ASSZ4.15.67.G01.1.454.CMB.2.raw
  modified_base (266)..(266): a, c, t, g, unknown or other
  modified_base (305)..(305): a, c, t, g, unknown or other
  modified_base (341)..(341): a, c, t, g, unknown or other
  modified_base (561)..(561): a, c, t, g, unknown or other
  modified_base (612)..(612): a, c, t, g, unknown or other
tcagtctacgtagccacgaccggtgctcgatttagagtatacatattgggtttgaggtctcagagaggagccttagccctggactccaaggcctttccatttggtgatcagcactgagcacagaggactcaccatggagttggggttgagctgggttttccttgttgttattttagaagtgtccagtgtgaggtgcacttggtggagtcgtgggggaggcttggtccaggcccgggggggtccctgagactctcctgtgcagtctntggattccacccttagaagttatggatgacctgggtccncaggctcgaggggaggggctgggagtgggtgccaanagtaaacaaaggacggaatacaaagtaaaaactgtgtggactgtgtacgaacggtccgaattccaacctatcctaccaagacgacaaaccgtccgaaagtaactttaccacttaggttatttacggaacctaaaatagaaacgacgtaccaggggacggaacgggccggaaagggacccgaacggggtccggttagtaagtttagttcggtgacccgggngtaagtagttaggtaattaggtaacgtacttcggttaacttaggggtaacncggtaagggttggtagttcggtaacgttgggtttaacg

SEQ ID NO: 370899 - DNA, 516 bp, Homo sapiens
  misc_feature: GZ8MTXP01A2AEJ.15.67.G01.1.454.CMB.2.raw
  modified_base (263)..(263): a, c, t, g, unknown or other
  modified_base (296)..(296): a, c, t, g, unknown or other
  modified_base (300)..(300): a, c, t, g, unknown or other
  modified_base (313)..(313): a, c, t, g, unknown or other
  modified_base (315)..(315): a, c, t, g, unknown or other
  modified_base (318)..(318): a, c, t, g, unknown or other
  modified_base (320)..(320): a, c, t, g, unknown or other
  modified_base (323)..(323): a, c, t, g, unknown or other
  modified_base (328)..(328): a, c, t, g, unknown or other
  modified_base (331)..(331): a, c, t, g, unknown or other
  modified_base (334)..(334): a, c, t, g, unknown or other
  modified_base (343)..(343): a, c, t, g, unknown or other
  modified_base (362)..(362): a, c, t, g, unknown or other
  modified_base (383)..(383): a, c, t, g, unknown or other
  modified_base (385)..(385): a, c, t, g, unknown or other
  modified_base (394)..(394): a, c, t, g, unknown or other
  modified_base (406)..(406): a, c, t, g, unknown or other
  modified_base (408)..(408): a, c, t, g, unknown or other
  modified_base (410)..(410): a, c, t, g, unknown or other
  modified_base (412)..(412): a, c, t, g, unknown or other
  modified_base (455)..(455): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttctgtagttatttagaagtgtcagtgtgaggtgcacttggtggagtcgtggggggagcttggtccaggccgggggggtccctgagctctcctgtgcagtctctggntcaccctagtagtattggatgccgtggtcgccnggcnccgagggaggggngnggngnggngacanaanaanaagagaganaagaaacatgtgatgtagngcgacgactcacactacacananacaacacanatacatatatananananacagcgagagaggacgacggacgacgacgtagtagtagtgtgngcgagagtagagtagtacgttacgttacttacgtaagtagtgtaggtaggttagtgttgtg

SEQ ID NO: 370900 - DNA, 601 bp, Homo sapiens
  misc_feature: GZ8MTXP01A549M.15.67.G01.1.454.CMB.2.raw
  modified_base (500)..(500): a, c, t, g, unknown or other
  modified_base (543)..(543): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttcgtgttagttatttagaaggtgtcagtgtgaggtgcacttggtggagtcgtgggggaggcttggtccgaggcccgggggggtccctgagactctcctgtgcagtctctggattcacccttagaagtattggattgaccgtgggtcccgccgaggcctccgaggggaaggggcgaagggaggtgggggtggcccaaacaataaaaccgaaagacggaaagtaccgaaagaaaaaacctagtgttagggaacttccgtagtacggaacgggcccattccaacctatcctaccgagaacgacaacgaccaagtaatcactgttattgacaaatagaacacgacgngagaggacggacggacgacggaccgtagtagttattgtgcggngagagtagagtagtaagacgttcttacgtaagtagaacggtggtaggttagtgttgtg

SEQ ID NO: 370901 - DNA, 596 bp, Homo sapiens
  misc_feature: GZ8MTXP01D3VK0.15.67.G01.1.454.CMB.2.raw
  modified_base (376)..(376): a, c, t, g, unknown or other
  modified_base (569)..(569): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattcacccttagaagtattggatgacctgggtccgccaggctccgaggggagggctgggagtgggtgaccaacaataaacaaagacggaagtacaagaaaaacctntagtggactcgtagtagaaccggccgtaattccacctatcctaccgaagacgaacaacggacccaaagaacttcaacttgtaatttgacaaaatgaaacagacctgaaggaggacggaggaccgacggtccgtaggtattagtggtgccgaagagagtgttaagtagtagttaacgttcttaacgaaggtagngtaagggtgttaagtgttaagtttcgg

SEQ ID NO: 370902 - DNA, 574 bp, Homo sapiens
  misc_feature: GZ8MTXP01B3QZ3.15.67.G01.1.454.CMB.2.raw
  modified_base (434)..(434): a, c, t, g, unknown or other
  modified_base (548)..(548): a, c, t, g, unknown or other
  modified_base (556)..(556): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacgttggtggagtcgtgggggaggcgttggtccgagggcccggggggtccctggagactctcctgtgcagtctcgtggattcacccttagaagttattggatgacctgggtcccgccgaggctccgaggggaaggggctgggagtgggtcggaccaaacaataaaacaaaggacggaaagtacgaaagaaaaaaccctgtgtaggaacctcgtagtagaacggccgattccaccatcnccagacacaacgccaagtaatcactgtatttgacaaatgaacagccgtagagacggcgaggaccgacggcgtagtagttagtgtgcggtaacagatgagtagtagacttcttanaagtacgngagggtgttatgaatttg

SEQ ID NO: 370903 - DNA, 563 bp, Homo sapiens
  misc_feature: GZ8MTXP01AJTWA.15.67.G01.1.454.CMB.2.raw
  modified_base (265)..(265): a, c, t, g, unknown or other
  modified_base (270)..(270): a, c, t, g, unknown or other
  modified_base (334)..(334): a, c, t, g, unknown or other
  modified_base (384)..(384): a, c, t, g, unknown or other
  modified_base (510)..(510): a, c, t, g, unknown or other
  modified_base (514)..(514): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggcccgggggggtccctgagactctcctgtgcngtctntggattcacccttagaagtattggatgacctgggtccgccaggctccgaggggaggggctgggngtgggtggaccaagaataaaacgaaagacggaaagtacaagaaaaacctngtggactctaggtacgaacggccgattcaccatctcagacgacaacggccaaagattacactagttatttcgacaaatgaacagccgtagagaggacgaggacgcggaccgtgtattgtgtgcggngagntgagtagtcgacttcttacgaagtggcgaggtggttatggttaacttgg

SEQ ID NO: 370904 - DNA, 610 bp, Homo sapiens
  misc_feature: GZ8MTXP01A8ECG.15.67.G01.1.454.CMB.2.raw
  modified_base (306)..(306): a, c, t, g, unknown or other
  modified_base (310)..(310): a, c, t, g, unknown or other
  modified_base (346)..(346): a, c, t, g, unknown or other
  modified_base (435)..(435): a, c, t, g, unknown or other
  modified_base (552)..(552): a, c, t, g, unknown or other
  modified_base (579)..(579): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctgacgactctcctgtgcagtctctggattcaccttagaagttatggatgacctgggtccnccgnggcctccgaggggagggctgggagtgggtgaccaanaataaaacgaaaggaacggaagtacaaaggtaaaaaccctagtggtaggactcgtaggtacgaaccggccgtaagttccacccagttcncaagacgaaccaacgaccaaagaattcacttagttatttgaacaaatagaacagcgtaggaacggaggacggacggaccacgggtccgtagttattagttggtacgcgaacgagttntggactagtacgttacttcgttaacgngttagcgtaagggtgttaagtcgttaagttg

SEQ ID NO: 370905 - DNA, 601 bp, Homo sapiens
  misc_feature: GZ8MTXP01AMJSW.15.67.G01.1.454.CMB.2.raw
  modified_base (309)..(309): a, c, t, g, unknown or other
  modified_base (349)..(349): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccgaggccgggggggtccctgagactctcctgtgcagtctcgtggattcacccttagaagttagttggactgacctcgggtccnccgaggctccgaggggaggggctggagtgggtgaccaaanataaacgaaagacggaatacaaagaaaaacctgtgtaggaactctagtacggaacggccgattcacctatctaccaagacgaacaacgaccaaagtaacttaccatagttatttcgactaaagtcgaaacaggaccctagggaacgagggacggaagcgacggtccgttagtattagtgtacgccgaaggagttagtaggatacgggtacacttcttaagtaagagaacgtaagggtggatgttaacgtttg

SEQ ID NO: 370906 - DNA, 699 bp, Homo sapiens
  misc_feature: GZ8MTXP01B9DHU.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccaggccgggggggtccctgagactctcctgtgcagtctctggattcacccttagaagtattggatgaccgtgggtccgccgaggctccgaggggaaggggcgtgggacggtggggtcggaccaaacaataaaacgaaaggaacggaaagtacgaaagtaaaaaaccctagtagtagggtaacctcgtaggttacggaaccgggcccgtaaatttccaaccacttcctaccaaagaacgaaccgaaaccggacccaaaggtaaacttacctaaacgtttggttaacttttggaactaaaacgtacgaaaccacggtacccgttagggaagggaacgggacggaacgggaccgaccgggtccgttagttacgttagttggtagccggcggtaagttagtaggaacgttaaggtacggttaacttcgttaaccgaaggtacgtaacgttaggggtggttaatgggttaatttcggg

SEQ ID NO: 370907 - DNA, 563 bp, Homo sapiens
  misc_feature: GZ8MTXP01BNXMO.15.67.G01.1.454.CMB.2.raw
  modified_base (305)..(305): a, c, t, g, unknown or other
  modified_base (341)..(341): a, c, t, g, unknown or other
  modified_base (371)..(371): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccagggcccgggggggtccctgagactctcctgtgcagtctctggattcaccttagagtatggatgacctgggtccncaggctccgaggggagggctggagtgggtggccaanataaacaaagacggaatcaagaaaaacctntgtggactcgtagtagaacggccgtattcacctatctaccagacgacaacgaccaaagaattcaacttgttactttgacaaatgaaacacgccgtagaaggaggacggaaggacgacgggtccgtagttattagtgtggcgcgagatgagtaagtacgattccttagaagtagcgaggtggttatgaagttg

SEQ ID NO: 370908 - DNA, 614 bp, Homo sapiens
  misc_feature: GZ8MTXP01C2TU3.15.67.G01.1.454.CMB.2.raw
  modified_base (383)..(383): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgtttattttagaaggtgtccagtgtgaggtgcacgttggtggagtcgtggggggaggcttgggtccgaggcccgggggggtccctgagactctcctgtgcagtctctggattcacccttagaagtatggatgacctggtccgccaggctccgagggaagggctggagtgggtggaccaacaataaaacaaaggacggaaagtacaaagaaaaaacctntaggtggaactcgtaggtgaaccgggccgaattacaccatctccaagagacaaacgacaaagaattcaactagtatttgacaaaatgaaactagccgtaggaagacgggcgaacggacgacgggccgttaggtattaagtgtgcggtcgaagttattagagttaaagtaaggttacgttcttaacgtaaggttaagcggtaaggggttgggttaagttggttaacgtttgg

SEQ ID NO: 370909 - DNA, 612 bp, Homo sapiens
  misc_feature: GZ8MTXP01DF03N.15.67.G01.1.454.CMB.2.raw
  modified_base (349)..(349): a, c, t, g, unknown or other
  modified_base (388)..(388): a, c, t, g, unknown or other
  modified_base (556)..(556): a, c, t, g, unknown or other
  modified_base (583)..(583): a, c, t, g, unknown or other
  modified_base (591)..(591): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggcccgggggggtccctgagactctcctgtgcagtctctggattcacccttagaagtattggatgacctgggtccgccaggctccgaggggaagggctgggaggtgggtgaccaaanaataaaacaaaggaacggaagtcaaagtaaaaaaccctntaggtggaacctcgtaggttacgaacgggcctattaccacctatcctaccgaagacgaacaacgacccaaagtaacttacaacgttgttaatttgacctaaaagtgaaacacgccgtaggaggaacggcggaaggaccgaccggccgttagtagtttagtgtcggcgngagatagagtacgtagttacttcttanaaggtagngtagggtgttatgttaacgtg

SEQ ID NO: 370910 - DNA, 605 bp, Homo sapiens
  misc_feature: GZ8MTXP01AC8PH.15.67.G01.1.454.CMB.2.raw
  modified_base (586)..(586): a, c, t, g, unknown or other
  modified_base (600)..(600): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcttgggtccgagggccgggggggtccctgagactctcctgtgcagtctctggattcacccttagaagtattggatgaccgtgggtccgccaggctccgaggggaaggggctgggaggtggggtggaccaaacaataaaacgaaaggaacggaaagtacaaagaaaaaaccctagtaggtaggactcgtaggttacggaacgggccgaattccaccctatctcccaagacgaaccaaacggaccaaagtaacttacacgttagttatttacgactaaatagaaacaggaccgtagaggaggacggaggacgacggccgtagtattagtgtgcgcgagatgagtagtagacttcttacgaagtcgngtagggtgttatgngttgg

SEQ ID NO: 370911 - DNA, 635 bp, Homo sapiens
  misc_feature: GZ8MTXP01BSRM6.15.67.G01.1.454.CMB.2.raw
  modified_base (609)..(609): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccagggcccgggggggtccctgagactctcctgtgcagtctctggattcaccttagaagtatggatgacctgggtccgccaggctccgaggggaggggctgggaggtgggtggaccaaacaataaaacgaaagaacggaaagtacaaagaaaaaacctgtagtaggtaacttgtaaggtacgaaccggtcgtaacttccacctacttcccacgaaaggaacgaaaccgaaaccgaacccgtaaagtaacttactaacgttagtttatttagaaactaaaagtacgaaacgacgtacgggtaggaacggaggacggaggaccgacggtcgttagtattagtgtgcggaagagagtgaacgtaagtaacgacttgacgtaagtagngtagggtgttagtgttaagtttcggg

SEQ ID NO: 370912 - DNA, 780 bp, Homo sapiens
  misc_feature: GZ8MTXP01AOL9N.15.67.G01.1.454.CMB.2.raw
  modified_base (311)..(311): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtggggggaggtcttgggtccgaggtccgggggggtccctggagactctcctgtgcagtctctggacttcacccttagaagtattggatgaccgtgggtccncgaggctccgaggggagggcgtggagtggggtgaccaacgaagtaaacgaaaggacggaaagtcaagaaaaaaccctgtaggtaggtaactccgtaagggttagaaccgggccgtaaactttccaaccctagtcccttacccgaaaggacgaaaccgaaaccggaacccaaaggtaaactttactaaaccgttaggtttaaattttacggaacctaaaaagttacggaaaacgttaccggaccccgggtttaaggggaagggaaacgggggaccgggtaaaccggggtaacccggaacccggggttacccgggttaggtttaaacgtttaacggtttagggttccggcgggaaccgggtaaggttaagtttacgggaacgtttaagggtaacgttaccccgtttcgaaacgtaagggtaaacggtcggttaaaggggtgggtttaacgttcccgggttaaggtttcggg

SEQ ID NO: 370913 - DNA, 682 bp, Homo sapiens
  misc_feature: GZ8MTXP01EMOJ0.15.67.G01.1.454.CMB.2.raw
  modified_base (323)..(323): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttatttagaaggtgtccagtgtgaggtgctacgttggtggaggtcggtggggggaggtcgtttgggtccgacggggcccgggggggtccctggacgactctccgtgtgcagtctctggtattcacccttagtaagtatggatgaccgtgggtccnccgaggctccggagggggaagggcgtgggaggtggggtcggaccaaacaaataaaacgaaaggacggaaagtacaaagaaaaaccctgtagtggactctaaggagaacgggcctattccacctatctacgagacgaacaacgacaaagtaacttactaacgttgttaatttcgaactaaaagtacgaaacacgtaccggtaaggacgggaacgggacggaacgggaacccgacggggtacccgttaggttaagtttagttggtcggccggaacggaaggttataggttaaagttaggtaacggttacttccgttaaagtaacggtagaacgtagggttggttaattcgttaagttttgg

SEQ ID NO: 370914 - DNA, 566 bp, Homo sapiens
  misc_feature: GZ8MTXP01AMQL2.15.67.G01.1.454.CMB.2.raw
  modified_base (304)..(304): a, c, t, g, unknown or other
  modified_base (378)..(378): a, c, t, g, unknown or other
  modified_base (392)..(392): a, c, t, g, unknown or other
  modified_base (411)..(411): a, c, t, g, unknown or other
  modified_base (416)..(416): a, c, t, g, unknown or other
  modified_base (447)..(447): a, c, t, g, unknown or other
  modified_base (449)..(449): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggcccgggggggtccctgagactctcctgtgcagtctctggattcaccttagagtatggatgacctgggtccncaggctccgaggggagggctgggagtgggtcggccaacaataaaccaaaggaccggaagtacaagaaaaacctntgtggacctgtagngaacggccaatcaccatcncaganacaacgcaagattcaatgtaattgactaaananacacgcggagaggaggacggacggacgacggtacggtacgtagttagtgtcgcggcgagagtagagtaagtaacgacgttacgttacgtaagtagtcgtaggtaggttagtgttgtg

SEQ ID NO: 370915 - DNA, 554 bp, Homo sapiens
  misc_feature: GZ8MTXP01BG4M3.15.67.G01.1.454.CMB.2.raw
  modified_base (332)..(332): a, c, t, g, unknown or other
  modified_base (340)..(340): a, c, t, g, unknown or other
  modified_base (377)..(377): a, c, t, g, unknown or other
  modified_base (505)..(505): a, c, t, g, unknown or other
  modified_base (538)..(538): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcacccttagaagtatggatgacctgggccgcaggctccgaggggagggctggagtggnggaccaanataaacgaaagacggaaagtcaagaaaaacctgtagnggactctagtggaacggccgtattccaccatcctaccagacgaacaacgaccaaagaacttcaacttgtaatttgactaaatgaactagccgtagaggaggacgagacgcggcgtgtattatgtgcgngagagtgaatagtaattacgttcagtaagtagngaggtgattgaagttg

SEQ ID NO: 370916 - DNA, 730 bp, Homo sapiens
  misc_feature: GZ8MTXP01ATYCZ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctggttttccttgttgttatttagaaggtgtccagtgtgaggtgctacgttggtggaggtcggtgggggaggtcgtttgggtccgagggcccgggggggttccctggacgtactctccgtgtgctagtctcgtggtacttcctacccttagtaagttagttggattcggaccgtcgggtccccgccgacggccgtacccggaagggggaacggggcgtaggggtaggttcgggggtacggacccaaacaaagtaaaaaccgaaaaggaacggaaagtacaaaacgtaaaaaacccttgtagtacggactcgtaacggtacggaaccggccgtaacttaccaaccgtatcctacgaacgacgaaccaaaccggaccaaaaggtaacttaccgtaacttagttaactttacgaactaaaacgtcgaaacgcggaccgtaggaacggacgggacgaacgggtaaccgacgggccgtttagttaagtttgttacggtcgtccgggaagtaagttagtagttaagttaacgtacgttaacgttccgttaagaacgtagcgtaagggttgttagttgttaagtttgg

SEQ ID NO: 370917 - DNA, 557 bp, Homo sapiens
  misc_feature: GZ8MTXP01DF02F.15.67.G01.1.454.CMB.2.raw
  modified_base (320)..(320): a, c, t, g, unknown or other
  modified_base (335)..(335): a, c, t, g, unknown or other
  modified_base (337)..(337): a, c, t, g, unknown or other
  modified_base (369)..(369): a, c, t, g, unknown or other
  modified_base (439)..(439): a, c, t, g, unknown or other
  modified_base (441)..(441): a, c, t, g, unknown or other
  modified_base (444)..(444): a, c, t, g, unknown or other
  modified_base (446)..(446): a, c, t, g, unknown or other
  modified_base (448)..(448): a, c, t, g, unknown or other
  modified_base (489)..(489): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggagcttggtccgaggccgggggggtccctgagactctcctgtgcagtctctggattcacctagagtatggatgacctgggtccgccagctcgaggggaggcnggagtgggtgccaananaaacgaaagacggaaagtcaagaaaaaccctntgtggactctaaggtcgaacggccgattcaccagtctcagagacaacgaccaagaattacactgtattananaanananagacgagagagacgacgacgacggcgtagtattagttgtgngcgagagtagagtaagtagttacgttcgttacgtaagtagtaacgtaggtaggttagtaagttaagtg

SEQ ID NO: 370918 - DNA, 598 bp, Homo sapiens
  misc_feature: GZ8MTXP01A3DM8.15.67.G01.1.454.CMB.2.raw
  modified_base (297)..(297): a, c, t, g, unknown or other
  modified_base (324)..(324): a, c, t, g, unknown or other
  modified_base (332)..(332): a, c, t, g, unknown or other
  modified_base (530)..(530): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggttttcttgttagttatttagaaggtgtcagtgtgaggtgcattggtggagtcgtgggggagcttggtccaggccggggggtcctgagactctctgtgcagtctctggtacttcaccttagaagttatggatgacgtggtccncaggctcgaggggaggctggaggtggngaccaaanaataaacgaaagacggaagtacaaagaaaaacctgtagtaggactcgtagtacgaacgccgtattcaccatcctacagacgaacaacgaccaaagaacttacacttagttattagaactaaagtacgaaacacgccggtaggaagggacggacggaaggtaccgacggtccgtagttattagtcgtgcggaagagttntagagtaaaggtacacgttcttaacgtaaggtacggaaggtaagggtgttaagtggttaagtttccgg

SEQ ID NO: 370919 - DNA, 627 bp, Homo sapiens
  misc_feature: GZ8MTXP01DIQQY.15.67.G01.1.454.CMB.2.raw
  modified_base (307)..(307): a, c, t, g, unknown or other
  modified_base (557)..(557): a, c, t, g, unknown or other
  modified_base (603)..(603): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcgttggtccgaggcccggggggtccctgagactctcctgtgcagtctctggattcacccttagaagtatggatgacctgggtccncaggctccgaggggaggctggagtgggtggaccaacgaataaaacgaaagacggaaagtcaaagtaaaaaaacctgtagtcggaacttcgtaggtacgaaccgggcccgtaatttcccaacctatcctaccaaggacgaacaaaccggacccaaaagtaacttcaacgttgttaatttagaactaaaatgaaacgagacccgtaggaagacgggacgaaggtaccgacggtccgttagttattagttggngtccgaaggagagtgaagtagtacgacttcttaacgaaggtaacgngtagggtgttatgttaacgtttgg

SEQ ID NO: 370920 - DNA, 638 bp, Homo sapiens
  misc_feature: GZ8MTXP01BG6KH.15.67.G01.1.454.CMB.2.raw
  modified_base (271)..(271): a, c, t, g, unknown or other
  modified_base (466)..(466): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttggtccgaggcccgggggggtccctgagactctcctgtgcagtctcnggtacttcacctagaagtatggatgacctgggtccgccgaggctccgaggggagggctggagtgggtcggaccaacaataaacgaaagacggaagtacaagaaaacctgtagtggactcgtagtagaacggcctatccacctaatcctaccagacgacaacgaccaagaacttacactgttatttagacaaagtnaaacgagtaccgtaggaacggaacgggacggaagggaacccgacgggtaccgttaggttaagtttacgtaggttcggcggaacggaaggttagttaggttaagttaaaggtaaggttaccttacgttaaccgtaagggttaacggcggtaagggtaggttagtgttaagttg

SEQ ID NO: 370921 - DNA, 668 bp, Homo sapiens
  misc_feature: GZ8MTXP01AQ0PN.15.67.G01.1.454.CMB.2.raw
  modified_base (374)..(374): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtcctgagactctcctgtgcagtctctggacttcacccttagaagtatggatgacctggccgcaggctccgaggggagggctggagtgggtaggaccaacaataaaacgaaagacggaagtacgaagaaaaacctntagtggactctaggtacgaaccggccgtacttaccaaccgtatacctaccgaagacgaaccgaaaccgacccaaacgtaaacttcaaccttagttaactttgaacctaaatacgaaacacggacccgtaggaacggacgggacgaacgggaccgaacggtcccgttaagtacgtttagtggtcgcggaacgaagttaggttacgttaagttaaacgggtaagaaccgtttaccgttaacgtaacggttaaggtaaccggtaaggggtttaggttacgtaaggttaacgttttgg

SEQ ID NO: 370922 - DNA, 854 bp, Homo sapiens
  misc_feature: GZ8MTXP01BTN1Q.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttccttgttgttatttagaaggtgtcagtgtgaggtgctacgttggtggagttcggtgggggaggtcgtttgggtccgacggggtcccgggggggtccctggacgtaccttctccgttggtcgtctacgttccttcgtggtaacttcctaacccgtttaaggtaaagttagttaggtaacttcggacccgttcgggtccccgccgacggcctaccgggagggggaacggggtcgtggggagggttggggtacgggtaccaaaacgtaaacgtaaaaacgaaacggtaacgggtaaagtaccgaaaaggtaaaaaacccttggtaggtacggtactcgtaacgggttaacggaaccggggtacctacgttacccaacccgtacttccgtacgaaacggaacgaaaccaaaccggaccctaaagtaactttacgtaaccgtttaggtttaatttaacggaaaccaaaacgttaggaaaaccgtacggtacccgggttaaaggggaaccggggtaacgggaccgggaaaccggtaacccgggtaaccggggttacccggttaggtttaaactttagggttttggtacgggcccgggtaaacggtaaggttagttacggttaaagtttaaaggtaacggttaacttcccgttaagtaaggtacggtaaggtagggttagttaggttgttaagttttaaggg

SEQ ID NO: 370923 - DNA, 630 bp, Homo sapiens
  misc_feature: GZ8MTXP01ADTVC.15.67.G01.1.454.CMB.2.raw
  modified_base (519)..(519): a, c, t, g, unknown or other
  modified_base (571)..(571): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggccgggggggtccctgagactctcctgtgcagtctctggattcacccttagaagtattggatgacctgggtccgccaggctccgagggagggcgtggaggtgggtggccaaacaataaaaccgaaagaacgggtaaagtacgaaagaaaaaaaccctagtaggtagggtaacctcgtaagggttaggaaccgggcccggtaactttaccaaccctaatcttaccccgaagacgaaccaaacggacccgaaagaacttacaacgtagttatttagacaaatacgaaanacgaccgtagaacggaggacgaggacgacggaccgtgtattagtgtggtcgngagatagagtaaggtgttacgttcttacgtaagtagcgtagggtggttatggaagtttg

SEQ ID NO: 370924 - DNA, 553 bp, Homo sapiens
  misc_feature: GZ8MTXP01CLBLJ.15.67.G01.1.454.CMB.2.raw
  modified_base (371)..(371): a, c, t, g, unknown or other
  modified_base (463)..(463): a, c, t, g, unknown or other
  modified_base (499)..(499): a, c, t, g, unknown or other
tcagtctacgtagccacgaccggtgctcgatttagagtatacatattgggtttggggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagttatggatgacctgggcccgccaggctccgaggggaggggctgggagtggtggccaacataaacaagaggaagtcaagaaaaactnagtggactctgtagaacggccagttccaccatcctcagacgacaacgccaagaattcactgtatttgacaatagaacagcctagggagaggngagacgacggccgtagtatattcgtgcgcgaagagngattagtaggacttgttacaggtaagctgggtaggtattagtaagttcgttaag

SEQ ID NO: 370925 - DNA, 589 bp, Homo sapiens
  misc_feature: GZ8MTXP01DEYGY.15.67.G01.1.454.CMB.2.raw
  modified_base (348)..(348): a, c, t, g, unknown or other
  modified_base (482)..(482): a, c, t, g, unknown or other
  modified_base (564)..(564): a, c, t, g, unknown or other
  modified_base (571)..(571): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtgggagtcgtgggggaggcttggtccgaggccgggggggtccctgagactctcctgtgcagtctctggattcacccttagaagtatggatgaccgtgggtccgccgaggcctccgaggggagggctgggagtgggtcggaccaanaataaaacgaaagaacggaaagtacaaagaaaaacctatggtagactcgtgtacgaacggctacgttcacctatacctccaagacgaacaacgtaccaaagtaatactacgttagttatttacgaactaaatanaacgacgcgtaggacggaggacgaggaccgacggtcgtagtattagtgtgcgtgagttatgaagtagacgttacttcgttanggtaagngtaggtgttagtgttgtg

SEQ ID NO: 370926 - DNA, 735 bp, Homo sapiens
  misc_feature: GZ8MTXP01AWDLM.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccggggggtcctgagactctcctgtgcagtctctggattcacccttagaagttattggatgaccgtgggtccgccaggctccgaggggaacggggctgggagtgggtcggaccaaacaataaaacgaaaggaaccggaaagtacaaagaaaaaaccctgtgtaggaactcgtaggtacgaacggcgtacttcaccctatcctaccgaagacgaaccaaaccgacccgtaaagtaaactttactaaccgttaggtttaactttaggaaccgtaaaacttagggaaaaccaacgggtaccccggttagggaaagggaacggggtacccgggaaaggggtaacccgaacggggtacccggttaggtttaaagttttaaggttgggttcggaccggtaacggtaaggaagttggttaaagttaaaccggttaaggaacccttacgttaaccgtaaggttaaacggggtaacggtaaggggttagggttaagttaacggttaacgtttgg

SEQ ID NO: 370927 - DNA, 614 bp, Homo sapiens
  misc_feature: GZ8MTXP01AG85R.15.67.G01.1.454.CMB.2.raw
  modified_base (542)..(542): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggagcgttggtccgaggccggggggtccctgagactctcctgtgcagtctctggattcacccttagaagtatggatgaccgtgggtccgccaggctccgaggggaaggggctgggaggtgggtggaccaaacgaattaaaacgaaaggacggaagtacaaagaaaaacctatgtaggactctggtacgaaccggcgattacgaccatcctaccaagacaacaacgaccaaagtaacttcactagttatttgactaaagtacgaaacacgccgtaggaggacggacggacgggacgtacccgggccgttagtatttaagttggtaccgngtaaccggaagagtgggattaaggacgttacttaccgttagtaagtagcgtagggtaggttagtgaagtttg

SEQ ID NO: 370928 - DNA, 593 bp, Homo sapiens
  misc_feature: GZ8MTXP01AOAYU.15.67.G01.1.454.CMB.2.raw
  modified_base (542)..(543): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtggggggaggcttggtccgaggccggggggtccctgagactctcctgtgcagtctctggattcacccttagaagttattggatgacctgggtccgccaggcctccgaggggaaggggctgggagtggggtggaccaaacaataaaacaaaggacgggtaaagtacaaggaaaaaaccctatggtaggtaactcgtagttacgaaccggcccgtattaccacctattcctccaaagacgaacaaacggacccaaagaacttacaactgttatttgacaaatagaacagccgtagaggaggacgaggacgacggccgtgtattattgtgcgnngatgagtaggtagacttcttacgaagtagcgtaagggtgttatgaagttg

SEQ ID NO: 370929 - DNA, 587 bp, Homo sapiens
  misc_feature: GZ8MTXP01EI7IW.15.67.G01.1.454.CMB.2.raw
  modified_base (434)..(434): a, c, t, g, unknown or other
  modified_base (480)..(480): a, c, t, g, unknown or other
  modified_base (529)..(529): a, c, t, g, unknown or other
  modified_base (547)..(547): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctgagactctcctgtgcagtctctggattcacccttagaagtattggatgacctgggtccgccaggctaccgaggggaaggggcgtgggaggtgggtggccaaacaataaaacgaaaggacggaaagtacaagaaaaacctatggtaggactcgtagtagaacggccgtattccacctatctaccgaganacaacgaccaaagaacttcaactagttatttacgacaaatgaaacncgaccgtaggaggagggcgagggaccacgggcgtagtattatggtgcgngagatgttaataggtaanacgttcttagaaggtagcgtagggtggttatgttaagttg

SEQ ID NO: 370930 - DNA, 588 bp, Homo sapiens
  misc_feature: GZ8MTXP01A7734.15.67.G01.1.454.CMB.2.raw
  modified_base (442)..(442): a, c, t, g, unknown or other
  modified_base (531)..(531): a, c, t, g, unknown or other
  modified_base (549)..(549): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtggggggagcgttggtccgaggcccggggggtcctgagactctcctgtgcagtctctggtattccacccttagaagttattggatgaccgtgggtcccgccgaggcctccgaggggaagggctgggagtgggtggaccaaacaataaaacgaaaggaacggaaagtacaaagtaaaaaaccctgtaggtaggaactctaggtagaacggccgattccaccatctacaganacaacgacaagactcactgttattgacaaatgaaacacgccgtaggagacggacggacggtacgacggtcgtagttagttagtgtgcgngtaagagtagagtagtanacgttcttacgaagtagcgtagggtgttagtgaacgttg

SEQ ID NO: 370931 - DNA, 754 bp, Homo sapiens
  misc_feature: GZ8MTXP01CIRKM.15.67.G01.1.454.CMB.2.raw
  modified_base (639)..(639): a, c, t, g, unknown or other
tcagtctacgtagccacgaccggtgctcgatttagagtatacatattgggtttggggtctcagagaggagccttagccctggactccaaggcctttccacttggtgatcagcactgagcacagaggactcaccatggagttggggctgagcttgggttttccttgttgttattttagaaggtgtccagtgtgaggtgcacgttgggtggtagtcgtggggggaggtcgttggtccgagggccggggggtcctgagctctctgtgcagtctctgattcacccttagaagttatggatcgaccgtgggtcccgccgaggccgtccgaaggggagggggctggggaggtggggtgacccgaaacaagtaaaaacaaaggaacggaaagtacaaaaggaaaaactgttaggtggaactgtaggtaaggaaccgggtcccgaatttcccaacctactcctaccgagaaacgaaccaaaccgacctaaaagtaacttacgtaaccttagttaattttacggaactaaaagttacgaaaacctaggacccgttagggggaaacggaacgggggaccggaaacggggaccgtaacccggggtacccggtttaggtttaaacgtttaggttttaggtcggtaccgggnggaaaggtgttaggtaaagttaggtaaacgtaaccgttaccttaaacgttagggttaacgggccggttaagggggtttaggggttaaattcgggggtaattttcgggttttaagg

SEQ ID NO: 370932 - DNA, 586 bp, Homo sapiens
  misc_feature: GZ8MTXP01C1JHF.15.67.G01.1.454.CMB.2.raw
  modified_base (290)..(290): a, c, t, g, unknown or other
  modified_base (304)..(304): a, c, t, g, unknown or other
  modified_base (322)..(322): a, c, t, g, unknown or other
  modified_base (330)..(330): a, c, t, g, unknown or other
  modified_base (337)..(337): a, c, t, g, unknown or other
  modified_base (521)..(521): a, c, t, g, unknown or other
  modified_base (566)..(566): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcttggtccgagggcccggggggtccctgacgactctccgtgtgcagtctctggattcaccttagaagtntgatgacgtggccncgagctcgaggggaggcnggagtggngaccaanaataaacgaggacgaagtacaaagaaaacctgtagtgactgtagtagaaccggccgtattaccacctatctaccaagacgaaccaaacgaccaaagaacttacaacttgttaatttacgaactaaagtgaaacacgacgtaggaggaaggacgaaggacgacggtccgttagtagttagtgcgngtaacgagagtgagttaaggtgaaccttcgttaacgaaggtacgngtagggtgttatgaagtttg

SEQ ID NO: 370933 - DNA, 716 bp, Homo sapiens
  misc_feature: GZ8MTXP01BUQ4G.15.67.G01.1.454.CMB.2.raw
  modified_base (317)..(317): a, c, t, g, unknown or other
  modified_base (358)..(358): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagtcttgggttttcttgttgtttatttagaaggtgtcagtgtgaggtgctacgttggtggagtcggtgggggaggtcgttggtccgaggggcccgggggggtcctggacgactctccgtgtgcagtctcgtggtattcaccttagaagtatggatcggacctgggtccncaggcctcggaggggagggctgggaggtgggtcgaccaaanaaataaaacgaaagacgggtaaagacaaaaggtaaaaaacctgtaggtacggaactcgtaaggtacggaaccgggtctaaacttccgaaccctaattccctaccgaagaacgaaccaaaccgaccaaagtaactttacaacttaggtttaatttgaaactaaagtacgaaaacgtacgccgtaaagggaacggaagggacccgggaaaggaaccggaccggggtacgttaaggtttatttaaggttccggtaggtcccgtaagttaagagtaggttaagttaacggttaacgaacccttgttaaaccgtaaggttaacggcggttaggggttaggttaaattggttaaccgttttggg

SEQ ID NO: 370934 - DNA, 569 bp, Homo sapiens
  misc_feature: GZ8MTXP01B0IDW.15.67.G01.1.454.CMB.2.raw
  modified_base (310)..(310): a, c, t, g, unknown or other
  modified_base (383)..(383): a, c, t, g, unknown or other
  modified_base (565)..(565): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttgggtccgagggcccggggggggtccctgagactctcctgtgcagtctctggattcacccttagaagtatggatgacctgggtccncaggctccgaggggaagggctggagtggggtggaccaacaataaaacaaagacggaaagtcaagaaaaacctntgtgactctagtgaacggcgattcaccatctaccagagacaacgaccaaagattcaacttgttaatttgacaaagtgaaacaggccgtaggaaggacggacggaaggaccgacgggtccgtaggtatttagtgtgcgcgagatgagtagtacgacttcacaagtagcgtaggtggttatggnttgg

SEQ ID NO: 370935 - DNA, 566 bp, Homo sapiens
  misc_feature: GZ8MTXP01DTZX2.15.67.G01.1.454.CMB.2.raw
  modified_base (267)..(267): a, c, t, g, unknown or other
  modified_base (533)..(533): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccgaggcccgggggggtccctgagactctcctgtgcagtctntggattcacccttagaagtatggatgacctgggtccgccaggctccgaggggagggctgggagtgggtgaccaacaataaacaaagacggaaagtcgaaagaaaacctatagtgactctagtagaacggcgtacttcaccatctccaagacgaacaacgacaaagaattcaacttagttatttagactaaatagaacagccgtagaggaggcgaggacgcggcgtagtattagttgtgcggaagagagtagaagtaagtagacttnttaacaagtagcgtagggtgttatcgaagtttg

SEQ ID NO: 370936 - DNA, 570 bp, Homo sapiens
  misc_feature: GZ8MTXP01C1P50.15.67.G01.1.454.CMB.2.raw
  modified_base (381)..(381): a, c, t, g, unknown or other
  modified_base (508)..(508): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattcacccttagagtatggatgacctgggtccgccgaggctccgaggggaaggggctgggagtggggtggccaaacaataaacgaaagacggaaagtcaagaaaaaacctntagtggactcgtagtagaacggtccgattccaccatctaccagacgacaacgccaagaattcactgtatttgacaaatgaaactagccgtagacgaggcgaggacgacggccgtagtagttattggngcgaacgagatgagtacggtgaacttcttacgaagtagcgtaagggtgttagtgaagttcgg

SEQ ID NO: 370937 - DNA, 687 bp, Homo sapiens
  misc_feature: GZ8MTXP01APB5N.15.67.G01.1.454.CMB.2.raw
  modified_base (349)..(349): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttcttgttgttattttagaaggtgtccagtgtgaggtgcacttggtggagtcgtggggggaggcttgggtccgaggccggggggtccctgagctctcctgtgcagtctctggattcaccttagtaagttattggatgaccgtgggtccgccaggctccgaggggacggggctgggagtgggtggaccaaanaataaaacgaaagacggaaagtcaaagtaaaaacctagtggtaggaactgtaagtggaaccggccgtattaccaccatcctacgaaagcgaaaccaaacggaacccaaaggtaaactttcaacgtttggttaattttcggaacctaaaagttagaaacctaacggcccgttaggaacggacggggacggaacggaaccgtaacgggtcccggttaagttagtttaaggttagttacgggccggaaggaagttaaggtacggttaaattacgggttaattacccttagttaaccgaaggttacgaacgttaagggtgggttaattgttaacgttttggg

SEQ ID NO: 370938 - DNA, 725 bp, Homo sapiens
  misc_feature: GZ8MTXP01AEY3A.15.67.G01.1.454.CMB.2.raw
  modified_base (616)..(616): a, c, t, g, unknown or other
  modified_base (653)..(653): a, c, t, g, unknown or other
  modified_base (699)..(699): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtgggggagtcttggtccgagggccggggggtccctgagactctcctgtgcagtctcgtggtacttcctaccttagtaagttattgggactcggaccgtcgggtcccgaccgacggtccgtaccgggaagggggacggggtcggtggggaacgggttcgggggtaccggaaccaaaagtaaaacgtaaaaacggaaaacggaaacgggtaaacgttaaacgaaaaaggtaaaaaaccccttggtagggtacgtaccttcgtagggtaaccggaacccgggtccctaacttacccaaccctactaccgtaacccgaaaggaaccgaaacaaacccggaccaaaagttacttacctaagttagtttaacttagaaactaaactaagaacgacgtcggaggaacggnggaacggtaacggacgtccggagtttagtagttacgngtcgcggaagtgagtgttaagtgtagttacccttgaacgtaagagnggttagggtgttagttaagcgttttg

SEQ ID NO: 370939 - DNA, 549 bp, Homo sapiens
  misc_feature: GZ8MTXP01ELPIB.15.67.G01.1.454.CMB.2.raw
  modified_base (300)..(300): a, c, t, g, unknown or other
  modified_base (491)..(491): a, c, t, g, unknown or other
  modified_base (505)..(505): a, c, t, g, unknown or other
  modified_base (509)..(509): a, c, t, g, unknown or other
  modified_base (518)..(518): a, c, t, g, unknown or other
  modified_base (525)..(525): a, c, t, g, unknown or other
  modified_base (531)..(531): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtcagtgtgaggtgcacttggtggagtcgtgggggagcttggtccgagggccgggggggtccctgagactctcctgtgcagtctctggattcaccttagaagtatggatgactggtccncaggctccgaggggagggctggagtgggtggacaaacaataaacgaaagacggaaagtacaagaaaaacctagtagtaggactcgtagtgaacggcgattcaccatctacagacacaacgacaagtaatctactagtattagactaaatagaaacacgccgtagaggaggacggaggacgacggtaccgtntagttagtgtgcgngagntgagtaganacttcanaagtancgtaggtgttatgttgtg

SEQ ID NO: 370940 - DNA, 629 bp, Homo sapiens
  misc_feature: GZ8MTXP01EXR0S.15.67.G01.1.454.CMB.2.raw
  modified_base (320)..(320): a, c, t, g, unknown or other
  modified_base (350)..(350): a, c, t, g, unknown or other
  modified_base (458)..(458): a, c, t, g, unknown or other
  modified_base (521)..(521): a, c, t, g, unknown or other
  modified_base (564)..(564): a, c, t, g, unknown or other
  modified_base (569)..(569): a, c, t, g, unknown or other
  modified_base (603)..(603): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgctacgttggtggtaggtcgtggggggaggtcgttgggtccgacgggtcccgggggggtccctagacgtactcctcctgtgcagtctctggattcaccttagaagtattggatgaccgtgggtccnccgaggcctccgagggggaagggcgtaggnggtgggtcggaccaaacaataaaacgaaaggaacggaaagtacaaagaaaaaaccctagtaggtaggactcgtaaggttcgaaccggtccgtaattccaacctatacncaagacgaacaaccggaccaaagtaatctacagtttaattgaacaaatagaaacacgtaccgnggaaggaggacgaggtacacggcctaggtattacgtgtcgcgngaagngtgttagtaggtacaccgttcttaacgaaggtanggaaggttgttaagttgaacgtttgg

SEQ ID NO: 370941 - DNA, 683 bp, Homo sapiens
  misc_feature: GZ8MTXP01AFFE2.15.67.G01.1.454.CMB.2.raw
  modified_base (313)..(313): a, c, t, g, unknown or other
  modified_base (352)..(352): a, c, t, g, unknown or other
  modified_base (389)..(389): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcttggtccgagggccggggggtccctgagactctctgtgcagtctcgtggtacttcacccgttagaagttattggatcgaccgtgggtccnccaggctccgaggggaggctgggagtgggtcgaccaaanaagtaaaacgaaagacggaatacaaagaaaaaccctntgtaggactcgtaggagaaccggtcaacttcaccctatccaccgaagacgaacaaaccggtaccaaaggtaacttcaacgttagttaatttacggaacctaaaagtacgaaacgtacgacccggttaggggaacggacggggaccgggaaacgggaccggttaacccggggcccggtttagggttaaactttaggttcggttggtacccgggaaggaagttagtagaaccgttaaggtaacgacgttccttaagaagttacggcgtaagggttggttaagtgttaaccgtttgg

SEQ ID NO: 370942 - DNA, 686 bp, Homo sapiens
  misc_feature: GZ8MTXP01BDJKC.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgctacgttggtgggagtcgtgggggaggtcgttgggtccgagggcccgggggggtccctggacgtactctcctgtgcagtctctggtacttcaccttagaagtattggatcgaccgtgggtcccgccgaggcctccgagggggaacggggcgtgggaggtggggtcggaccaaacgaaataaaacgaaaaggaaccggaaagtacaaagtaaaaaacctgtagtaggactcgtagtacgaaccggacgattccaccatctaccaagacaactaacgaccaaagtaacttacaacgttagttaatttacgaacaaaattacgaaacgacgtacccgtagggaaacggacggacgggaacggaacccgtaccgggtccgtaggtttaattaggttaggttcgccggtaacggaagttagtacgttaagttaaagtacgttaccgttcttaacgtaaggttagcgtaaggggttggttagttggttcgtttaagg

SEQ ID NO: 370943 - DNA, 586 bp, Homo sapiens
  misc_feature: GZ8MTXP01B10J9.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggttttccttgttgttatttagaaggtgtccagtgtgaggtgcacgttggtggagtcgtggggggaggcgttggtccaggccgggggggtccctgagactctcctgtgcagtctctggattcacccttagaagttattggatgacctgggtccgccaggctccaggggaggggctggagtgggtggccaacataaacaaagacggaaagtacaagaaaaaacctagtagtggaactcgtaggtagaacgggccgattccaaccatctccagacgaacaacgaccaagaacttcaactgttatttgacaaagtgaaacacgaccgtagaaggaggcggaaggaccgaacggccgtagtattagttgtgcgcggagagtgagttagtaggaacttcttaacgtaagtaaggcggtagggtgttagtgttaagttg

SEQ ID NO: 370944 - DNA, 616 bp, Homo sapiens
  misc_feature: GZ8MTXP01ATD6J.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtgggggaggcttggtccgaggccggggggtccctgagactctcctgtgcagtctctggacttcacccttagaagtatggatgaccgtggtccgcaggctccgaggggagggctggagtgggtcggaccaaacgaataaaacaaaaggacggaaagtacaaagaaaaaacctgtagtaggactcgtagtagaaccggccgtatcaccatcacagacacaacgccaaagattacactgttatttgactaaatcgaaacagcccgtaggaaggacgggacggaacgggaacgaccgggtcccgttaggttaattacgtttgtacggccggaagaagttagtgaagttacgggtaagttacgttcgaacgtaagtaaggcgtaagggggtggttatggttaagtttgg

SEQ ID NO: 370945 - DNA, 658 bp, Homo sapiens
  misc_feature: GZ8MTXP01BR7LO.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcgttggtccgagggccgggggggtccctggagactctcctgtgcagtctctggtattccaccttagtaagttagttggatgaccgtgggtcccgccgaggctcccgaggggacggggcgtggggaggtgggtcggaccaaacaataaaacgaaaggaacggaaagtacaaagaaaaacctagtgtaggactctagggtacgaaccgggacccgtattcccaacccgtatacctaccgaaagaacgaaacccaaaccggaccaaaagtaacttaccgaactttggttaattttgaacaaaattagaaaccagtaccggtagaaggaacgggacggaaggaccgacgggtccgttagtaatttagtggtcgacggcgaggttatgagttagtacgaacttcgttaagaaggtacgtgtaaggggtggttatgttaacgttg

SEQ ID NO: 370946 - DNA, 826 bp, Homo sapiens
  misc_feature: GZ8MTXP01AUUXC.15.67.G01.1.454.CMB.2.raw
  modified_base (347)..(347): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccggggggtcctgagactctccgtgtgcagtctcgtggtattcacccttagtaagtattggatgacctgggtccgcaggctccgaggggaagggcgtggaggtgggtaggaccaaanaactaaaacgaaaggaacggaaagtacaaaggtaaaaaaccctgtaggtacggtacctcgttaaggttacgggaacccgggtccgtaatttacccaccctaatccgtacccaaacgggacgaaacccgaaaccgggtacccaaagggtaaactttccgtaaacgtttacggttaacttttagaacctaaaaaacgttaacggaaacgaaccgggtacccgttacggggaaaggggaacggggaacccgggttaaaacgggaacccggaaaccgggggttaccccgggtaaagggttttaaacgtttaacggtttaacgggtttggcccgggtaaacgggtaacggttaaacggttaggttaaaaccggttaagggttaaaccggttaaccgttacccggtttaaacggaacggggtttaaacggaacgggtaacggggtttagggggttaactttaacggggttaacggttttaacggg

SEQ ID NO: 370947 - DNA, 563 bp, Homo sapiens
  misc_feature: GZ8MTXP01CE5C9.15.67.G01.1.454.CMB.2.raw
  modified_base (334)..(334): a, c, t, g, unknown or other
  modified_base (453)..(453): a, c, t, g, unknown or other
  modified_base (508)..(508): a, c, t, g, unknown or other
  modified_base (545)..(545): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattcacccttagaagtatggatgacctgggtccgccaggctccgaggggagggctggagtgggnggccaaacaataaacaaagacgaagtcaagaaaaaccctatgtggactctagtacgaacggcgattccacatctacagacgacaaacgccaaagaattcaactgtaatttgactaaatnaacgagccgtaggaagaggacgaggaccacgggtaccgtagtattattcgtgcgngagatgacgtaaagtgacttcttacgaagtacgaagngggtggttatcgaagttg

SEQ ID NO: 370948 - DNA, 685 bp, Homo sapiens
  misc_feature: GZ8MTXP01DETAT.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtggaggtgcacgttggtggagtcgtgggggaggcgttggtccgagggcccggggggtccctgagctctcctgtgcagtctctggattcacccttagagttattggatgaccgtgggtccgccgaggctccgaggggaaggggcgtgggaggtgggtcggaccaaacaaataaaacgaaaggtaaccggaaagtacaaagtaaaaaacccttataggtggactcgtaggtacggaaccgggccgatttaccaacctactctaccgaagacaaccaaccgaccaaagtaacttacgaacttgttaatttgaacctaaatagaaacacggacccggtaggaacgggagggaccggagggaaccgtacgggtcccggttagttaatttagttcggtgccgggtaagaaggttagtaggagttaaacgggtacgttaaaccgttcgttaaacgtaaggttaagcggttagggttagggttagttaaggaagttttaaggg

SEQ ID NO: 370949 - DNA, 637 bp, Homo sapiens
  misc_feature: GZ8MTXP01DAHBA.15.67.G01.1.454.CMB.2.raw
  modified_base (310)..(310): a, c, t, g, unknown or other
  modified_base (391)..(391): a, c, t, g, unknown or other
  modified_base (500)..(500): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtgggagtcgtggggggaggctttgggtccgagggcccgggggggtccctggagactctcctgtgcagtctctggattcaccttagagtatggatgacgtgggtcccncaggctaccgaggggaaggcgtggaggtgggtggaccaaacaataaaacgaaaggacggaaagtacaaagtaaaaaacctntggtaggtaactcgtaagtacggaacccgggctattaccaacctatccaccgagacgaacaaacgacctaaagaaattccaagttagttatttagaactaaatgaaacncgaccgtaggaaggaggaccgaggaaccgcggtaccgttagtattagttggcgcgaagagttagtagaagttacgtacgttacgttcgttaacggtaagtacggaacggtaagggttaggttagtggttaagtttcg

SEQ ID NO: 370950 - DNA, 655 bp, Homo sapiens
  misc_feature: GZ8MTXP01AUSUQ.15.67.G01.1.454.CMB.2.raw
  modified_base (299)..(299): a, c, t, g, unknown or other
  modified_base (340)..(340): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtggggggaggcgttgggtcccgagggcccggggggggtccctggacgtacctctccgtgtgcagtctctggattcacctagaagtntggatgacctggtccgcgaggctccgaggggagggctgggngtgggtcgaccaaacaagtaaaacaaaggaacgaagtacaaagaaaaaccctgtaggtaggaactcgtaaggtacgaacggcgtattccactatctaccagacgaacaacggacccaaagtaacttacaacttagttatttacggaactaaatacggaaacacggaccgtagggacgggaaggacggggaacggaaccgccgggtaccgttagtagttaagttgggtcgcggtaacggagttagtagttaacgttaaggtacttacgttcgttaacgtaaggtaggaacggtagggttaggttacgtgttgttcg

SEQ ID NO: 370951 - DNA, 535 bp, Homo sapiens
  misc_feature: GZ8MTXP01EBOPQ.15.67.G01.1.454.CMB.2.raw
  modified_base (411)..(411): a, c, t, g, unknown or other
  modified_base (491)..(491): a, c, t, g, unknown or other
  modified_base (509)..(509): a, c, t, g, unknown or other
  modified_base (520)..(520): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggcccgggggggtccctgagactctcctgtgcagtctctggattcacccttagaagtatggatgacctgggtccgccaggctccaggggaaggggctggagtgggtggccaacataaacaaagacggaagtcaagaaaaacctatgtggactctgtgaacggcgattcaccatctcaganacaacgcaagaattcactgtattgacaaatgaaacagccgtagagaggacgaggacgacggccgtagtattattgtgcgngagatgatagtagacttnttacgaatagnaggtgttatgaagtg

SEQ ID NO: 370952 - DNA, 621 bp, Homo sapiens
  misc_feature: GZ8MTXP01C0XV8.15.67.G01.1.454.CMB.2.raw
  modified_base (545)..(545): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctcgtggacttcacccgttagaagttattggattgaccgtgggtccgccgaggctccgaggggagggctgggaggtgggtggaccaaagaataaaacgaaaggaaccggaagtacaagaaaaaacctagtagtggaactcgtagtacgaacgggctaattccaccatcctaccaagacgacaaacgccaaagtaattcacttgtatttagacaaatagaacacgtaccgtaggagggaacggacggaaggtaaccgacggtccggtagttagttattgggngcgaagtaagatgagttaacgtacgttacgttcgacgtaagtaggtaacggtagggttagttattaaggttcgttg

SEQ ID NO: 370953 - DNA, 603 bp, Homo sapiens
  misc_feature: GZ8MTXP01BDTRY.15.67.G01.1.454.CMB.2.raw
  modified_base (322)..(322): a, c, t, g, unknown or other
  modified_base (410)..(410): a, c, t, g, unknown or other
  modified_base (433)..(433): a, c, t, g, unknown or other
  modified_base (489)..(489): a, c, t, g, unknown or other
  modified_base (549)..(549): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgtttatttagaaggtgtccagtgtgaggtgctacgttggtggaggtcggtggggggaggtcgtttgggtccgacgggtcccggggggggtccctggagacctctccgtgtgcagtctcgtggattcacccttagaagtattggatgacctgggtccnccgagctccgaggggaaggggctggaggtgggtggaccaaagaataaaacgaaagaacggaaagtcaaagaaaaacctatgtagactntagtgaacggcgattcaccatcnccaagagaacaaccggaccaaagtaattcactagttatttacgactaaatgaaacncgaccggtgaagggacggacggaaggaccgacgggtccgtagttattagtgtgcgtgagntaggataaggtagacttcgttaacgtaaggtagcgtaagggtggttatgcgttg

SEQ ID NO: 370954 - DNA, 556 bp, Homo sapiens
  misc_feature: GZ8MTXP01E03QV.15.67.G01.1.454.CMB.2.raw
  modified_base (415)..(415): a, c, t, g, unknown or other
  modified_base (447)..(447): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttcttgttgttatttagaaggtgtccagtgtgaggtgcacgttggtggagtcgtggggggaggcgttggtccgagggcccgggggggtccctgagactctcctgtgcagtctctggattcaccttagaagtatggatgacctggtccgccaggctccgaggggaagggcgtggaggtgggtggaccaaacaataaaacaaagacggaaagtacaaagaaaaacctatgtaggactctagtgaacggccgatccacatcncagagacaacgccaagaattcactgtattganaaatgaaacagccgtgagaggcggaggacgacggcgtgtattattggtgcgcgaagatggttaatagtagacttcttacgaagtagcgtagggtggttatgttaagttg

SEQ ID NO: 370955 - DNA, 635 bp, Homo sapiens
  misc_feature: GZ8MTXP01ASQV8.15.67.G01.1.454.CMB.2.raw
  modified_base (303)..(303): a, c, t, g, unknown or other
  modified_base (319)..(319): a, c, t, g, unknown or other
  modified_base (358)..(358): a, c, t, g, unknown or other
  modified_base (477)..(477): a, c, t, g, unknown or other
  modified_base (609)..(609): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgtttattttagaaggtgtccagtgtgaggtgcacgttggtggagtcggtggggggaggtcgttgggtccgacgggcccggggggtccctggacgactctcctggtgcagtctcgtggacttcgacccttagaagtntggatgacctgggccncaggctccgaggggagggctggaggtgggtcgaccaaanaagtaaaacgaaaggacgaagacaaagaaaaacctgtggtacggactcgtaagtcggaacggcccgtaattcccacctatacctccgaagacgacaaacggaccaaagattcaacgttnttaattgaacaaatcgaaacacgcgtaggaggacggacgacggaccgcggtacgttggtatttgggtagtcggtccggaagtaaggttagttaggagttaaaggtacgttacgttcgttaacgaaggtacgngtaagggtgttaagtgttaacgtttg

SEQ ID NO: 370956 - DNA, 744 bp, Homo sapiens
  misc_feature: GZ8MTXP01CZYQ5.15.67.G01.1.454.CMB.2.raw
  modified_base (703)..(703): a, c, t, g, unknown or other
  modified_base (734)..(734): a, c, t, g, unknown or other
  modified_base (738)..(738): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttgggtccgaggccgggggggtccctgacgactctccgtgtgcagtctctggtacttcacccttagaagttatggatgaccgtgggtcccgccgaggcctaccggagggggaacggggtcgtggggaggttgggggtacggaccccaaaacgaaagtaaaaaaccgaaaagggaaccgggtaaaagttaccgaaaaggtaaaaaaaaccccttagtttacgggtacggggtaaaccttcggttaacgggttaacgggaacccgggtacccggtaaacttttaccccaaaccctaacttacccgtaaccccgaaaggaaacggtaacccaaaacccggaccccgtaaaagtaaactttacccaaacgtttagtttaagtttacgaaacctaaaagttacgaaacgacgtaccggtaggaagggaacgggacggaaggaccgacggccgttagtattagtgtcgtcgaagagatgagtaacgngttacttcaacgtaagtagcgtaggtagttntcgngttaag

SEQ ID NO: 370957 - DNA, 642 bp, Homo sapiens
  misc_feature: GZ8MTXP01C16I6.15.67.G01.1.454.CMB.2.raw
  modified_base (574)..(574): a, c, t, g, unknown or other
  modified_base (617)..(617): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgtttattttagaaggtgtccagtgtgaggtgcacttggtggagtcgtggggggaggcttgggtccgagggcccggggggtccctgagactctcctgtgcagtctctggattcaccttagaagttatggatgacctgggtccgccaggctccggaggggaaggggctgggaggtgggtcggaccaaacaagtaaaacgaaaggaacggaaagtacaaaggtaaaaaacctgtggtaggacttcgtagttaggaaccggccgtattccaacctatcctaccaaagacgaacaaaccgaccaagaacttcacttagttatttagaacaaatagaaactacgccgtaggaacgggacgggacgggaacggaccgtaaccgggtccgttaaggttatttagttggtcgcggngtaagttagtagttaagtaagtacgttacttcaacgtgtaggngtaaggggtgttagtgttaagtttg

SEQ ID NO: 370958 - DNA, 609 bp, Homo sapiens
  misc_feature: GZ8MTXP01BAVTY.15.67.G01.1.454.CMB.2.raw
  modified_base (561)..(561): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggttttccttgttgttatttagaaggtgtccagtgtgaggtgcacttggtggagtcgtgggggagcgttggtccgagggcccgggggggtccctgagactctcctgtgcagtctctggattcaccttagagtatgatgacctgggtccgcaggctccgaggggaagggctgggagtgggtcggaccaaacgaataaaacgaaaggaccggaaagtacaaagaaaaacctgtagtacggaactcgtaggtacgaacgtccgtaattccaacctatccaccagacgaacaaccgacaaagtacttacaacgtgttaacttgaactaaagtagaactaacgccgtagaggacggacgacggacaccggtcgtagttattagtgtgcgcgaagttagtgaaagtacggtaanacgtttccaacgtaaggagtaacgtagggtcggttaatcgggttgttg

SEQ ID NO: 370959 - DNA, 663 bp, Homo sapiens
  misc_feature: GZ8MTXP01A84OE.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggtttttccttgttgttattttagaaggtgtccagtgtgaggtgcacttggtggagtcgtgggggaggcttggtccgaggccgggggggtccctgagactctcctgtgcagtctctggacttcacccttagaagtagttggatgaccgtgggtccgccaggctccgaggggaaggggctggggaggtgggtacgggaccaaacgaataaaaccgaaaggacggaaagtacaaaggaaaaacctagtaggtaggtactcgtaaggtacgtaaccgggccgtaactttccaaccctatacccgtacaaacgacgaaaccgaaaccggacccaaaagaactttcaaccgttaggtttaatttacgaaccaaaagttacggaaacacggtaccgtaggaaaggacgggcggaacggtacgacgggtaccgtagttaattagtgtcgcggcgaagttagtgagttaagagttacgttcttaccgtaagtacgcgagggttgttaagttgaagttg

SEQ ID NO: 370960 - DNA, 640 bp, Homo sapiens
  misc_feature: GZ8MTXP01C3DK1.15.67.G01.1.454.CMB.2.raw
  modified_base (575)..(575): a, c, t, g, unknown or other
  modified_base (616)..(616): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggaggtcgtgggggaggcgttggtccgaggccggggggtccctggagactctcctgtgcagtctctggattcacccttagaagtatggatgaccgtgggtcccgccgaggctccgaggggaagggcgtgggaggtgggtggaccaaacgaaagtaaaaccgaaaggaacggaaagtacaaagtaaaaaacctagtaggtaggaccttcgtaggttacggaaccgggcccgtaacgtttaccaacccatccctaccgaacgaacgaaccaaaccgacccaaagaactttaccaacttagttaatttaggacaaaagtgaaaccagacccgtaggacggaggacggaaggacgaccggcgtagtattagttgngcgcgagagtagagtagtacgacttcgttaacgaaggtagngtagggtggttagtgaagtttcgg

SEQ ID NO: 370961 - DNA, 587 bp, Homo sapiens
  misc_feature: GZ8MTXP01DPL9Q.15.67.G01.1.454.CMB.2.raw
  modified_base (525)..(525): a, c, t, g, unknown or other
  modified_base (535)..(535): a, c, t, g, unknown or other
  modified_base (539)..(539): a, c, t, g, unknown or other
  modified_base (560)..(560): a, c, t, g, unknown or other
  modified_base (566)..(566): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagtaaggtgtccagtgtgaggtgcacttggtggagtcgtgggggaggcgttggtccgaggccggggggtcccgtgagactctcctgtgcagtctctggtattcaccccttaagtaagtattggatgaccgtgggtcccgccaggctcccgaggggaaggggcgtgggaggtgggtggccaaacaataaaacgaaagacggtaaaggcaaacggaaaaaacctagtagtaggactcgtagtgaacgggcccgtattaccaccctatcttccgaacgaggaacaaaccgtccaaaggaattacgactagtatttgacaaatgaacacgctgagaggcgagacgcggccgtagtnttagtgtgcngagntgagtagtgacttcttaacgngtacgntagggtgttagtgaacgtttg

SEQ ID NO: 370962 - DNA, 593 bp, Homo sapiens
  misc_feature: GZ8MTXP01ANRL1.15.67.G01.1.454.CMB.2.raw
  modified_base (464)..(464): a, c, t, g, unknown or other
  modified_base (545)..(545): a, c, t, g, unknown or other
  modified_base (552)..(552): a, c, t, g, unknown or other
  modified_base (566)..(566): a, c, t, g, unknown or other
  modified_base (576)..(576): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttccttgttgttattttagaaggtgtccagtgtgaggtgcacgttggtggagtcgtggggggaggtcgttgggtccgacgggcccggggggtccctgagactctcctgtgcagtctctggattcacccttagaagtattggatgaccgtgggtcctccaggctccgaggggaaggggctgggaggtgggtggaccaaacaagtaaaaacaaaggaaccggaaagtacaaaggaaaaaacctatggtgactctaagtcgaacggccgattacaccatcaccagacgacaacggaccaagaattcactnttatttagactaaaatgaaacagccgtaggaaggacggacggaacggaccgaacggtccgtagttagttagttgtcgcggngagttangagtagtagacttnactaagacgngaggtgttatgaagttg

SEQ ID NO: 370963 - DNA, 632 bp, Homo sapiens
  misc_feature: GZ8MTXP01BDYR5.15.67.G01.1.454.CMB.2.raw
  modified_base (308)..(308): a, c, t, g, unknown or other
  modified_base (348)..(348): a, c, t, g, unknown or other
  modified_base (571)..(571): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgagggccgggggggtccctgagactctcctgtgcagtctctggacttccaccttagaagtatggatgaccgtgggcccncaggctccgaggggagggcgtggagtggggtcgaccaaanaataaaacgaaaggaacggaaagtacaaaggtaaaaaaccctgtggtacggtactcgtaggtacggaaccggtccaactttcaccctagttccacaagacgaaccaaaccggaccaaagtacttacgactagttatttagaactaaatagaaacgacgaccggtaggaacggacgggacgggaacggaccgtaccgggtcgttagtagtttagtggtacgcgnggaagttataggaagtaggtacacttccagaagtagcgtagggtggttatcggaatttggg

SEQ ID NO: 370964 - DNA, 587 bp, Homo sapiens
  misc_feature: GZ8MTXP01A8R45.15.67.G01.1.454.CMB.2.raw
  modified_base (351)..(351): a, c, t, g, unknown or other
  modified_base (428)..(428): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggattcgtggggggaggcttgggtccgagggcccggggggggtccctggagacctctcctgtgcagtctctggattcacccttagaagtatggatgacctgggtccgccaggctccgaggggaagggctggaggtgggtggccaaanataaacgaaagacggaaagtacaaagaaaaaaccctgtagtaggactcgtgtagaacggccgattccacactctcanagacaacgaccaaagtatcactgtatttgacaaatagaacagccgtagagaggggacgaagggaccgacgggtccgtgtaagttatggtgcgaacgtagatggaataggtaacacgttcttaacgaagttagcgagggtaggttacgtggttaatttgg

SEQ ID NO: 370965 - DNA, 590 bp, Homo sapiens
  misc_feature: GZ8MTXP01DRPZV.15.67.G01.1.454.CMB.2.raw
  modified_base (533)..(533): a, c, t, g, unknown or other
  modified_base (570)..(570): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtggggggaggcgttggtccgagggcccgggggggtccctgagactctcctgtgcagtctctggattcacccttagaagtatggatgacctgggtccgccaggctccgaggggagggctggagtggtgaccaacaataaacaaagacggaagtcaaagaaaaacctgtagtaggactcgtagtacgaacggccagttccaccatctaccagacgacaacgaccaaagaattacactagttatttgactaaatgaaacacgccgtaggaggacggacggacggaacgacgggtccgtagttagttagttgtgcggcgtaagngtagagtagttacgacgttcttaacgaaggttaaggnggtaggtgttagtgttgttg

SEQ ID NO: 370966 - DNA, 605 bp, Homo sapiens
  misc_feature: GZ8MTXP01DXR7P.15.67.G01.1.454.CMB.2.raw
  modified_base (272)..(272): a, c, t, g, unknown or other
  modified_base (287)..(287): a, c, t, g, unknown or other
  modified_base (299)..(299): a, c, t, g, unknown or other
  modified_base (314)..(314): a, c, t, g, unknown or other
  modified_base (331)..(331): a, c, t, g, unknown or other
  modified_base (522)..(522): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcttgggtccgagggcccggggggtccctggagactctcctgtgcagtctntgattcacctagatntgatgactggcncagctcgagggaggntggagtgggtgaccaanaataaacgaagacggaagtacaagtaaaacctgtgtaggactcgtaagtcgaacggccgtaattaccaccatcctacaagacgaacaacgaccaaagtattacacttagttatttgactaaaagtgaaacacgccggtagaagggacggacggaaggacgtaccgggtccggttagttaatttagttgggnggcggaagaagttagtagttaagtaagtacgttacgttacgttaacgtaaggtagaacggtaggtaggttagtgttaacgttg

SEQ ID NO: 370967 - DNA, 556 bp, Homo sapiens
  misc_feature: GZ8MTXP01APIND.15.67.G01.1.454.CMB.2.raw
  modified_base (302)..(302): a, c, t, g, unknown or other
  modified_base (340)..(340): a, c, t, g, unknown or other
  modified_base (371)..(371): a, c, t, g, unknown or other
  modified_base (380)..(380): a, c, t, g, unknown or other
  modified_base (404)..(404): a, c, t, g, unknown or other
  modified_base (500)..(500): a, c, t, g, unknown or other
  modified_base (524)..(524): a, c, t, g, unknown or other
  modified_base (528)..(528): a, c, t, g, unknown or other
  modified_base (534)..(534): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcaccttagagtatgatgacctgggtccncaggctccgaggggagggcgtggagtgggtggaccaanataaacgaaagacggaagtcaagaaaacctntgtggactntagtgaacgcgatcacatctacanacgacaacgacaagattcacttagtattagacaaatgaaacagcccgtagaacggaggacggaggaccgacgggaccttggtattagttggcgcgngtaagataggatacggagaccttnacgngtacgngtagggtgttagtaaggttgtg

SEQ ID NO: 370968 - DNA, 668 bp, Homo sapiens
  misc_feature: GZ8MTXP01DTR8R.15.67.G01.1.454.CMB.2.raw
  modified_base (621)..(621): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgctacgttggtggagtcgtggggggagcgttggtccgagggcccggggggtccctgagactctctgtgcagtctctggtacttctaccttagaagttatggatcgaccgtcgggtcccgcgacggctaccggaggggaagggctggagtggggtcgaccaaacgaataaaacgaaagacggaaagtacaaaacgtaaaaaacctgtaggtacggtactacgtaaggtacgaaccgggcctaacttccaaccctatccgtaccaagaacgaaacaaccggaaccaaagtaattcaacgttgttaatttacgactaaatacgaaactacgaccgtagggaacggacggaccggtaagggaacccgtacgggtccggttaattagtttattccggtggcgaagtaagttagtacgaagttacggtaacnccgttagttaacgaagttagcgtaggggtattatcggttaatttcgg

SEQ ID NO: 370969 - DNA, 623 bp, Homo sapiens
  misc_feature: GZ8MTXP01BO3R7.15.67.G01.1.454.CMB.2.raw
  modified_base (306)..(306): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctgagactctcctgtgcagtctctggacttcacccttagaagtatggatgacctgggtccncagactccgaggggaagggctgggagtgggtcggaccaaacaataaaaccgaaaaggaccggaaagtacaaaggaaaaaaccctgtagtcgggaactcgtgtagaaccggccgtaattccaacctagtcctaccgaagaacgaacaaccggaccaaagtaacttccacttgttaatttgaactaaagtgaaacagtaccgtagaaggaggcgaaacgggaccacgggccgttagtagtttagtcggtagccggaagtagagtggaaatggtaagacgttcaacgtaaggtagcgtagggtggttatgggttaattgg

SEQ ID NO: 370970 - DNA, 638 bp, Homo sapiens
  misc_feature: GZ8MTXP01D8YAN.15.67.G01.1.454.CMB.2.raw
  modified_base (319)..(319): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgtttattttagaaggtgtccagtgtgaggtgcacgttggtggagtcgtggggggaggtcgttgggtccgagggcccgggggggtccctaggagtactctcctgtgcagtctcgtggattccaccttagaagttattggatgaccgtggtccncgaggcctccgaggggaggctggaggtgggcgaccaacaataaaacgaaagacggaaagtacaaagtaaaaaacctgtaggtaggtactcgtaagtacgaacgggcctattaccacctatacctaccgaagacgaaccaacgtacccgaaataacttactaactagttatttacgaataaagaacgaacaacgaccggacgaggaggacggaacggacgacggaccgtagttattagttagtgcgcgagagtagttagtaagtaagttacgttccttacgtaagtagtaagtaggtaggttagtaagttaagtttaagg

SEQ ID NO: 370971 - DNA, 620 bp, Homo sapiens
  misc_feature: GZ8MTXP01B8SJ8.15.67.G01.1.454.CMB.2.raw
  modified_base (340)..(340): a, c, t, g, unknown or other
  modified_base (390)..(390): a, c, t, g, unknown or other
  modified_base (456)..(456): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctggagactctcctgtgcagtctctggattcacccttagaagttatggatgaccgtgggtccgccgaggctaccgaggggaagggctggagtgggnggaccaaacgaataaaacgaaaagacggaaatacgaaagaaaaaaacctntagtaggacctgtagtacgaacggcctaattccaaccatccaccaagacgaacaaacgacctaaanaaacttcaaactgttaatttacgaacaaaataagaacgacgacggtagaggaggacggacgacgacggacgtagttagttagttgtgcgaagaagagtagttagtaagtaagttacgttacgttacgtaagtaggtaacggtaggtaggttagtaagttaagtg

SEQ ID NO: 370972 - DNA, 550 bp, Homo sapiens
  misc_feature: GZ8MTXP01DT19D.15.67.G01.1.454.CMB.2.raw
  modified_base (377)..(377): a, c, t, g, unknown or other
  modified_base (502)..(502): a, c, t, g, unknown or other
  modified_base (506)..(506): a, c, t, g, unknown or other
  modified_base (525)..(525): a, c, t, g, unknown or other
  modified_base (532)..(532): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccgggggggtccctgagactctcctgtgcagtctctggattcacccttagaagtatggatgacctgggtccgccaggctccgaggggaaggggctggagtggggtggccaacaataaacaaagacggaaagtcaagaaaaaacctntgtggactcgtgtagaacgggccgattcacccatctccagacgacaacgccaaagaattcaactgttatttgacaaatgaaacagccgtagagaggcgaggacacggcgtgtattattgtcgcgngagntgagtagtagacttcttanaagtagngaggtgttatgaagttcg

SEQ ID NO: 370973 - DNA, 543 bp, Homo sapiens
  misc_feature: GZ8MTXP01E1S6F.15.67.G01.1.454.CMB.2.raw
  modified_base (387)..(387): a, c, t, g, unknown or other
  modified_base (444)..(444): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttttagaaggtgtccagtgtgaggtgcacttggtggagtctgggggaggcttggtccgaggccggggggggtccctgagactctcctgtgcagtctctggattcacccttagaagtattggatgacctgggtccgccaggctccgaggggaaggggcgtggagtggggtggccaacataaacaaagacggaaagtcagaaaaaccctatgtggacnctgtgaacggccgattcaccatctccagagacaacgccaaagaattcactgtattgnaaatgaacagcctgagaggcgaggaccacgggccgtagtattattgtgcggcgagatgatagtagacttcttacaagtagcagggtggttatggaatgg

SEQ ID NO: 370974 - DNA, 566 bp, Homo sapiens
  misc_feature: GZ8MTXP01C8YVT.15.67.G01.1.454.CMB.2.raw
  modified_base (423)..(423): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggccgggggggtccctgagactctcctgtgcagtctctggattcacccttagaagtattggatgacctgggtccgccaggctccgagggggaagggctgggagtggggtggaccaacaataaaaccaaagacggaagtacaaagaaaaacctatgtggactcgtagtgaacggccgattcaccatctcaganacaacgaccaagattcacttgtatttgacaaatagaacagccgtaggaaggagggcggaaggaccgacggccgttagtattagtgtgcgcgagatcgagtagtagacttcttacgaagtagcgtagggtgttatggaatttgg

SEQ ID NO: 370975 - DNA, 670 bp, Homo sapiens
  misc_feature: GZ8MTXP01BBNAX.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttctgttgttatttagaaggtgtcagtgtgaggtgcacttggtggagtcgtgggggaggcttggtccgaggccggggggtcctgagactctctgtgcagtctctggtattccaccgttagtagtattggatgaccgtgggtccgcgaggcgtaccgaggggaagggcgtgggagtgggtcgacaaacataaaacgaaagacggaaagtacaaagtaaaacctagtggtaggaactcgtaggtacgaacgggtccattaccacctattccaccgaaagaacgaacaaaccggacctaaagtaattactaacttaggtttatttaggacttaaagaagaaacgacgtaccggtacggaaggaagggacgggaacgggaacgaaccgggtacccggttacggttaagtttaaggttcggttggtccgggtaacggtaagaggtagttagtaaggtaacttacgttaccttacgtaaggtaagaacggtaagggttgggttagttaagttaagtttgg

SEQ ID NO: 370976 - DNA, 755 bp, Homo sapiens
  misc_feature: GZ8MTXP01CR5ZH.15.67.G01.1.454.CMB.2.raw
  modified_base (703)..(703): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctggttttccttgttgttattttagaaggtgtccagtgtgaggtgctacttggtggaggtcgtgggggaggtcgtttcgggtccgacgggtcccggggggtccctggacgtacctccgtccgttgtcgctagtctcgtggtacttcctacccttaagtaagttagttggagtcgtaccgtcgggtcccgccgaggtctacccggagggggaacggggcgtagggggtacggtgggggtacggaacccaaaacgtaaacgtaaaaaaccgaaaacggtaacgggaaaacggtaactaaaaggtaaaaaaacccttagtacggtaggtaaccgtcgtaagggttacggaaccggtccgtaacgttacccaaccaactcctaaccgaacgaacgaacaaccggtaaccaaagtaacttacaacgtttagttaactttgaaactaaagtacgtaaacacggtaccgtaaggacggtaacgggacgaacggaacgacgggtcgttaagttattagtggtcgcggtaagagttagtacgagttaaagtacttaaccgttnttaaccgtaagtacgtaacggtagggttaggttagtcggttaagtttaacgg

SEQ ID NO: 370977 - DNA, 641 bp, Homo sapiens
  misc_feature: GZ8MTXP01D3NNN.15.67.G01.1.454.CMB.2.raw
  modified_base (338)..(338): a, c, t, g, unknown or other
  modified_base (373)..(373): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccggggggtcctgagactctcctgtgcagtctctggattcacccttagaagtatggatgaccgtgggtccgccaggctccgaggggagggctgggagtgggtgccaanaataaacaaagacggaaagtcaagtaaaaaacctntagtaggactcgtagtacgaacggccgtattaccacctagtcctccaagacgaacaacgaccaaagtaacttacaacttagttaatttgaactaaaagtgaaactagttacggtaggaaggaacgggaccggaagggtaaccgaccggggtccgttaaggtttaatttaagttggtggccggaagaaggttagtagaaagttaaagtagttacgttccgttaaacgaaggtaaggcgtaaggggttggttaagttggttaacgtttgg

SEQ ID NO: 370978 - DNA, 563 bp, Homo sapiens
  misc_feature: GZ8MTXP01EH5EG.15.67.G01.1.454.CMB.2.raw
  modified_base (511)..(511): a, c, t, g, unknown or other
  modified_base (537)..(537): a, c, t, g, unknown or other
  modified_base (543)..(543): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggcccgggggggtccctgagactctcctgtgcagtctctggattcacccttagaagtatggatgacctgggtccgccaggctccgaggggaaggggctgggagtgggtggaccaaacataaaacgaaagacggaaagtcaaagaaaaacctatgtggactctagtgaacggcgattcaccatctccaagagacaacgccaagaattcacttgttatttgactaaaatgaaacagccgtagagaagggcgaaggacacggccgtagtattagttgtgccgngtagatgagtagtagacttcttaacngttagngtagggtgattgaagtttgg

SEQ ID NO: 370979 - DNA, 597 bp, Homo sapiens
  misc_feature: GZ8MTXP01AF25P.15.67.G01.1.454.CMB.2.raw
  modified_base (542)..(542): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagaagttatggatgacctgggtccgccaggctcccgagggggaaggggcgtgggagtggggtggccaacaataaacaaaggacggaaagtacaagaaaaaccctatgtggactctagtagaaccggccaaattccacctatctaccagacgaaccaacgaccaagaacttacgacttagtatttgactaaagtagaacagacccgttaggaggacgggacggaacggaccgacgggtcccgtaggttacttagttggtagccgngagatgagtagtagcttacttacgaaggtagcgtagggtggttagtgttaagttg

SEQ ID NO: 370980 - DNA, 578 bp, Homo sapiens
  misc_feature: GZ8MTXP01EYQCB.15.67.G01.1.454.CMB.2.raw
  modified_base (306)..(306): a, c, t, g, unknown or other
  modified_base (380)..(380): a, c, t, g, unknown or other
  modified_base (467)..(467): a, c, t, g, unknown or other
  modified_base (500)..(500): a, c, t, g, unknown or other
  modified_base (552)..(552): a, c, t, g, unknown or other
  modified_base (560)..(560): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggagcgttggtccagggcccggggggtcctggagactctcctgtgcagtctctggattcacccttagaagttatggatcgactgggtccncaggctccgaggggagggctggagtgggtcggaccaacaataaaccgaaaggacggaagtacaagtaaaacctntagtggactcgtagtacggaaccgccgtaattcaccatcctccaagacgaacacgaccaaagtattcactgttattagacaaagtanaaacgacgcgtaggaagacggacggaggaaccncgggtacgtagttatagttgtacgcgaagtagagtgagtacgtagacttcanaaggtagngagggtgttatgttgttg

SEQ ID NO: 370981 - DNA, 609 bp, Homo sapiens
  misc_feature: GZ8MTXP01BC5SE.15.67.G01.1.454.CMB.2.raw
  modified_base (310)..(310): a, c, t, g, unknown or other
  modified_base (553)..(553): a, c, t, g, unknown or other
  modified_base (556)..(556): a, c, t, g, unknown or other
  modified_base (584)..(584): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtgggggaggtcgttggtccgagggcccggggggtccctgagactctcctgtgcagtctctggattcacccttagaagttatggatgacctgggtcccnccgaggctccgagggggaaggggctgggaggtggggtcggaccaaacaataaaacgaaaggacggaaagtacgaagaaaaaaccctgtagtaggactcgtaggtgaacggtccgatttcaacctgtcctacagacgaacaacgaccaaagaacttcaacttgttatttagactaaagtacgaaacacgccggtagaggagggacggaggaccgacggtccgtagttattagttgtgcgcgagngtnagtagtacgacttcgttacaaggttagngtagggtggttactgttaagtttgg

SEQ ID NO: 370982 - DNA, 564 bp, Homo sapiens
  misc_feature: GZ8MTXP01BT8MT.15.67.G01.1.454.CMB.2.raw
  modified_base (372)..(372): a, c, t, g, unknown or other
  modified_base (376)..(376): a, c, t, g, unknown or other
  modified_base (507)..(507): a, c, t, g, unknown or other
  modified_base (511)..(511): a, c, t, g, unknown or other
  modified_base (542)..(542): a, c, t, g, unknown or other
tcagtctacgtagccacgaccggtgctcgatttagagtatacatattgggtttgaggtctcagagaggagccttagccctggactccaaggcctttccacttggtgatcagcactgagcacagagtactcaccatggagttggggctgagctgggttttccttgttgttattttagaaggtgtccagtgtgaggtgcacttggtggagtcgtggggggaggcttgggtccaggcccgggggggtccctgagactctcctgtgcagtctctggattcacccttagaagtatggatgacctgggtccgccaggctccgaggggaaggggctggagtgggtgccaacataaacaaagacgaagcaagaaaaactntagnggactctgtagaacggccgaattccaccatctccgagagacaacgaccaaagtaacttcaacttgttatttagacctaaatagaaacagccgtagaggaggcggagacgacggcgtagtattagtgtgcgngagntagagtaagtaggcttacgttacaagttagngtaggtgggttatggaatttgg

SEQ ID NO: 370983 - DNA, 636 bp, Homo sapiens
  misc_feature: GZ8MTXP01BYZDT.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgaacacagaggactcaccatggagttggggctgagcttgggttttccttgttgttattttagaaggtgtccagtgtgaggtgcacgttgggtggaggttcgtggggggaggtcgttgggtcccgagggcccggggggggttccctggacgacctctcctgtgctagtctcgtggattcacccttagaagttatggatgaccgtgggtccgccgaggctccgaggggaaggggcgtgggaggtggggtacggaccaaacaataaaacgaaaggacggaaagtacaaagaaaaactatggtagactcgtgtacgaacggccgattacgaccactctacgagacgacaacgacaagtatacaactgttatttagactaatacgaacagcctaggggagagggacgacggacgtccggacgttagttattacgttcggtaggcgcggaagagttagtaagttagtaacgtacttaccgttcttaaggttcgagtaagggttggattagggtaacttgggttttaa

SEQ ID NO: 370984 - DNA, 761 bp, Homo sapiens
  misc_feature: GZ8MTXP01CZ879.15.67.G01.1.454.CMB.2.raw
  modified_base (331)..(331): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgtttattttagaaggtgtccagtgtgaggtgctacgttggtggaggtcgtggggggagggtcgtttgggtccgacggggcccgggggggtccctggacgtacttcctccgtgttgctagtctctggacttccacccttagaagttatggatgaccgtgggtccnccgaggcctccggaggggaacggggtctggggaggtggggtcggacccaaacgaactaaaacgaaaggaaccggtaaagtaccaaagtaaaaaaaccctgtggtaggacctcgtaaggtcggaaccggcctaactttccaccctatcctaccgaagacgaacaaaccgacccaaagtaaacttacaacttagttattttacgactaaaagtacgtaaacacggtaccggggttacggaagggtaagggttacgggaacggggaaccgtaccggggtacccggtttaggtttaagtttaagtttggtacgggtccgaacggaaagggttcgttaaggttaaagttaacgggttaacgttaaccgttaccgttaaccggttaaggtaaggtccggtaaagggggtttggttaacgttggttaaccgttttgg

SEQ ID NO: 370985 - DNA, 559 bp, Homo sapiens
  misc_feature: GZ8MTXP01A14ST.15.67.G01.1.454.CMB.2.raw
  modified_base (371)..(371): a, c, t, g, unknown or other
  modified_base (406)..(406): a, c, t, g, unknown or other
  modified_base (481)..(481): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcaccttagagtatggatgacctgggtccgccagctccgaggggagggctggagtgggtggaccaacaataaacaaagacggaaagtcaagaaaaacctntgtaggactctagtcgaacggcgtattcaccatcncagagacaacgcaagattcactgtattgacaatagaacagacgtgagagacgaggcgacggcgtgtattagttgngcgcggaagttgttagagttaaggtacgttacttcttaacgaaggtaggcgtaggggttaggagttggaagtttcggg

SEQ ID NO: 370986 - DNA, 547 bp, Homo sapiens
  misc_feature: GZ8MTXP01BAFQY.15.67.G01.1.454.CMB.2.raw
  modified_base (304)..(304): a, c, t, g, unknown or other
  modified_base (498)..(498): a, c, t, g, unknown or other
  modified_base (502)..(502): a, c, t, g, unknown or other
  modified_base (506)..(506): a, c, t, g, unknown or other
  modified_base (544)..(544): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctgagactctcctgtgcagtctctggattcacccttagaagtatggatgactgggtccnccaggctccgaggggaagggctggaggtgggtggaccaaacaataaaacaaaggacggaaagtcaaagaaaaacctatgtggaactctagtagaaccggccgattcacccatccaccagagacaacgaccaagaattcactgtatttgacaaatgaatagcgtgagaggcgaggacacggccgtgtattagtgngcgngagngtgagtagtacacttcagaagtagcgtaggtgttatgngtg

SEQ ID NO: 370987 - DNA, 618 bp, Homo sapiens
  misc_feature: GZ8MTXP01BDREW.15.67.G01.1.454.CMB.2.raw
  modified_base (307)..(307): a, c, t, g, unknown or other
  modified_base (390)..(390): a, c, t, g, unknown or other
  modified_base (434)..(434): a, c, t, g, unknown or other
  modified_base (553)..(553): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcgttggtccgaggccgggggggttccctgagactctccgtgtgcagtctcgtggattcacccttagaagtatggatgacctgggtccnccgaggctccagggggaaggggctgggagtggggtggaccaaacataaaaccgaaaggtacggaaggtacaagaaaaaccctntagtggaactcgtagagaacggccgtattccgacatctccaganaacaacgcaaagattcacttgtatttgcaaatgaaactagccgtaggaagaggacggaacgacgacggtccggtagttaattagttgtagcgaacggagttatggaagttaagggtaanaccgtttcgaaaccttaaggggtgaaccgtaaggggttacggttaattcgggttaaagttttcgg

SEQ ID NO: 370988 - DNA, 725 bp, Homo sapiens
  misc_feature: GZ8MTXP01BHAB3.15.67.G01.1.454.CMB.2.raw
  modified_base (328)..(328): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggtttttccttgtttgtttattttagaaggtgtccagtgtgaggtgcacttggtggaggtcgtggggggaggtcgttgggtccgagggcccgggggggtccctggagacctctccgtgtgcagtctcgtggtacttcacccttagtaagttattgggatgaccgtcgggtcccnccgaggcctccgagggggaagggggctgggaggtggggtacggacccaaacgaactaaaaacgaaacggtaacgggaaagtaccgaaaggtaaaaaaaccctgtaggtagtaacctcgtagggttacgaaccgggccgtaacttaccacctatccctaccgaagagaaaccgaacgacccaaaggtaacttacaacttagttaattttagaacctaaatacgaaacgtacggaccggtaggaagggacgggacgggaaacggaacggaaccgggtaccggttagttaagtttagttggtcggccgggaaggtagagtagttaagttaagggtaacttaccttcgttaaaccgtgttaaaccgggtcggttagggtaggttagttggttaagtttcgg

SEQ ID NO: 370989 - DNA, 892 bp, Homo sapiens
  misc_feature: GZ8MTXP01AU2KJ.15.67.G01.1.454.CMB.2.raw
tcagtctacgtagccacgaccggtgctcgatttagagtatacatattgggtttgaggtctcagagaggagccttagccctggactccaaggcctttcccacttggtgatcagcactgagcacagaggactcaccatggaggttgggctgagcgttgggttttcctttgttgtttattttagaaggtgtcagtgtgaggtgcacgttggtgggtagttcggtggggggagggtcgtttcgggtccgacgggggtccccggggggggttccctggaacggtaccttccgttccgtggttcgccgtaggttccttcgttggtactttacctacccgttaaggtaaagttagttggagttggaccgtcgggtcccgaccgagggccgtacccggaagggggaagggggcgtgggtagggtggggtcggacccaaacgaaagtaaaaacgaaaaggaaaccggaaagtaacgaaaacgtaaaaaaacccgtagttaggtacggtaacgttccgtaagggttacgggaaccgggtcccgggtaaacttttacccgaaccctacgttaccctacccgaaacggaacccggaaaccaaaacccggaaacccgtaaaccggtaaaatttaaccctaacccgtttaggttaaagtttttacggaaacttaaaacgttaacggaaaacgtacgggcccgttaagggaacgggaaggggacggaaacggggttaaccggacgggtaccgtttacgttaaagtttgttagggttacggtcggaacggtaaggttaaagtaggttaaggtttaaaccggtaaaggttaccccggttaacttaacgggtaagggtttacggaacgggtaaagggggtttcggttaggttaaggttaaggttttaagg

SEQ ID NO: 370990 - DNA, 645 bp, Homo sapiens
  misc_feature: GZ8MTXP01A452Q.15.67.G01.1.454.CMB.2.raw
  modified_base (593)..(593): a, c, t, g, unknown or other
  modified_base (597)..(597): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtgggggaggcttggtccgaggcccggggggtccctgagactctcctgtgcagtctctggattcacccttagaagttattggatgacctgggtccgccaggctccgaggggaagggctgggaggtgggtggaccaaacaagtaaacgaaaggaacggaaagtacgaaaagtaaaaacctgtagtacggtactacgtagggttacggaaccgggccgtaacttacccaacctactaccctacccgaaagacgaaacaaacccggaaccaaagtaaccttactaacgttagtttatttagaacctaaaattaggaaactaccgaccggtaggaacgggagggacggaaacggaccgacggtccgttagttattagtgtcgcgngagngtagagtagtacgacttccagaagtcgaagtagggtgttatgttgttg

SEQ ID NO: 370991 - DNA, 818 bp, Homo sapiens
  misc_feature: GZ8MTXP01AYSSK.15.67.G01.1.454.CMB.2.raw
  modified_base (792)..(792): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttatttagaaggtgtcagtgtgaggtgctacgttggtggagtcggtggggggaggtcgttgggtccgacggggcccgggggggtccctggacgtacctccctcgtgtcgcgtacgtctcgtagtaccttacctaaccgttaagtagtagtagagtcgtacggtcggtccgcgacggtccgtaacgggagggggacggtcggtagggtagggtcgggtaccgaaccgaaaacgtaaaacgtaaaaacggaaacgggtaaacggtaaacgtaaacggtaaaaaaacgtaaaacccgttaggttacggtacggttaaccttcggtaacgggtaacccgggtaacccgggtaaccgttaacccttacccgaacccttaaccgttaccccgaaacggaacggaaacccgaaacccgtaaacccggtaaacccgtaaaagtttaccttaacccgttaacggtttaagtttaacttaccgaaactaaagtaacgaaccgttaccgccggggtaaagggaacggggacgacgggaaacggaccgtaccgggttacttaagtttacttgggttcgcggaccggaagtaagttagtaagttagttaaacgacgttacttgttaacgtggtacgnggttagggtagttagtgttgtttcgg

SEQ ID NO: 370992 - DNA, 693 bp, Homo sapiens
  misc_feature: GZ8MTXP01DAPLJ.15.67.G01.1.454.CMB.2.raw
  modified_base (619)..(619): a, c, t, g, unknown or other
  modified_base (685)..(685): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcacatggagttgtgctgagtcgttgggttttcttgttgttatttaggaggtgtcagtgtgaggtgctagttgggtggaggtcggtgggggagtcgttgggtccgaggggtcccgggggggtcctggacgtctcgtccgtggtcgctagtctcgtggtacttccacccgttaagaagttagtggtatcggtaccggtcgggtccgccgaggccgtaccgggaagggggaacggggcgtagggaggtcgggggtacggacaaaacgaaagtaaaacgaaaggaacggaaagtaccgaaaaagtaaaaactgtacggtagtaccgtacgtaggtaacggaaaccgggtccgtaacgttaccaacctacttccaaccgaaggaacaaccaaaccggaccaaagtaacttaccgtattagttaacgttagaactaaagtacgaaacgacgtcgaaggagacggacggtaacgacgcgtacgtagtagttagtcgngaacggtgagtagttcgaagttaagacttaccttacgtaagaggtaagtggtagggttagttaagngtttaagg

SEQ ID NO: 370993 - DNA, 636 bp, Homo sapiens
  misc_feature: GZ8MTXP01A0RVL.15.67.G01.1.454.CMB.2.raw
  modified_base (318)..(318): a, c, t, g, unknown or other
  modified_base (366)..(366): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaggtgtccagtgtgaggtgctacgttggtggagtcgtgggggaggcttggtccgagggcccgggggggtccctggagtactctcctgtgcagtctcgtggtacttccaacccttagaagttagtggatggaccgtgggtcccnccgaggcctaccggagggggaagggcgtgggaggtgggtcgaccaaanaataaaacgaaaggtacgaagtacaaagtaaaacctgtagtagactctaagtacgaacggccgtattacccactatccacagacaaccaaccgacaaagtaacttcaacgttgttaattcgaactaaatagaaacgagtaccggtaggaacggacgggacgtaacggaacgtaccgggtcgttagttaaacgtttgttgtcggaccggtgaagttagtacgagtacgtagttacttcttagaagtagcgtagggtgttatgttaacgttg

SEQ ID NO: 370994 - DNA, 727 bp, Homo sapiens
  misc_feature: GZ8MTXP01C2N05.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcacccttagaagtatggatgaccgtgggtccgccaggctccgaggggaagggctggaggtgggtggaccaaacaagtaaaacgaaaggaacggaaagtacaaaggaaaaaacctgtaggcggaactcgtaagttagaacccgggccgtaacttaccaacccatcctacccaaggaacgaaccgaaaccgaaccgaaagtaaacttacccgaacttacggttaattttacggaacaaaaattacgaaaccgtaaggaccccgttagggaaggaacggggacggaaacgggaacccgaaccggggtaccggtttaggtttaatttaaggtttggtacggccggtaacggaaaggttagttacggaaacgtttaaaggtaacggttaacctttccgttaaaccgtaagggttacgtaacgggtagggttaggggttacttaaggttaagttttcgg

SEQ ID NO: 370995 - DNA, 625 bp, Homo sapiens
  misc_feature: GZ8MTXP01D0REA.15.67.G01.1.454.CMB.2.raw
  modified_base (356)..(356): a, c, t, g, unknown or other
  modified_base (586)..(586): a, c, t, g, unknown or other
  modified_base (601)..(601): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcgttggtccgagggcccgggggggtccctggagactctcctgtgcagtctctggattccaccttaagaagttattggatcgaccgtgggtcccgccgaggcctccgaggggaagggctgggagtgggtgaccaanaataaacgaaaggacggaaagtacaaagtaaaaaacctgtaggtacgtaactcgtagggttacgaaccgggcctaacttaccacctatcctacgaagacgaacaaaccggacaaagtaattacaacttagttactttagaactaaaatagaaacacgaccggtaggaaggaggacggaggaaccgacggtcgtatagtttagtggtgcgaagagttataggataggtaanacgttcagaagtagngtagggtgttaagtgttaagtttg

SEQ ID NO: 370996 - DNA, 750 bp, Homo sapiens
  misc_feature: GZ8MTXP01CKPH1.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtgggggaggcgttggtccgagggtccgggggggtccctgacgtacctctccgtgtgctagtctctggtacttccaccgttagtaagttagtggactcgaccgtgggtcccacgacggctccggaaggggaacgggtcgtagggtaggtcgggtacggaccaaacgtaaagtaaaaccgaaaggacggtaaacgtacgaaaacgtaaaacccttagtacggtaacggtacttcggtaacgggttaacggaaccgggtacccgtaattacccgaacctactcccgtaccgaaagtaacgaaaccgaaaccgtacccgaaagttaaacttctaaacgtttacggttaactttcggaaaccttaaaagtacgaaaccgtcgtaaccggtagggaacggacggaccggtaaggacccgtacggttaccgttagttacgtttaagtgggttacgccggtaagtaacgttagtaggttaacgttaagggtacttacggttccttaaagtcgttagcggttaggtagttagtaacgttaagtttg

SEQ ID NO: 370997 - DNA, 611 bp, Homo sapiens
  misc_feature: GZ8MTXP01BNCYU.15.67.G01.1.454.CMB.2.raw
  modified_base (307)..(307): a, c, t, g, unknown or other
  modified_base (313)..(313): a, c, t, g, unknown or other
  modified_base (325)..(325): a, c, t, g, unknown or other
  modified_base (447)..(447): a, c, t, g, unknown or other
  modified_base (472)..(472): a, c, t, g, unknown or other
  modified_base (531)..(531): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctgagactctcctgtgcagtctctggacttcacccttagaagtatggatcgacgtgggtccncaggcncgaggggaggcnggagtgggtgaccaaacaataaaacgaaagacggaaagtacaaagaaaaaaccctgtgtaggactcgtagtacggaaccggccaattcaccctatctaccaagacgaacaaacgacctaaanaattccagtagttatttagacaaanaagaacgacgacggagaggaggacggacggaccgacggtacgtagttagttagtgtcgngaagagtttagtagaagtaagtaacgttacgttacttacgtaaggtaggtaacgtaggtaggttagtaagttaagttaag

SEQ ID NO: 370998 - DNA, 724 bp, Homo sapiens
  misc_feature: GZ8MTXP01BNPFQ.15.67.G01.1.454.CMB.2.raw
  modified_base (337)..(337): a, c, t, g, unknown or other
  modified_base (344)..(344): a, c, t, g, unknown or other
  modified_base (373)..(373): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtggggggaggtcgtttgggtccgagggcccggggggggttccctggagacctctcctgtgcagtctctggattcatctagattatggatgacctggtccgcaggctcgagggagggctggagtgggngaccaanataaacaaagacgaagtacaagaaaactntgtaggactacgtggtgaaaccggccgtattccaacctactcctacccgagaacgaaccaaaccggacccaaagtaacttaccgaactttagttaagttttacgaactaaaagttcgaaaaccgacgggtacccggttaggggaaacggacgggggaccgggaaacgggtaaccggaacccggggttacccggtttaggtttaaacgttttaaggtttagggttcggggtaaccgggtagggaaacggttaacgttggtaaacgtttaagggttaaacggttacctttacccgtaaacggttaaggttaacggtcggtaaaggggtttgggttaagtttaacggtttaagg

SEQ ID NO: 370999 - DNA, 555 bp, Homo sapiens
  misc_feature: GZ8MTXP01CSCRN.15.67.G01.1.454.CMB.2.raw
  modified_base (408)..(408): a, c, t, g, unknown or other
  modified_base (458)..(458): a, c, t, g, unknown or other
  modified_base (504)..(504): a, c, t, g, unknown or other
  modified_base (538)..(538): a, c, t, g, unknown or other
tcagtctacgtagccacgaccggtgctcgatttagagtatacatattgggtttgaggtactcagagaggagccttagccctggactccaaggcctttccacttggtgatcagcactgagcacagaggactcaccatggagttggggctgagctggggttttccttgttgttattttagaaggtgtccagtgtgaggtgcacttggtggagtctgggggaggcttggtccagccgggggggtccctgagactctcctgtgcagtctctggattcacccttagaagtattggatgacctgggtccgccaggctccgaggggaggggctgggagtgggtggccaacaataaaacaaagacggaagtcaagaaaaaccctatgtggaactctaagtgaacggcgattcacanctccagagacaacggccaagtaattcactagtatttgactaaatgaaacngaccgtaggaaggaggacgaggactacggaccgtggtattatgtgngcgagatcggatagtagacttcttacaagtacgngaggtgttatgttgtcg

SEQ ID NO: 371000 - DNA, 746 bp, Homo sapiens
  misc_feature: GZ8MTXP01BBUPT.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgaggccgggggggtccctggagactctcctgtgcagtctcgtggtattccacccttagtagtattggatgaccgtgggtccgccaggctccgaggggaagggctgggaggtgggggtggacccaaacgaagtaaaaccgaaaaggaccggaaagttacaaaggtaaaaaaacccttgtacggtaggtaaccctcgtaagggttacggaacccgggtcccgtaaactttacccgaaccctaattcccgtacccgaaagaaccgaacctaaaaccggacccaaaagtaacttcgaaccgtttaggttaattttacgaactaaaagttacgaaacgtaacgacccggttaggaacggggacgggaaccgggttaagggaccgaaccggggtacccggtttagttaacgtttaagttgggttaccgggcggtaacgtaaggttagtagttaacgttaaacggtacgttaacgttcgttaacggtaaggtagtaacggtagggttagttagtgttaagttcg

SEQ ID NO: 371001 - DNA, 600 bp, Homo sapiens
  misc_feature: GZ8MTXP01A4ZX8.15.67.G01.1.454.CMB.2.raw
  modified_base (550)..(550): a, c, t, g, unknown or other
  modified_base (569)..(569): a, c, t, g, unknown or other
  modified_base (577)..(577): a, c, t, g, unknown or other
  modified_base (579)..(579): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcgttggtccgaggcccgggggggtccctgagactctcctgtgcagtctctggattcacccttagaagtatggatgacctgggtccgccaggctccgaggggaaggggctgggaggtggggtggaccaaacgaataaaacgaaaaggaacggaaagtacgaaagtaaaaaaccctataggtagggaactctaggtacgaacgggcccgaatttccaccctattcctacccaagacgaaccaacgacccgaaagaaacttcaactgttactttagacaaatgaacagccgtgagaggcgaggacacggccgtagttacttagtgtgccgngagatgagtagtagacttnttacaagngngtaggtgttagtgaagttcgg

SEQ ID NO: 371002 - DNA, 844 bp, Homo sapiens
  misc_feature: GZ8MTXP01B87FD.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtggaggtgcacgttggtggaggtcgtgggggaggtcgttgggtccgagggcccgggggggtccctggacgactctccgtgtcgcagtctcgtggtattctacccttagtaagttatggatgaccgtgggtccgcgacggctccgagggggaaggggcgtaggggaggtgggggtacggaccaaaacgaataaaacgaaaggaacgggaaagtacgaaaagtaaaaaacccttagtaggtacggtactcgtaggttacggaaccgggcccgtactttacccaaccactaccgtacaacgaaacgaacccgtaaaccggacccaaaaggtaaactttaccgtaaaccgtttacgtttaagttttacggaaaccctaaaaagttaaccgaaaacgtaccgtacccgggggttaacggaaaggggaacggggacccggggaaacggggaacccgtaaccgggggtacccggtttaaagggttaactttttaaggttcgggttacgggcccgggaaacgggtaaggttaaggttaaccggttaaagtttaaagggttaaacgttaaaccgggtttcccttaaaacgggtaacggttaacgggtaacgggttaaaagggggtttggggttaaacggtttggttaaacggttttttaacggg

SEQ ID NO: 371003 - DNA, 565 bp, Homo sapiens
  misc_feature: GZ8MTXP01ATNVW.15.67.G01.1.454.CMB.2.raw
  modified_base (288)..(288): a, c, t, g, unknown or other
  modified_base (509)..(509): a, c, t, g, unknown or other
  modified_base (513)..(513): a, c, t, g, unknown or other
  modified_base (535)..(535): a, c, t, g, unknown or other
  modified_base (540)..(540): a, c, t, g, unknown or other
  modified_base (556)..(556): a, c, t, g, unknown or other
tcagtctacgtagccacgaccggtgctcgatttagagtatacatattgggtttgaggtctcagagaggagccttagccctggactccaaggcctttccacttggtgatcagcactgagtacagaggactcaccatggagttggggctgagctgggttttccttgttgttattttagaaggtgtccagtgtgaggtgcacttggtggagtcgtgggggaggcttggtccgaggcccgggggggtccctgagactctcctgtgcagtctctggattcaccttagaagttntggatgacctgggtcccgcaggctccgaggggaaggggctgggagtgggtggaccaaacataaaacgaaaggacggaaagtcaaagaaaaactgtgtaggactcgtgtagaacggcgatcacatcacagacgacacgacaagtatcacttagtactttagacaaatgaaacacgccgtaggaggaggcggaacggacgacggtccgtagtattatgtgcgngaanattgacttagagacttcgttanagtgngtggttgagttaggtnttcgttaag

SEQ ID NO: 371004 - DNA, 701 bp, Homo sapiens
  misc_feature: GZ8MTXP01CJ17D.15.67.G01.1.454.CMB.2.raw
  modified_base (674)..(674): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacgttggtggagtcgtgggggaggtcgttggtccgagggccggggggtccctggacgtactctccgtgtgcagtctcgtggtacttccacccgttaagtaagttagtggatcgaccgtcgggtcccgccgaggcctaccggaagggggaacgggtcgtggggaaggtgggggtacggaccaaacgaaagtaaaaaccgaaaaggaacggaaaagtaccgaaaagtaaaaaacctgtaggtacggaactcgtaaggtacgaaccgggcctaattccaaccatcctaccaagacgaacaacgaccaaagtaacttctaacttagttaatttacgaactaaagtaacgaaacgacgtaccggtaggaagggacgggacggaacggaaccgtaccgggtaccggttagttaagtttaggttggtcggcgaacggtaagttagtagttagtaaaggtacgttacttcgttaacgaaggttagnggtagggtggttacttgttgtttaagg

SEQ ID NO: 371005 - DNA, 538 bp, Homo sapiens
  misc_feature: GZ8MTXP01DI6VY.15.67.G01.1.454.CMB.2.raw
  modified_base (369)..(369): a, c, t, g, unknown or other
  modified_base (407)..(407): a, c, t, g, unknown or other
  modified_base (476)..(476): a, c, t, g, unknown or other
  modified_base (484)..(484): a, c, t, g, unknown or other
  modified_base (486)..(486): a, c, t, g, unknown or other
  modified_base (488)..(488): a, c, t, g, unknown or other
  modified_base (492)..(492): a, c, t, g, unknown or other
  modified_base (521)..(521): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggtttttccttgttgttattttagaaggtgtccagtgtgaggtgcacttggtggagtcgtggggggagcttggtccgaggccgggggggtccctgagactctcctgtgcagtctctggattcacccttagaagtattggatgacctggtccgccaggctccgagggagggctggagtgggtggcaacataaacaaagacggaatcaagaaaacctngtggactcgtagtgaacggccgattcaccatctcaganacacgacaagattcatgtatttgacaaatgaacacgccgtagaggaggacgaggacgacggccgtagtnttattggngngngagntgagtagtattacgttcttacgaagtagngtaggtgttatgttgtg

SEQ ID NO: 371006 - DNA, 737 bp, Homo sapiens
  misc_feature: GZ8MTXP01DW1L6.15.67.G01.1.454.CMB.2.raw
  modified_base (384)..(384): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattctacccttagaagtatggatcgaccgtgggtccgccaggctccgaggggagggctggaggtgggtggaccaaacaataaaacgaaaggacggaaagtcaaagaaaaaaccctntaggtaggaactcgtaaggttacgaaccggggccctaaagtttcccaaccgtaactcccgtaccgaaaggaacgaaaccaaaaccggacccaaaaggtaaactttccgtaaaccttaggtttaatttacggaactaaaacgttagaaacctaacggacccgttagggaaggaacgggaccgggaagggaaccgtaaccggggtccggtttaaggttaacttttaaagtttcggttaggcccggaaggtaaggaaagttagggttaattaaacgggtaagttaaccgttccgttaaaccgtaagggttaacggtcgtaaagggggtttgggttaacgttgggttaagttttggg

SEQ ID NO: 371007 - DNA, 570 bp, Homo sapiens
  misc_feature: GZ8MTXP01A1UIP.15.67.G01.1.454.CMB.2.raw
  modified_base (436)..(436): a, c, t, g, unknown or other
  modified_base (475)..(475): a, c, t, g, unknown or other
  modified_base (479)..(479): a, c, t, g, unknown or other
  modified_base (488)..(488): a, c, t, g, unknown or other
  modified_base (516)..(516): a, c, t, g, unknown or other
  modified_base (518)..(518): a, c, t, g, unknown or other
  modified_base (520)..(520): a, c, t, g, unknown or other
  modified_base (523)..(523): a, c, t, g, unknown or other
  modified_base (525)..(525): a, c, t, g, unknown or other
  modified_base (534)..(534): a, c, t, g, unknown or other
  modified_base (548)..(548): a, c, t, g, unknown or other
  modified_base (565)..(565): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggccgggggggtccctgagactctcctgtgcagtctcgtggattccacccttagaagttattggatgaccgtgggtcccgccgaggcctccgaggggaggggcgtggaggtggggtcggacaaacaataaaacgaaagacggaaagtacaagaaaaaaccctgtgtaggactcgttaggacgaaccgggccattaccaccattcncagagaacaacgacaaagattcactagtattgacaaatnaacngcgtagagnggacgagcgacggctagtattagtcggngngnagngngagtagtanacgttacagtaagngaacgtggtgttagtgngttcg

SEQ ID NO: 371008 - DNA, 687 bp, Homo sapiens
  misc_feature: GZ8MTXP01EZYTR.15.67.G01.1.454.CMB.2.raw
  modified_base (367)..(367): a, c, t, g, unknown or other
tcagtctacgtagccacgaccggtgctcgatttagagtatacatattgggtttgaggtgtcagagaggagccttagccctggactccaaggcctttccacttggtgatcagcactgagcacagaggactcaccatggagttggggctgagcgtggtttccttgttgttatttagaaggtgtccagtgtgaggtgcacttggtggagtcgtggggggaggcttggtccgaggccgggggggtccctgagactctcctgtgcagtctctggattcacccttaagtaagttattggatcgacctcgggtcccgccgacggcctccggagggggaaggggcgttggggaggttggggtcgggacccaaaanaaacgtaaaaaccgaaaaggaaccgggtaaagtaccaaaggaaaaaaacccttagtaggtggaacttcgtaggtacggaaccggtccgattccaccctactcctacgaagaacgaaccaaacgacccgaaagtaaacttaccacgttagttatttacgaaccaaatacgaaacgacgaccggtaggaaggacgggacggacgggaaccgcgggtaccgttggttaaattgttaggtgcggaacggtattagtgttaagtaggttaagacgttcttaaccggaaggttagcggtaagggtaggttaagtcggttgtttcgg

SEQ ID NO: 371009 - DNA, 699 bp, Homo sapiens
  misc_feature: GZ8MTXP01EZXIG.15.67.G01.1.454.CMB.2.raw
  modified_base (340)..(340): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagtcgttgggttttccttgtttgtttattttagaaggtgtcagtgtgaggtgctacgttggtggaggtcggtggggggaggtcgttgggtccgacggggtcccgggggggtccctggacgtacctctccgtgtcgctagttctcgtggtacttcctacccgttaagtaagttattggatgaccgtgggtccnccgaggctccggaggggagggcgtgggaggtgggtcggaccaaacaagtaaaacgaaaggacggaaagtacaaagaaaaacctgtgtagtactcgtaaggtacgaaccggccgtacttccacctattccaccgagaacgaacaaacgaccaaagtaacttacgtacttagtttattacgaactaaagtacgaaacgacgtccgggtaagggaaacgggaacggggcccggaaagggaccgaaccggggttccggttaagttagtttagttggtacggcggtaagaaggttagtagttaagtaaggttacgacctttcgacgtaaggtagaaggttagggtgttatcggttaagtttcgg

SEQ ID NO: 371010 - DNA, 788 bp, Homo sapiens
  misc_feature: GZ8MTXP01A4IVK.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcgttggttttccttgttgttatttagaaggtgtccagtgtgaggtgctacgttggtggaggtcgtgggggaggtcgttgggtccgacgggcccggggggtccctggacgtactctccgtgtcgcagttctcgtggtacttcctaacccgttaagtaagttattggatcgacccgtcggggtcccgccgaggccgtaccggagggggaacggggtctggggaggttgggggtacgacccaaagaagtaaaacgaaaggaacggaaagtacgaaaagtaaaaaccctgtaggtaggacctcgtaaggtacggaacccggccgtaactttacccaaccctacttccctaccgaacggaacgaaccaaaccggacccaaaagtaacttaccaacgtttaggtttaatttacggaaactaaagttacgaaacgtacgtacccgggttaggaaacgggaacgggaccggaaacgggtaaccggtaccgggttacccgggtttaagttaacgttttaggttcgggtcggcccggtaaggtaaaggttagttacggttaaagttaaacgggtaacgttaccgtttacgttaacgtaagggttaacgggccgttaaaggggttggttaaacgtggttaacgttttggg

SEQ ID NO: 371011 - DNA, 596 bp, Homo sapiens
  misc_feature: GZ8MTXP01BVQ6O.15.67.G01.1.454.CMB.2.raw
  modified_base (389)..(389): a, c, t, g, unknown or other
  modified_base (424)..(424): a, c, t, g, unknown or other
tcagtctacgtagccacgaccggtgctcgatttagagtatacatattgggtttgaggtctcagagaggagccttagccctggactccaaggcctttccacttggtgatcagcactgagcacagagaactcaccatggagttggggctgagctgggttttccttgttgttatttagaaggtgtccagtgtgaggtgcacgttggtggaggtcgtggggggaggtcgttgggtccgagggcccgggggggtccctgagactctcctgtgcagtctctggattcacccttagaagtattggatgacgtgggtccgccaggctccgaggggaagggctggaggtgggtcggccaaacgaataaacgaaagacggaagtacaaagaaaaacctntagtaggactcgtagtagaacggcattcaccatcnccagacgacaacgacaagaattcaacgtagttatttagaacaaaagaacagaccgtgggaagagggacgaaggaccgacggccgtagttacttagttcggtgccgtggaagagttgaaattgtaagacttacgttacagtaagcgtaagggtgtagttgtaagttgtttaag

SEQ ID NO: 371012 - DNA, 591 bp, Homo sapiens
  misc_feature: GZ8MTXP01A0FVP.15.67.G01.1.454.CMB.2.raw
  modified_base (488)..(488): a, c, t, g, unknown or other
  modified_base (531)..(531): a, c, t, g, unknown or other
  modified_base (547)..(547): a, c, t, g, unknown or other
  modified_base (584)..(584): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccgaggccgggggggtccctgacgactctcctgtgcagtctctggattcacccttagaagttattggatgaccgtggggtcccgcccgaggcctccgagggggaaacggggcgtgggaggtggggtcggaccaaacaataaaacgaaaggaacggaagtacaagaaaaaaccctatgtggaactcgtagtagaaccggccgaacttccgacactctccaagagaacaacgaccaagaattcactgtatttcgactaaatgaanacgcgtgacgagcgagacgacggcgtagtacttatgtcgcggngagatggattaaggtnttacgttccagtaagttagcgaagggttggttatggntttaagg

SEQ ID NO: 371013 - DNA, 601 bp, Homo sapiens
  misc_feature: GZ8MTXP01ENQDO.15.67.G01.1.454.CMB.2.raw
  modified_base (307)..(307): a, c, t, g, unknown or other
  modified_base (528)..(528): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcacccttagaagttattggatgacctgggtccnccaggctccgaggggagggctgggagtgggtggaccaacaataaacgaaagacggaaagtacaaagaaaaaacctgtgtggaactcgtagtacgaacgggccattaccacattcgcaagacgacaacgacaaagtatacactagtattgactaaaatggaaacacggacctaggaagagggcgaaggacgtacgggccgtaggtatttagttcgtgccggnggaagttagtacgaagtacgtaagacgttcttaacgaagttagaacgtagggtaggttaatggttaatttcgg

SEQ ID NO: 371014 - DNA, 634 bp, Homo sapiens
  misc_feature: GZ8MTXP01ACO0U.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcttggtccgaggccgggggggtccctgagactctcctgtgcagtctctggacttcaccttagagtattggatgaccgtgggtccgcgaggctccggaggggaagggcgtggaggtgggtcggaccaaacaaagtaaaacgaaaaggacggaaagtacaaagtaaaaaacctagtggtaggtaactcgtaaggtacgggaaccggtccgtaattccaacctactctaccagacgaacaaccggacaagtaattcgaactgttattgaacaaagtacgaacagaccgtaggaggacgggcggaacggaccgacgggtccgttagtattagtgtggccggaagagttagtagacgtaagggtaacgttacttcgttacaaggttagaagtagggttggttagtcgttaagtttgg

SEQ ID NO: 371015 - DNA, 547 bp, Homo sapiens
  misc_feature: GZ8MTXP01BZDXK.15.67.G01.1.454.CMB.2.raw
  modified_base (341)..(341): a, c, t, g, unknown or other
  modified_base (491)..(491): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcctgttgttattttagaaggtgtccagtgtgaggtgcacttggtggagtctggggggagcttggtccaggccgggggggtccctgagactctcctgtgcagtctctggattcacccttagaagtattggatgacctgggtccgccaggctccaggggaaggggctggagtgggggtgccaanataaacaaagacggaagtacagaaaaacctatgtggactctagtgaacggccgattcacatctccagagacaacgaccaagaacttcactgtattcgacaaatgaacagccgtaggagagggcgaggacgacggccgtgtattagttggngtgcgagatgagtacgtagacgttcttacgaagtgcgtagggtgttagtgttgtcg

SEQ ID NO: 371016 - DNA, 643 bp, Homo sapiens
  misc_feature: GZ8MTXP01BL1B1.15.67.G01.1.454.CMB.2.raw
  modified_base (335)..(335): a, c, t, g, unknown or other
  modified_base (572)..(572): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcgttggtccgaggcccggggggggtccctgagactctcctgtgcagtctctggattcaccttagaagtattggatgaccgtgggtaccgcgaggctccgaggggaacgggcgnggaggtggtcggaccaaacgaataaaacgaaaggaacggaaagtacgaaagaaaaaacccttgtagtaggactcgtaggtaggaacccggcgtacttcaccctatcctaccgaaggaacacgaaacgaccgaaagtaacttacaaccttaggttattttacgaaacaaagtaagaacgaacgacggtacggaggacggacggacggacggacggtacggtagttacgttagtgtcgngaagagagtagttagtaagtaagttacgttacgttacgtaagtagtaagtaggtaggttagtgttaagttg

SEQ ID NO: 371017 - DNA, 567 bp, Homo sapiens
  misc_feature: GZ8MTXP01AIXNW.15.67.G01.1.454.CMB.2.raw
  modified_base (383)..(383): a, c, t, g, unknown or other
  modified_base (518)..(518): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtgggggagtcttggtccgagggccggggggtccctgagactctcctgtgcagtctcgtggattccacccttagaagtattggatgaccgtgggtccgccaggctccgaggggagggctggaggtgggtgccaaacaataaacaaagacggaagtacgaaagaaaaacctntagtggactcgtagtgaaccggccgtattcaccatctacagacgacaacgaccaaagaacttcactagttatttgactaaagtgaacacgccgtagaaggaggcgaaggacgacggcgtagttattagtgtgcgngagatgagtagtagacttcttacaagtagcgaggtgttatgttaagttg

SEQ ID NO: 371018 - DNA, 598 bp, Homo sapiens
  misc_feature: GZ8MTXP01B28CX.15.67.G01.1.454.CMB.2.raw
  modified_base (302)..(302): a, c, t, g, unknown or other
  modified_base (534)..(534): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggagcttggtccaggccggggggtccctgagactctcctgtgcagtctctggattcacccttagagtattggatgacctgggtccncaggctccgaggggagggctggagtgggtcggaccaaacgaataaaaccgaaaggtaccggaaagtacaaagtaaaaaacctgtagtggaaccttgtagtacgaaccggccgaattccaccatcctcaagagacaacggaccaagaattacactagttatttagactaaatacgaacagccgtaggaaggacgggacgaagggaccgacggtcgtagtattagttgtcgcgngagatagagtaaggtcacgttcttacgtaaggtagcgtagggtgttagttaacggttaatttgg

SEQ ID NO: 371019 - DNA, 629 bp, Homo sapiens
  misc_feature: GZ8MTXP01BR7SW.15.67.G01.1.454.CMB.2.raw
  modified_base (277)..(277): a, c, t, g, unknown or other
  modified_base (322)..(322): a, c, t, g, unknown or other
  modified_base (607)..(607): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttccttgtttgtttattttagaaggtgtccagtgtgaggtgctacgttggtgggaggttcggtggggggaggtcgttgggtccgagggcccgggggggtccctgacgactctcctgtgcngtctctggattcacccttagaagttattggatgaccgtgggtccnccgaggctccgaggggaggggcgtgggaggtggggtcggaccaaacgaataaaacgaaaagaacggaaagtaccaaagaaaaaacctataggtaggactcgtaggtagaacggccgtattccaccatcctaccagacaacaaacgaccaaagtaaacttctaacgttagttaatttacgaactaaaatagaaacaacgccggtagaggaacggacggaaggaccgacggccgttagtattagttgtgcgtgagatagagttagtagacttcttaacgaagtacgngtagggtgttagtgttaagttg

SEQ ID NO: 371020 - DNA, 757 bp, Homo sapiens
  misc_feature: GZ8MTXP01DUUSM.15.67.G01.1.454.CMB.2.raw
  modified_base (276)..(276): a, c, t, g, unknown or other
tcagtctacgtagccacgaccggtgctcgatttagagtatacatattgggtttgaggtctcagagaggagccttagccctggactccaaggcctttccacttggtgatcagcactgagcacagagaactcaccatggagttgggtctgagctgggttttcttgttgttatttagaaggtgtccagtgtggaggtgctacgttgggtggaggtcgtggggggaggcgtttgggtccgagggccgggggggtccctggagactctcctgtgcagtctntggtattcaccttagtaagtatggatcgaccgtgggtccgccgaggctccggaagggggagggcgtggggaggtggggtacggaccaaacgaagtaaaacgaaaggaaccggaaagtacgaaaagtaaaaaacctgtaggtacggtactcgtaaggtacgggaaccgggcctaattaccaaccctattacctacgaagaacgaaccaaaccggaccaaaggtaacttacgtaactttagttaatttaggaacctaaaagtacgaaaacgacgtacccggtaaggaagggaacgggaccgggaagggaacccgtaccgggtacccgtttaaggtttaatttaaggtttggtcggacccgggttaacggaaggttaaagttaggaaacgttaaacgggtagttaaaccctttacgttaaaccggtaaggttaaacggtaacgggtaaggggtttagggttagttaaccggttaagttttcggg

SEQ ID NO: 371021 - DNA, 597 bp, Homo sapiens
  misc_feature: GZ8MTXP01B7MLY.15.67.G01.1.454.CMB.2.raw
  modified_base (482)..(482): a, c, t, g, unknown or other
  modified_base (533)..(533): a, c, t, g, unknown or other
  modified_base (539)..(539): a, c, t, g, unknown or other
tcagtctacgtagccacgaccggtgctcgatttagagtatacatattgggtttggggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtgggggaggcttggtccgagggcccggggggtcctgagactctcctgtgcagtctctgattccacccttagaagttatggatgaccgtgggtccgcaaggcctccgaggggaaggggcgtgggaggtgggtcggaccaaacgaataaaaacgaaaggaacggaatacgaaagaaaaactatggtaggactcgtgtaacgaaccggcgattccactagtcctaccgagacgacaacgaccaaagtaattcaacttagtatttagacaatanaacagcctaggggaggacggacgaggacgacggcgtgttattagtgtgcgngaagtnttagagttagaacgtcttacttgagtggacgtaaggttggtattgtaagttgtttaag

SEQ ID NO: 371022 - DNA, 548 bp, Homo sapiens
  misc_feature: GZ8MTXP01D1IRX.15.67.G01.1.454.CMB.2.raw
  modified_base (293)..(293): a, c, t, g, unknown or other
  modified_base (361)..(361): a, c, t, g, unknown or other
  modified_base (393)..(393): a, c, t, g, unknown or other
  modified_base (396)..(396): a, c, t, g, unknown or other
  modified_base (401)..(401): a, c, t, g, unknown or other
  modified_base (409)..(409): a, c, t, g, unknown or other
  modified_base (413)..(413): a, c, t, g, unknown or other
  modified_base (422)..(422): a, c, t, g, unknown or other
  modified_base (424)..(424): a, c, t, g, unknown or other
  modified_base (426)..(426): a, c, t, g, unknown or other
  modified_base (428)..(428): a, c, t, g, unknown or other
  modified_base (430)..(430): a, c, t, g, unknown or other
  modified_base (432)..(432): a, c, t, g, unknown or other
  modified_base (471)..(471): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttctgtagtatttagaagtgtcagtgtgaggtgcacttggtggagtcgtgggggagcgtttggtccaggccgggggggtccctgagactctcctgtgcagtctctggattcacctagaagtatggatgactgggtcncagctcgagggaggctggagtgggtagaccaaacaataaacgaaagacgaagtacaaagaaaaaactntagtaggactcgtagagaacggccattcaacntcncaganacagcaanatanatatattananananananacgagagagacgacgacgacgcgtagtagttagttgtgngaacgagagtagttagtaacgtaacgttacgttacgttacgtaagtaggtaacgtaggtaggttagtaagttaagtg

SEQ ID NO: 371023 - DNA, 643 bp, Homo sapiens
  misc_feature: GZ8MTXP01BV00R.15.67.G01.1.454.CMB.2.raw
  modified_base (266)..(266): a, c, t, g, unknown or other
  modified_base (284)..(284): a, c, t, g, unknown or other
  modified_base (583)..(583): a, c, t, g, unknown or other
  modified_base (610)..(610): a, c, t, g, unknown or other
  modified_base (618)..(618): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtcctgagactctcctgtgcagtctcnggattcaccttagaagtntggatgacctggtccgcaggctaccgaggggaggcgtggaggtgggtagaccaaacgaataaaacgaaaggaacggaaagtacgaaaagtaaaaaaccctgtaggtaggtaacttcgtaaggttacggaaccggggcctaatttccaaccctattcccgacgaaggaacgaacaaaccgtacccgaaaagtaacttacgaaactttggttaatttcgaactaaaatacgaaacaagccggtaggaagacgggacggacggacgacggtcgtagttattagttcgacgcggaagaagttntaggacttaagacgttacttccgttanaaggtcgnggtaaggtgttagtgttaagttcgg

SEQ ID NO: 371024 - DNA, 668 bp, Homo sapiens
  misc_feature: GZ8MTXP01B65Y1.15.67.G01.1.454.CMB.2.raw
  modified_base (328)..(328): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcttgggtccagggcccggggggggtccctggagactctcctgtgcagtctctggattcaccttagaagtatggatgactgggtccgcaggctccgaggggagggcnggagtggggtcggaccaaacaataaaacgaaaggacggaaagtacaaagaaaaaaccctgtaggtagggacttcgtaagttacggaaccggccgaatttccaaccctatcctaccgaaaggacgaacaaaccggaccaaagtaaacttcgaacttggttatttagactaaaagtgaaacaggaccgtaggaagggaacgggacggaaggaaccgaccggggtaccgttggttaatttagttggtacggcgggaacgaaggttagtggaacgtaggttacggaacctttccgttaacgtaaggtacgtcggtaaggggttaggttacgttgttaagtttgg

SEQ ID NO: 371025 - DNA, 540 bp, Homo sapiens
  misc_feature: GZ8MTXP01C7LWE.15.67.G01.1.454.CMB.2.raw
  modified_base (253)..(253): a, c, t, g, unknown or other
  modified_base (323)..(323): a, c, t, g, unknown or other
  modified_base (376)..(376): a, c, t, g, unknown or other
  modified_base (470)..(470): a, c, t, g, unknown or other
  modified_base (476)..(476): a, c, t, g, unknown or other
  modified_base (488)..(488): a, c, t, g, unknown or other
  modified_base (519)..(519): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccaggccgggggggtccctgagactntcctgtgcagtctctggattcacccttagaagtattggatgacctgggtccgcaggctccgagggagggntggagtgggtggccaacaataaaacgaaagacggaaagtcaagaaaaaacctntgtggactctagtgaacggcgattcaccatctacagagacaacgaccaagtaattcaactgtattgacaaatgaacagcgtagagagcgagacncgcgtntagtatgtgcgngagatgagtagtagacttcttacgaagtagngaagggtggttatgaagttcg

SEQ ID NO: 371026 - DNA, 1076 bp, Homo sapiens
  misc_feature: GZ8MTXP01BBETR.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagtcttgggttttccttgttgtttattttagaaggtgtccagtgtgaggtgcacgttggtggtagtcggtggggggaggtcgttcgggtccgacggggtcccggggggggtccctggacgtacctccttcccgtggtgctagttccttcgtggtacttccgtaacccgtttaaggtaaaggttagttagggtacgttacggtaaccccggttcgggggtcccccggacccgtacggggtacccgttacccgggaacggggggaaacgggggtccggtagggggtacgggttcggggggtaaccggaaccccgaaaacgtaaaacgttaaaaaaaccggaaaaacgggtaaaccgggtaaaacggtaaaccgtaaaaaccggtaaaaaaaaccccgttaggttacgggtttaaccggggtaacccgtttaccgggttaaacggggtttaaacggggaaccccggggtacccgggttaaaccgtttaaccccaaccccggtaaacctttacccccggttaaaccccggaaaacgggtaaaacccgggaaaacccgaaaaaaccccgggtaacccgtaaaaaaacgggttaaccctttttaaaccgtaaacccggttttaagggttttaaacttttaacgggaaaacccttaaaaacgtaaaccggttaaaaccggaacgggtaccccggggttaaaggggaaaccgggggtaaacggggacccggggaaacggggtaacccggtaaacccgggggtacccgggtttaaggtttaaccgtttagggttaacgggttcgggacgggtaaccgtaagggttacggttaacgttaaggttaaacggttaacgttaaccgtttacgaaccgggttaagggtaccgggtcgggttaagggggttacggttaaacgttcgggttaagttttccgggg

SEQ ID NO: 371027 - DNA, 663 bp, Homo sapiens
  misc_feature: GZ8MTXP01C3WTK.15.67.G01.1.454.CMB.2.raw
  modified_base (309)..(309): a, c, t, g, unknown or other
  modified_base (339)..(339): a, c, t, g, unknown or other
  modified_base (380)..(380): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggaggtcgtggggggaggcgttggtccgagggccgggggggtccctgagactctcctgtgcagtctctggattcacccttagaagtatggatgacctgggtccnccaggctccgaggggagggctggagtgggnggccaaacaataaacgaaagacggaatacaaagaaaacctntggtggactctggtagaacggccgtaattccgaaccatcctaccaagacgaacaaacgaccaaagtaacttacaacttgttaatttagactaaaagtcgaaacacggcccgttaagggaacgggaacgggaccgggaagggaaacccgaccggggtaccgttaggttactttaagttggtcgccggaaggtaagagttagaagtttaaacggtacgttaaccgttcgttaacgtaaggtaaacggcgtaaagggggttggttagtttaaggaacgttttaagg

SEQ ID NO: 371028 - DNA, 633 bp, Homo sapiens
  misc_feature: GZ8MTXP01BC5WT.15.67.G01.1.454.CMB.2.raw
  modified_base (368)..(368): a, c, t, g, unknown or other
  modified_base (406)..(406): a, c, t, g, unknown or other
  modified_base (416)..(416): a, c, t, g, unknown or other
  modified_base (600)..(600): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggtcgttgggtccgacgggcccggggggggtccctggacgtacctcctccgtgtgctagtctcgtggacttcacccttagtaagtattggatgaccgtgggtccgccgaggctccgaggggagggcgtgggaggtgggtcggaccaanaagtaaaacgaaaggaccggaaagtcaaagaaaacctntgtgactcgngtacgcgcgattcacctatctacagacgaacaacgacaaagaacttcaacgttgttatttagactaaaatcgaaacagtaccgtaggaaggagggacggaacggacgaccgggtcgtagttaagttagtttggtgcggtgagttatgggaattaggtaaggacttccgttaacgaagggtttcnccggtaggggttggttaattgttaagttttggg

SEQ ID NO: 371029 - DNA, 506 bp, Homo sapiens
  misc_feature: GZ8MTXP01CJBQH.15.67.G01.1.454.CMB.2.raw
  modified_base (209)..(209): a, c, t, g, unknown or other
  modified_base (219)..(219): a, c, t, g, unknown or other
  modified_base (298)..(298): a, c, t, g, unknown or other
  modified_base (303)..(303): a, c, t, g, unknown or other
  modified_base (305)..(305): a, c, t, g, unknown or other
  modified_base (312)..(312): a, c, t, g, unknown or other
  modified_base (314)..(314): a, c, t, g, unknown or other
  modified_base (316)..(316): a, c, t, g, unknown or other
  modified_base (318)..(318): a, c, t, g, unknown or other
  modified_base (320)..(320): a, c, t, g, unknown or other
  modified_base (324)..(324): a, c, t, g, unknown or other
  modified_base (327)..(327): a, c, t, g, unknown or other
  modified_base (331)..(331): a, c, t, g, unknown or other
  modified_base (335)..(335): a, c, t, g, unknown or other
  modified_base (339)..(339): a, c, t, g, unknown or other
  modified_base (341)..(341): a, c, t, g, unknown or other
  modified_base (343)..(343): a, c, t, g, unknown or other
  modified_base (349)..(350): a, c, t, g, unknown or other
  modified_base (352)..(352): a, c, t, g, unknown or other
  modified_base (354)..(354): a, c, t, g, unknown or other
  modified_base (356)..(356): a, c, t, g, unknown or other
  modified_base (358)..(358): a, c, t, g, unknown or other
  modified_base (369)..(369): a, c, t, g, unknown or other
  modified_base (371)..(371): a, c, t, g, unknown or other
  modified_base (374)..(374): a, c, t, g, unknown or other
  modified_base (376)..(376): a, c, t, g, unknown or other
  modified_base (386)..(386): a, c, t, g, unknown or other
  modified_base (400)..(400): a, c, t, g, unknown or other
  modified_base (402)..(402): a, c, t, g, unknown or other
  modified_base (406)..(406): a, c, t, g, unknown or other
  modified_base (408)..(408): a, c, t, g, unknown or other
  modified_base (448)..(448): a, c, t, g, unknown or other
  modified_base (450)..(450): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggggttttccttgttgttattttagaaggtgtccagtgtgaggtgcactggtgagtntgggggaggnttggtccagccggggggggtccctgagactctcctgtgcagtctctggattcacccttagaagtatgatgacctggtcncagcncnggagggngngngngngcanaanaaanaaanaganananaaacanngntngngngacatacacancncananacaacacaanaatacatatattananaaananaacagacgagagaggacgagacgacgcgtagtatatgtgngngagatagagtagtagacgttcttactaagtagaacgaggtaggttagtgttaagtg

SEQ ID NO: 371030 - DNA, 682 bp, Homo sapiens
  misc_feature: GZ8MTXP01AC7TU.15.67.G01.1.454.CMB.2.raw
  modified_base (355)..(355): a, c, t, g, unknown or other
  modified_base (398)..(398): a, c, t, g, unknown or other
  modified_base (623)..(623): a, c, t, g, unknown or other
  modified_base (652)..(652): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtgggagtcgtggggggaggcttgggtccgagggcccgggggggtccctgagactctcctgtgcagtctcgtggattcaacccttagaagttatggatgacctcgggtccgcgaggcctccgaggggaagggctgggagtgggtgaccaaanaaagtaaaacgaaaggaacggaaagtacgaaagaaaaaacctntaggtagggtaactcgttaagggtacggaaccgggtcccgtaaatttcccaaaccctattccgaccaaaggaaccggaaacaaaccggaaccaaaaggtaaaccttactaacttaggttaattttacgaaactaaaagttaaggaaacaacggcctagggaaggacgggacggaagggaccgaccgggaccgttaggttaatttaggttggtacgcggaagaagnttaggaagttagtagttacttcttaacgngtagcgagggttggttaatgttaagtttcg

SEQ ID NO: 371031 - DNA, 582 bp, Homo sapiens
  misc_feature: GZ8MTXP01AKQOC.15.67.G01.1.454.CMB.2.raw
  modified_base (345)..(345): a, c, t, g, unknown or other
  modified_base (536)..(536): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtggggggagtcttgggtccgagggcccggggggtccctgagacctctcctgtgcagtctctggacttcaccttagaagtatgatgacgtggtccgcgaggctccgaggggaggctgggagtgggtggaccaanaataaaacgaaagacggaaagtacaaagaaaaacctgtagtaggactgtagtcggaaccggccgtaattcaccatcctcgaagagacaacgacaagtatacacttgtattgacaaatgaactacgcgtagaggaggaccgagaccgcgacgtgtagttatgtagcggtaacgagttagtgaagtaggttanacgttcttacgtaagttagaacgtagggtgttacgtgttgtttaag

SEQ ID NO: 371032 - DNA, 636 bp, Homo sapiens
  misc_feature: GZ8MTXP01CR9NU.15.67.G01.1.454.CMB.2.raw
  modified_base (309)..(309): a, c, t, g, unknown or other
  modified_base (608)..(608): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccgagggccgggggggtccctggacgactctcctgtgcagtctctggattcacccttagaagtattggatgacctgggtccnccaggctccgaggggagggctggaggtgggtggccaaacgaataaaacgaaagaacggaagtacaaagaaaaaccctagtgtggactcgtgtagaacgggccatttccacgatcctacagacgaacaaccgtacccaaagtaacttcaacttcgttaattttacggactaaaagtcgaaactacgcccgttaggaacgggacgggacggaaggaccgaccgggtccgttaggtatttagttgtcggcggaacggagttagtaggaagttaacggtagaccgttcttaaacgtgtacggngtagggttaggttagtgttaagtttggg

SEQ ID NO: 371033 - DNA, 544 bp, Homo sapiens
  misc_feature: GZ8MTXP01A0PVR.15.67.G01.1.454.CMB.2.raw
  modified_base (302)..(302): a, c, t, g, unknown or other
  modified_base (306)..(306): a, c, t, g, unknown or other
  modified_base (315)..(315): a, c, t, g, unknown or other
  modified_base (387)..(387): a, c, t, g, unknown or other
  modified_base (394)..(394): a, c, t, g, unknown or other
  modified_base (398)..(398): a, c, t, g, unknown or other
  modified_base (400)..(400): a, c, t, g, unknown or other
  modified_base (410)..(410): a, c, t, g, unknown or other
  modified_base (423)..(423): a, c, t, g, unknown or other
  modified_base (425)..(425): a, c, t, g, unknown or other
  modified_base (428)..(428): a, c, t, g, unknown or other
  modified_base (430)..(430): a, c, t, g, unknown or other
  modified_base (432)..(432): a, c, t, g, unknown or other
tcagtctacgtagccacgaccggtgctcgatttagagtatacatattgggtttggaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggccgggggggtccctgagactctcctgtgcagtctctggattcacccttagaagtatggatgactggcncagncgaggaggngtgagtggtgcgaacataaacaaagagaagacaagaaaactaatagtaggactctagtagaacgacgattanaccatcncaananacaacacaanaatatatatatananaanananagacgagagagacgagacgacgacgtagtagtagttagtgcgaagagagtagttagtagtaacgttacgttacttacgaaggtagtaacggtaggtaggttagtaagttgtg

SEQ ID NO: 371034 - DNA, 766 bp, Homo sapiens
  misc_feature: GZ8MTXP01BV87O.15.67.G01.1.454.CMB.2.raw
  modified_base (320)..(320): a, c, t, g, unknown or other
  modified_base (366)..(366): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatgggagttggggctgagcgttgggttttccttgttgtttatttagaaggtgtcagtgtgaggtgctacgttggtggagtcggtggggggagtcgttgggtccgacgggccggggggtcctggagtactctctgtgcagtctcgtggtacttctaccttagtaagttatggatcgaccgtgggtccnccgaggctccggaggggaacgggcgtgggaggtgggtcgaccaaanaaactaaaacgaaaggaacggaaagtacaaaagtaaaaaccctgtaggtcggaacttcgtaagggtacgtaacccggggcttaactacccaaccgtacttcccaccgaagaacgaaccaaacggaacctaaagtaaacttacgtaacgttacgtttaatttacggaaactaaaacgtacggaaaacgtacggccggttaaagggtaacggggaacgggaccgggaaacgggaaccggtaacccggggtaccggtttaaggtttaaacgtttacggtttaggtccgggacggtaaggaagttaagttaccggaaagttaaagggtaacggttaaccttacgttaaaccggtaaggtccggtaagttagggggttagttaagttccgttaaagttttccggg

SEQ ID NO: 371035 - DNA, 675 bp, Homo sapiens
  misc_feature: GZ8MTXP01AKGOK.15.67.G01.1.454.CMB.2.raw
  modified_base (197)..(197): a, c, t, g, unknown or other
  modified_base (559)..(559): a, c, t, g, unknown or other
  modified_base (611)..(611): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtncacgttggtggagtcgtgggggaggcgttggtccgagggcccggggggtccctggagacctctcctgtgctagtctcgtggacttccacccttagtaagttatggatcggtacccgtgggtacccgccgaggccgtaccggagggggaacggggctggggaggttggggtcggaccgtaaacaagtaaaacgaaaggaacggtaaagtaccgaaagtaaaaaaccctagtggtacggtactcgtaggtacggaacggcccgtaatttccaacctacttcctaccgaagaccgaacaaccggaccaaagtaacttaccgaattggtttaaactttacgaactaaagtagaaccgaggtaccgnggaaacggagggaccggaagaccgaccggtccgtagtaattgtagcgtcggngagatagaagttaggtacacgttccgaacgtaaggttaagcggtaggttggttagtgttaagtg

SEQ ID NO: 371036 - DNA, 558 bp, Homo sapiens
  misc_feature: GZ8MTXP01DRGJQ.15.67.G01.1.454.CMB.2.raw
  modified_base (340)..(340): a, c, t, g, unknown or other
  modified_base (410)..(410): a, c, t, g, unknown or other
  modified_base (419)..(419): a, c, t, g, unknown or other
  modified_base (428)..(428): a, c, t, g, unknown or other
  modified_base (440)..(440): a, c, t, g, unknown or other
  modified_base (442)..(442): a, c, t, g, unknown or other
  modified_base (493)..(493): a, c, t, g, unknown or other
  modified_base (530)..(530): a, c, t, g, unknown or other
  modified_base (540)..(540): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactaaccatggagttggggctgagcttgggttttccttgttgttattttagaaggtgtccagtgtgaggtgcacttgggtggagtcgtgggggagtcgttggtccagggccggggggtccctgagactctcctgtgcagtctctggattccacccttagaagttatggatgaccgttggccgcaggctcgagggagggctggagtggtgacaanaagtaaaacaagacgaagtacaaagaaaactagtgtaggactcgtagtacgaacgccgtattccacctanctccaaganacagacaanattcatgtattnanaaatgaacagcctaggacggagtacgagacgcgcgtagtattagtgtgcgngaagattgaagttagtacgacttacgaagttagaagngtaaggtgtnttagtaagttgtttaacg

SEQ ID NO: 371037 - DNA, 589 bp, Homo sapiens
  misc_feature: GZ8MTXP01BXYMO.15.67.G01.1.454.CMB.2.raw
  modified_base (565)..(565): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtcctgagactctcctgtgcagtctctggtattcacccttagaagttatggatgacctgggtccgccgaggctccgaggggaaggggcgtgggacggtggggtcggaccaaacgaataaaacgaaaggacggaaagtacaaagaaaaacctatggtaggactcgtagtgaacggccgtattcaccatctacagacacaacgaccaagaacttcacttagtatttagacaaatgaaacagccgtaggagagggacgaaggacgacggtccgtagtagttagttgtcgcggcgagttagtgagtagtagacgttcttaagaagttagngtaggtggttatgttaacgtttgg

SEQ ID NO: 371038 - DNA, 618 bp, Homo sapiens
  misc_feature: GZ8MTXP01E2WGH.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtgggggaggcttgggtccgaggccggggggtccctgagactctcctgtgcagtctctggattcacccttagaagtattggatcgaccgtgggtcccgccgaggctaccgaggggaagggcgtgggagtgggtcgaccaaacaataaaacgaaagaacggaaagtacgaaagtaaaaacctgtgtaggaactcgtagtacggaaccggccgtaattcacctatctcaagagacaaacgccaaagattcacttgttatttacgacaaagtacgaacgacgaccggtaggaaggagggcggaaggaccgacgggtccgtagtatttagtgtcgcggaagagttagtgttaagtaggtacacgttccttaagtaaggtagaacgtaggtaggttatcggttaagtttgg

SEQ ID NO: 371039 - DNA, 746 bp, Homo sapiens
  misc_feature: GZ8MTXP01BYGWL.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaggtgtccagtgtgaggtgcacttggtggagtcgtgggggaggcgttgggtccgagggcccggggggtccctgacgactctcctgtgcagtctctggtattcacccttagtaagttattggattcgaccgtgggtccgccgaggcctccggagggggaacggggcgtagggaggtggggtacgggaccaaacgaataaaacgaaaaggacggaaagtacaaagaaaaaaccctagtagtacggactcgtaaggttacggaaccgggcccgtaatttacccacctatcctaccaacgaagaacccgaaacgaccaaagaacttactaacgttgtttaagtttacgaacgtaaattacggaaacacggaccggtaggaaggaacggacgggaaacgggaaccgacccggggtacccgtttagggttaactttaggtttacgggttcgaccgggtaacggtaacggttagttaggttaaaccgttagggttaaacgttacgtttaccgttaaccggtaagggttaacccgcgggttaaggggttacgggttaaagttcggttaagtttcggg

SEQ ID NO: 371040 - DNA, 601 bp, Homo sapiens
  misc_feature: GZ8MTXP01D9XQC.15.67.G01.1.454.CMB.2.raw
  modified_base (280)..(280): a, c, t, g, unknown or other
  modified_base (295)..(295): a, c, t, g, unknown or other
  modified_base (310)..(310): a, c, t, g, unknown or other
  modified_base (383)..(383): a, c, t, g, unknown or other
  modified_base (429)..(429): a, c, t, g, unknown or other
  modified_base (538)..(538): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcgttgggttttccttgttgttattttagaaggtgtccagtgtgaggtgctacgttggtggagtcgtgggggagtcgttgggtccgagggccggggggttccctgacgtactctcctgtgcagtctctggtnttcacccttagaatntgatgacctggtccnccgagctccgaggggaggcgtggagtgggtgacaaacaagtaaaacaagaacgaagtacaaagtaaaaacctntgtggactgtaagtagaaccggccgtattaccaccatccaccgtanacggacaacgaccaagtaattcaacttagttactttagactaaatacgaaacacgtccgaggaagagggacgaaggacgtacggaccgtagttattagttgtaccgggngaacgagagtagttagtaacgtacacgttcttagtaagtagtgtaggtagttagtgttgttcg

SEQ ID NO: 371041 - DNA, 732 bp, Homo sapiens
  misc_feature: GZ8MTXP01A8L42.15.67.G01.1.454.CMB.2.raw
  modified_base (316)..(316): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggtattttccttgttgttattttagaaggtgtccagtgtgaggtgctacgttggtggagtcgtgggggagtcgttggtccgaggccggggggtcctggacgtactctccgtgtgctagttctcgtggacttccacccttagaagttatggatgaccgtggtccncaggctccgaggggaggctggagtgggacgaccaaacaataaaacgaaacggacggaaagtaccgaaaagtaaaaacctgtaggtacggtaaccttgtagtaacggaaaccgggtccctaatttacccacctatcctaacccagaacgaaccaacggtaccaaagtaactttaccgaattaggttactttacgaacgtaaaacttcgaaaaccgacggtacccgtaggaacggaacgggaccggaaccggttaaccggaccgggttacccggtttggttaaacctttaggttggtacggtaacccggtaacggaagttaaaccggttcggtaaacgttaaccggggttaacttaccgggtttaaccctaacggaaggttaacgacggtaaggggttagggttaattgggtttaaag

SEQ ID NO: 371042 - DNA, 797 bp, Homo sapiens
  misc_feature: GZ8MTXP01BTANQ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgttgggttttccttgtttgtttattttagaaggtgtccagtgtgaggtgctacgttggtggaggttcggtgggggaggtcgttgggtccgacggggcccggggggttccctggacgtacctctccgtgtcgctagtccttcgtggtacttcctacccgttaagtaagttagttggatcggtaccgtgggtcccgccgaggccgtaccggagggggaacggggcgtggggtaggtcggggtcggacccaaaacgaaagtaaaacgaaaggaacggaaagtaacaaaaggtaaaaaaccttgtaggtacggtacttacgtacgggtacggaacccgggtccgtaactttacccaaccctaacttcccgtaaccgaaaggaccgaaacccgaaaccgtaccgaaagtaacttacgtaaaccgttaggtttaactttacggaactaaaagttacggaaactacggtacccgggtaggaacggggaacgggacgggtaaacgggaacccggtaccgggtaccggtttagttaaagtttgttcggtacgccggtaaggtaagttagttaggttaaagttaacggtaacgttaccgttaccgttaaggtaacggtaggtaacgttaggggtagtttagtcggttaagttttgg

SEQ ID NO: 371043 - DNA, 674 bp, Homo sapiens
  misc_feature: GZ8MTXP01D2UXI.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggagcgttgggtccgagggccggggggtccctggacgactctcctgtgctagtctctggtacttcacccgttagaaagttattggattcgaccgttggggtcccgccgtaggccgtaccggaaggggagggcgtgggaaggtcggggtacgacaaccgaaagtaaaacgaaagacggtaaagacgaaagtaaaaacctgtaggtagactcgtaaggtacgaaccgggcctatttaccaaccacttacctaccgaagacgaacgaaaccgtaaccaagtaaacttctaacttagttatttacgaataaagtagaaacacgtcggtaacgaggaacgggacgaaggaaccgacgggtaccgtagttaagttagtggttcgcggaacggtaagagtacgagttaacgtaagttaccttcttacgaagtagaacgtagggtagttagtgttaacgtttaagg

SEQ ID NO: 371044 - DNA, 750 bp, Homo sapiens
  misc_feature: GZ8MTXP01A92T0.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcttggtccagggccggggggtcctgagactctcctgtgcagtctctggattcaccttagtaagtattggatcgacgtgggtcccgccgaggctccggaggggaacggggctggggaggtgggggtacggacccaaacgaataaaacgaaaggaaccggaaagtacgaaacgaaaaaacctagtaggtacggtaacgtccgtagggtaacggaacccgggccgtaaactttcccaaccctatacccgttaccaaggaacggaaccaaaccggtaacccaaaaggtaaactttaccgaacgtttaggtttaattttacggaacttaaaagtacgaaacgtaacggtcccggttaagggaaaggggaacggggaccgggaacggtaacccgaacggggttacccgtttagggttaattttcgttaagggttcggcccgggaacggtaaagagtttaggaacgttaaggtaacgttacgttcttaacggtaaggtacgtaacgggtaaggttcgggttaatggttaagtttgg

SEQ ID NO: 371045 - DNA, 610 bp, Homo sapiens
  misc_feature: GZ8MTXP01CF5IW.15.67.G01.1.454.CMB.2.raw
  modified_base (353)..(353): a, c, t, g, unknown or other
  modified_base (478)..(478): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtggggggaggcttggtccgaggccgggggggtccctgagactctcctgtgcagtctctggattcacccttagaagtattggatgacctgggtcccgccgaggctccgaggggaaggggctgggaggtgggtcggaccaaanataaacgaaaggacggaagtacaagaaaaacctagtgtaggactcgtagtacggaacggcccgtaattccacctatcctaccagacgacaaacgcaaagaattcactgtatttgacaaatgaacngaccgtggaacggagggacgagggaccgaccgggtccggttagtatttagttggtcggcgaacgtaggagtgaagttagtacgacttacgttacgaaggttgaacgtaggggttgttagttcgaagtttcgg

SEQ ID NO: 371046 - DNA, 844 bp, Homo sapiens
  misc_feature: GZ8MTXP01D6L7Z.15.67.G01.1.454.CMB.2.raw
  modified_base (814)..(814): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagtcgttgggttttcttgttgtttatttagaggtgtcagtgtgaggtgctacgttggtggtaggttcggtggggggaggtcgtttcgggtcccgacgggggtcccggggggttccctggacgtaccttccttccgtgtcgcgtagttctcgtggtacttaccgtaacccgttaagtaacgttagttggagttcgtaccggttcgggtccccgaccgacggtccgtaccgggagggggaacgggggtcgtagggggtaacgggttcgggggtacggtaaaccccgtaaaacgtaaaacgtttaaaaaaccgggaaaaacggaaaccgggggtaaaacgttaaacggaaaaaacgttaaaaaaaccccgttaggttacgggttacggtaaaccttcggtaacgggtttaacggaacccggggaccgttaacgtttacccaacctaacgttccctaacgaacggaaacgaaccgaaaccggaacctaaaaggtaacttacccttaaggtttacgtttaattacgaaacttaaactagaaacgacgtccggggaagacggggaggaccggaacggtaaccgaccggggtacgtttaggttatttaggtggttcgacggaacgaaggttagtacgttaagttaagtaacgacttcgttaagtaacggttagngttaagggtgttaaatcgttaagggtttcg

SEQ ID NO: 371047 - DNA, 640 bp, Homo sapiens
  misc_feature: GZ8MTXP01EW2OK.15.67.G01.1.454.CMB.2.raw
  modified_base (374)..(374): a, c, t, g, unknown or other
  modified_base (560)..(560): a, c, t, g, unknown or other
  modified_base (569)..(569): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcgttgggtccgagggcccggggggggtccctgacgactctcctgtgcagtctctggattcacccttagaagtatggatgacctgggtccgccaggctccgagggagggctggaggtggtgcaacataaacaagacgaagtcaagaaaacctntaggtcggactctaggtcgaaccgggccgattccaccagttcctacccgaagacgaacaaaccggacccaaaggaaacttacgaaccttaggtttactttaggaccaaaatacgaaacacgtcccgtaggaacgggagggacggaacgggacgtacgggccgttagttagtttagttggtcgcggngaaggttanaggttaatagggtaacacttcgttaacgaagggttagaacggtaagggttggttacgttggttaagtttgg

SEQ ID NO: 371048 - DNA, 811 bp, Homo sapiens
  misc_feature: GZ8MTXP01AGEQS.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagtcgttgggttttccttgtttgtttattttagaaggtgtccagtgtgaggtgctacgttggtggaggttcggtgggggaggtcgtttcgggtcccgacgggggtcccgggggggttccctggacgtaccttccgttcccgttggtcgcgtacgttccttcgtggtactttccgtaacccgtttagtaaagttagttaggtattcggacccgttcggggtccccgccgacggccgtaccggaagggggaacgggcgtggggaggttgggggtacggaccaaaacgaaagtaaaaccgaaaggaacggtaaagtacgaaaagtaaaaaaccccttgtaggtacgacttcgtaagggtacgggaacccggtccgtaactttacccaaccctacttacccgtaacccaaacggaacgaacccgtaaacccgacctaaaagtaaccttactaaccttaggtttactttagaaaccttaaaagtacgaaacgtacgaccgggttaggaacgggagggacggaacggaccgtaccgggtaccgtttaaggttacgttttagtcggtcggaccggaaggtaaattgtaaggttaaagttaaggtaaccgttaacgttaccgaacggtaagttagaacggttaaggggtggtttaagtggttaacgtttgg

SEQ ID NO: 371049 - DNA, 647 bp, Homo sapiens
  misc_feature: GZ8MTXP01COG0H.15.67.G01.1.454.CMB.2.raw
  modified_base (315)..(315): a, c, t, g, unknown or other
  modified_base (337)..(337): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgtttgttattttagaaggtgtccagtgtgaggtgcacgttggtggagtcgtgggggaggcgttgggtccgagggccggggggtccctgacgtactctcctgtgctagtctcgtggtattcacccttagaagtatggatgacctgggtcccncgaggctccgaggggacgggcngggagtgggtggaccaaacgaataaaacgaaaggaccggaaagtacaaaagtaaaaaaccctgtaggtggactcgtaggtacgaaccgggccgtaacttccaacctagtcctaccaagacgaacaaccgacaaagtaacttccaacttgttactttagactaaaagtcgaacacgccgtaggacggacgggacggaacggaccgacgggtccgttagttaagttagtggtcgcggtaacgtagagtgaagttaaagtagacttccttaagtaagtaacgtgtaagggttggttaattggttaacgtttgg

SEQ ID NO: 371050 - DNA, 775 bp, Homo sapiens
  misc_feature: GZ8MTXP01BJXKZ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggaggttggggctgagtcgtgggttttccttgttgttattttagaaggtgtccagtgtgaggtgcacgttggtggagtcggtgggggaggtcgttggtccgacgggcccgggggggtccctggacgacctctcctgtcgcagtctcgtggtacttcctaccgttaagtaagttagtgggattcggaccgtcggggtcccgccgaggctacccgggagggggaacggggcgttaggggacggttgggggtcggaaccaaacgaaactaaaaacgaaaggaacggaaacgtacgaaagtaaaaaacccgttgtaggtaggaccttcgtaagacggaaccgggtcctatacccgaaccatttacccgacgaaacgacgaaaccgaaccggaccaaaagtaacttacaacgtttaggtttaatttacgggaactaaacgtacgaaacgtagtacccggggtaaggaacgggtaagggaccggaaaggtaccggtaccgggtaccgttaaggtttaactttaggttcgtagggtcccggaaggtaaagttggttaaagagttaaacgggtaacttaaccggttacttaaacggtaagggttaaggaacggttagggggtttagttacgttcggttaagttttggg

SEQ ID NO: 371051 - DNA, 580 bp, Homo sapiens
  misc_feature: GZ8MTXP01AN4PB.15.67.G01.1.454.CMB.2.raw
  modified_base (376)..(376): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccggggggggtccctgagactctcctgtgcagtctctggattcacccttagaagtattggatgacctgggtccgccaggctccgaggggaaggggctgggagtggggtggccaacataaacaaagacggaagtcaagaaaaacctntgtggactctagtgaacggccgaattcaccgatctccagacgacaacgcaagatacactgtattgacaaatagaacacgccgtgagaggcgaaggacgacggcccgtaggttattacgttagtgccggtgaaggagtggaagtaacgtaggaacccttcttaaccgaagtaggtaacaggggtaggttactaaggttaagttgg

SEQ ID NO: 371052 - DNA, 618 bp, Homo sapiens
  misc_feature: GZ8MTXP01AS9D2.15.67.G01.1.454.CMB.2.raw
  modified_base (565)..(565): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggagcgttggtccgaggccgggggggtccctggacgactctccgtgtgctagtctcgtggattcacccttagaagtatggatgaccgtgggtccgccaggctccgagggggaacgggcgtgggaggtggggtcggaccaaacgaactaaaacgaaaggaaccggaagtaaccgaaagtaaaaaaccctgtagtaggacctcgtaggtacgaaccgggccgtattccaccctatcctaccaagacgacaaacgacccaaagtaacttactacttggttaatttacgacctaaatagaacaggaccgtaggaacggagggacgaggacgacggccgtagtattagtgtcgcgngagagtgagtaagtagacttcacgtaagagcgagggtagttagtgcgtttaag

SEQ ID NO: 371053 - DNA, 653 bp, Homo sapiens
  misc_feature: GZ8MTXP01B6FNA.15.67.G01.1.454.CMB.2.raw
  modified_base (588)..(588): a, c, t, g, unknown or other
  modified_base (599)..(599): a, c, t, g, unknown or other
  modified_base (619)..(619): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcttggtccgaggcccggggggtccctgagactctcctgtgcagtctctggattcacccttagaagttattggatgaccgtgggtccgccgaggctccgaggggaagggctggagtgggtcgaccaaacaataaaacgaaaggaaccggaaagtacgaaagtaaaaaaccctagtaggtacggaacctcgtaggtacggaaccgggcccgtaatttccaacccattaccctaccgaagaacgaaccaaaccgacccgaaagtaaacttaccaacgttgttaatttacgaactaaagtagaaacgacgaccgtaggaacgggagggacggaaacgggaaccgaccgggtaccgtaggttattagttggngtcgaacgganagtagagtaagtagaccttnaacgtaagtagcgtagggtgttagtgttaagttg

SEQ ID NO: 371054 - DNA, 791 bp, Homo sapiens
  misc_feature: GZ8MTXP01EWRT3.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggaggttcgtggggggagggtcgtttgggtcccgacggggtcccggggggggttcccttggacgaccttcctccgtggtggcaggttcttcgtggtacttccacccttaaggaagttattggactcggacccgttggggtccccgaccgacgggtcgtacccggaaaggggggtaacggggtccgttgggggtaaggttgggggtacggaccccgaaaacgtaaagtaaaaaccggaaaaggaaccgggtaaaagttacgaaaacggtaaaaaaaccttggtacggtagggtaaccttcgtaacgggtaacggaaccggggtacccgtaaatttaccccgaacctacgttacccacccgaaagaacgtaaacccaaaccgggtaccaaaagtaactttaccgtaaccgttagtttaacttaggaacctaaaattcgaaacacggtaccggttaggaacgggacggggacgaacggaacccggtacggtccgttagtattaggtgttggccgaaggtagagtagagttaacgtaacgacttccgttaagaacgttagaacggtaggttggttagtgttaagtttgg

SEQ ID NO: 371055 - DNA, 747 bp, Homo sapiens
  misc_feature: GZ8MTXP01DFJYV.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtcagtgtgaggtgcacttggtggagtcgtggggggaggcttggtccaggccggggggggtccctggagactctcctgtgcagtctctggattcaccttagaagtattggatgacctgggtccgccgaggctacgaggggaagggctggagtgggtggaccaaacaataaaacgaaaagaacggaaagtacaaaaggtaaaaaaaccctagtagttacggggaacccttacgttagggttacggaacccgggggtacccgtaaagtttacccaaacccgtaaacttcctaccccgaaaggaaacgaaaccaaaaccggaacccaaaagtaaactttacaaaccttagttaattttacggaaacaaaactaaacgtaaacgaaacggacggtaggaagggaacgggaacgggaacgggaacggaccggtaccggttaacggtttaagtttagtttacggtacggtacggtaacggtaagttaagtaaggttaagttaaacgttaacgttaacgttacgttaacgtaaggtaaggtaaggtagggttaggttagttaagttaagttaag

SEQ ID NO: 371056 - DNA, 693 bp, Homo sapiens
  misc_feature: GZ8MTXP01CLC8J.15.67.G01.1.454.CMB.2.raw
  modified_base (313)..(313): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggtcgttggtccgagggcccggggggtccctgacgtactctccgtgtgctagtctcgtggtattcacccttagaagtatggatgaccgtgggtccnccgaggcctcgaggggagggcgtgggaggtgggtcgaccaaacgaaataaaacgaaagaacggaaagtacgaaaagtaaaaaacccgtataggtaggtacctcgtaaggtacgaaccggcgtaacttaccgaacccactacctaccgaagaacgaaccgaacgaccaaagtaacttactacgttagttaattagaactaaaagtacgaaacgtacgaccggtaggaacggaacgggacggaaacgggaaccgtaccgggtaccggttaagttaagtttaagttcggtaggaccggtaaggtaagagttagaagttaaagtaacgttaacgttcgttaacgtaaggtaagcgtaagggttggttagtcgttaagtttaagg

SEQ ID NO: 371057 - DNA, 634 bp, Homo sapiens
  misc_feature: GZ8MTXP01DG8G8.15.67.G01.1.454.CMB.2.raw
  modified_base (556)..(556): a, c, t, g, unknown or other
tcagtctacgtagccacgaccggtgctcgatttagagtatacatattgggtttgaggtctcagagaggagccttagccctggactccaaggccctttccacttggtgatcagcactgagcacagaggactcaccatggagttggggctgagctgggttttccttgttgttatttagaaggtgtccagtgtgaggtgcacgttggtggaggtcgtggggggaggcgttggtccgagggccggggggtccctgagactctcctgtgcagtctctggattcaccttagaagttatggatgactggtccgcaggctcgaggggagggctgggagtggggtcgaccaaacgaataaaacgaaaggaacggaaagtacaaaagtaaaaacctgtaggtaggactcgtaggtacgaacgggcgtacttcgaccatcctacgaagacaacaaacgaccaaagtaacttcaacttgttactttagaactaaagtacgaaacgacgccggtagaggaacgggacgaaggacgacgtccggtagttattagttgcggtcgcgtaagngtagaagttaaggtaacggttacttacttaacgtaaggtaaaggtggtaggggttagttacggtaagttcgtttaagg

SEQ ID NO: 371058 - DNA, 557 bp, Homo sapiens
  misc_feature: GZ8MTXP01EZYZG.15.67.G01.1.454.CMB.2.raw
  modified_base (306)..(306): a, c, t, g, unknown or other
  modified_base (342)..(342): a, c, t, g, unknown or other
  modified_base (375)..(375): a, c, t, g, unknown or other
  modified_base (413)..(413): a, c, t, g, unknown or other
  modified_base (418)..(418): a, c, t, g, unknown or other
  modified_base (440)..(440): a, c, t, g, unknown or other
  modified_base (466)..(466): a, c, t, g, unknown or other
  modified_base (497)..(497): a, c, t, g, unknown or other
  modified_base (501)..(501): a, c, t, g, unknown or other
  modified_base (505)..(505): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcttggtccgagggcccgggggggtccctggagactctcctgtgcagtctctggattcaccttagagtatggatgactgggtccncagctccgaggggaggctggagtgggtggaccaaanataaacgaaagacggaagtacaagaaaaacctntgtagactcgtaagtacgaacggccgattcaccattcncaganacacgaccaaagacttcacgtnttattgacaatgaacagccgtgaggnggcgaggaccgacggcgtagtattagttggngcgngagntagttagtagtacacgttcgttacgtaaggtgtgtaggtgttacgtgttgtg

SEQ ID NO: 371059 - DNA, 638 bp, Homo sapiens
  misc_feature: GZ8MTXP01BNYQ5.15.67.G01.1.454.CMB.2.raw
  modified_base (584)..(584): a, c, t, g, unknown or other
  modified_base (595)..(595): a, c, t, g, unknown or other
  modified_base (608)..(608): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacttggtggagtcgtgggggaggcgttggtccgaggccggggggtcctgagactctccgtgtgcagtctctggtacttcacccttagtaagttattggatcgaccgtggtcccgccgacggcctaccggaggggaaggggcgtggagggtggggtacggacccaaacaaagtaaaaaccgaaaaggaaaccgggaaagtaccgaaaagtaaaaaacccgtgttaggtacgggacttccgtagtacgaaccggccgtaacttccacccatctaccgaagacgaacaacgtaccaaagtaacttactaacttgttattagactaaatagaaacacgtcgagaggaggaccgagccgacggtcgtagttatattggcgcggaagaagttangttacgaagtnacgttcttaaggngtagcgtaagggttgttagtgttaagtttg

SEQ ID NO: 371060 - DNA, 651 bp, Homo sapiens
  misc_feature: GZ8MTXP01BLWC4.15.67.G01.1.454.CMB.2.raw
  modified_base (297)..(297): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcttgttgttattttagagtgtccagtgtgaggtgcacgttggtggagtcgtgggggagcgttggtccaggccggggggtcctgagactctcctgtgcagtctctggattcacctagagtatggatgaccgtgggtccncgaggctccgaggggaggctggagtggcgcaacataaacgaaagacggaaatcgaaagtaaaaacctgtagtaggactctaggtcgaacggcgtaattccaccagtctacgagaacgacaaccggtaccaaagaacttcaacttagttatttgaacctaaatagaaacgtacgccggtagaaggacggggacgaacggggaccgtaaacccggggtccgttagtaagttttaagttggttcccggagggtccggaaggttacgttacggttaaagtaaggtaacgaccgtttaccttaaccggaaggttaagccggtaggggtttagggttaagttcggttaagttttaacggg

SEQ ID NO: 371061 - DNA, 630 bp, Homo sapiens
  misc_feature: GZ8MTXP01ERXNB.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccagccggggggggtccctgagactctcctgtgcagtctctggattcacccttagaagtattggatgacctgggtccgccaggctccgaggggaaggggctgggagtgggtggccaacataaacaaagacggaagtcagaaaaacctatagtggactctagtgaacggccgattcacccatctccagacgacaacgccaacgaattcaacctagttatttagtacaaatagaaacgtaacgaccgtacggtaggaagggacggacggggaaccgacggggacccggttaggttagtttaattgggtttcgcgggtcggaggttagtagttagtaggttaaggaacttcccgttaacgtaaggtaagtaaccggtagggtacggggttagttggttaacgttgg

SEQ ID NO: 371062 - DNA, 610 bp, Homo sapiens
  misc_feature: GZ8MTXP01DQ3PJ.15.67.G01.1.454.CMB.2.raw
  modified_base (418)..(418): a, c, t, g, unknown or other
  modified_base (536)..(536): a, c, t, g, unknown or other
  modified_base (586)..(586): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtgggggaggcttgggtccgagggcccgggggggtccctggagactctcctgtgcagtctctggattctaccttagaagttatggatcgacctgggtccgcaggctccggaggggagggctgggagtggggcgacaacaagtaaaacgaaagacggaatacaaagtaaaacctgtagtggactcgtgtagaaccggcgattccacnttcacagacaacacgtacaagtaattcaacttgttatttacgactaaatggaaacacggaccgtaggaaggacgggacggacggaccgacggtaccgttagttaagtttatggtcggnggtaacgaggttatggagtttaagtacgttacttcgttagaaggttacgngtagggtagttatcgttgtttaag

SEQ ID NO: 371063 - DNA, 759 bp, Homo sapiens
  misc_feature: GZ8MTXP01BICHR.15.67.G01.1.454.CMB.2.raw
  modified_base (302)..(302): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggcccgggggggtccctggagactctcctgtgcagtctctggattcaccttagagtatggatgacctgggtccnccgaggctccgagggggagggcgtgggaggtggggtcggaccaaacaataaaacgaaaggacggaaagtacgaaagaaaaaaccctgtaggtaggaaccttcgtaagggtacggaaccgggcccgtaaacttacccaaccctattaccctaccgaaagaacgaaccgaaaccgtaccgaaaaggtaacttaccgtaaccgttaggtttaattttacgggaaacctaaaagttaacggaaacgtacggtacccgggttaagggaaaggggtaacggggaccgggaaacgggaaaccccggtaccggggttacccgggtaggtttaaccgtttaggtttaacgggttcgacccgggaacggttaagagttaggttaacgtaaaggtacggttaaccttcttaaaccggtaagttacggaacgggtaagggttgggttaaccgttgggttaacgtttggg

SEQ ID NO: 371064 - DNA, 638 bp, Homo sapiens
  misc_feature: GZ8MTXP01DQTYL.15.67.G01.1.454.CMB.2.raw
  modified_base (307)..(307): a, c, t, g, unknown or other
  modified_base (614)..(614): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggaggtcgtgggggaggcgttggtccgaggcccgggggggtccctgagactctcctgtgcagtctctggattcacccttagaagtatggatgactgggtccnccgaggctccgaggggaagggcgtgggagtgggtggaccaacaagtaaaacaaaggaacggaaagtacaaagaaaaaacctagtaggtaggtacctacgtagttaggaaccggccgtaattaccacccatcctccaagaacgaacaaccgacccaaagtaacttacaacttagttaactttgaaacctaaaagtagaaacgtacgaccgtaaggaagggaacggaccgggaaggaccgacgggccgttagtattagttgtggcgaagagttagtagttaagtagtagaacttcaacgaaggtaacgngtagggtgttatggttaagtttgg

SEQ ID NO: 371065 - DNA, 658 bp, Homo sapiens
  misc_feature: GZ8MTXP01BP2NG.15.67.G01.1.454.CMB.2.raw
  modified_base (305)..(305): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgagggccgggggggtccctgagactctcctgtgcagtctctggattcaccttagaagtattggatgacctgggtccnccaggctccgaggggaaggggctgggaggtgggtggacccaaacaataaaacgaaaggaacggaaagtacgaaagaaaaaaccctgtagtaggactcgtaggtacggaaccgggccgaatttcccacctatcctacaagacgacaaccgacccaaagaattcaacttgttaatttgaacaaatcgaaacacgccgttaggaaggacgggacggaagggaccgacgggtcccgttaggttatttagttcgggtagcggaacggtaagagttaggttaattaagtttaacggacctttcgttaacgtaagggttaggccgtaaggggtttggttaagttcggttaagttttcggg

SEQ ID NO: 371066 - DNA, 733 bp, Homo sapiens
  misc_feature: GZ8MTXP01B7SMG.15.67.G01.1.454.CMB.2.raw
  modified_base (327)..(327): a, c, t, g, unknown or other
  modified_base (714)..(714): a, c, t, g, unknown or other
tcagtctacgtagccacgaccggtgctcgatttagagtatacatattgggtttggggtctcagagaggagccttagccctggactccaaggcctttccacttggtgatcagcactgagcacagaggactcaccatggagttggggctgagtcttgggttttccttgttgttattttagaaggtgtcagtgtgaggtgcacgttggtggagtcgtggggggaggcgttgggtccgagggcccgggggggtccctgagaccttctccttggtgctagttctcgtggtattccaaccgttagaagttagtggatgtacctggggtacccnccgtaggcctccggagggggtaacggggcgtaggggacggtggggtacggacccaaacgtaagtaaaaaccgaaaggacggaaacgtaaccgaaagaaaaaccttgtacggtggaccttacgtaggtaacggaaccggtccgaatttaccaaccctatcctaaccgaagaacgaaccctaacgaccaaagtacttaccataggtttactttagacgtaaactacgaaacgacgtaccgttaggggaacggaacggggccgggaaacgggaacccggtaccgggtaccggttagtttaaacgtttacgttgggtaccggccgagggtaataagttggtaaagttaccggtaagtacccgttagttccgaagtcgaggtaagggttagnttagccgttaaggtttaag

SEQ ID NO: 371067 - DNA, 535 bp, Homo sapiens
  misc_feature: GZ8MTXP01A28CW.15.67.G01.1.454.CMB.2.raw
  modified_base (497)..(497): a, c, t, g, unknown or other
  modified_base (514)..(514): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggccgggggggtccctgagactctcctgtgcagtctctggattcacccttagaagtattggatgacctgggtccgccaggctccaggggaaggggctggagtgggtggccaacataaacaaagacggaagtacagaaaaacctatgtggactctgtgaacgccgattccaccatctcagagacaacgccaagaattcactgtatttgacaaatgaaacagaccgtgagaggcgaggacacggccgtagtattagtgtgcgcgagntgagtagtagacttcanaagtagcagggtgatggaatg

SEQ ID NO: 371068 - DNA, 688 bp, Homo sapiens
  misc_feature: GZ8MTXP01CEPN3.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatgggagttggggctgagcttgggtttttccttgttgtttattttagaaggtgtccagtgtgaggtgctacgttggtggagtcggtgggggaggctttggtccgagggcccggggggtccctggagactctcctgtgcagtctcgtggtacttctacccgttagtaagttgtggattgaccgttcgggtccccgccgaggccgtaccgagggggaagggcgtgggaggtgggtcggacccaaacgaaactaaaacgaaaggacggtaaagtacgaaagtaaaaaacccgtgtaggtggtaacctcggtaagtacggaaccggccgtaacttacacctactccaccgaagacgaaccgaaacgacccaaagtaacttcgtaacttaggttatttacgaactaaagttacgaacacgtaccggtaggaacggacgggtaccgaagggacccgtacgggccgttagttagttagttggacgcgtaacgtagagtagaagtagtacggttacttcttacgtaaggtaggtaagtagggttgttaacgtgttaagtttgg

SEQ ID NO: 371069 - DNA, 710 bp, Homo sapiens
  misc_feature: GZ8MTXP01ELJKU.15.67.G01.1.454.CMB.2.raw
  modified_base (691)..(691): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggagcgttggtccaggccgggggggtccctgagctctcctgtgcagtctcgtggtacttcaccttagaagttatggatgacccgttgggtcccgccgaggcctaccggagggggagggtcgtgggtacggtggggtcggacaaacaagtaaaacgaaaacggaccggaaagtacaaaaggtaaaaaaccctgtggtacggaacttccgtaagggacgggtaacccgggtaccctactttacccaacccgtaattcccgaaccgaagaaccggaaccaaacgaccaaagtaacttaccaacgttagtttaattacggaaccttaaaatgaaaaccacggttaccgtagggacggaacggggacgagggaacccgtacgggtccgtttagttacgttagtttcggcgccggtaaggaattgtaggaagtttaaaggacggaaccttcaacggaaggttaccgaagttaagggggtnttagttgttaacgttttgg

SEQ ID NO: 371070 - DNA, 668 bp, Homo sapiens
  misc_feature: GZ8MTXP01CZJ2X.15.67.G01.1.454.CMB.2.raw
  modified_base (294)..(294): a, c, t, g, unknown or other
  modified_base (315)..(315): a, c, t, g, unknown or other
  modified_base (398)..(398): a, c, t, g, unknown or other
  modified_base (598)..(598): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtccagtgtgaggtgcacgttggtggaggtcgtggggggaggcttgggtccgagggcccgggggggtccctgagactctcctgtgcagtctctggattccacccttagaagttnttggatcgaccgtgggtcccncgaggctaccgagggggagggcgtggggaggtgggtaggaccaaacaagtaaaacaaaggtacggaagtacaaagaaaacctntaggtcggtactcgtaaggtacgaacgggacctattacccacctagttccaccgaagacgaaccgtaacggaccctaagtaacttctaacgttagtttaattcgaaacttaaagcgaaacacgtccggtaaggacgggacggggaccgagggttacccgacggggtcctttaaggtaatttcggtagtcgaccgggtaanaagagtacgttaagtaagtacgttacgttcgttacgtaaggtacgtcggtagggtcgttatggttcgttg

SEQ ID NO: 371071 - DNA, 570 bp, Homo sapiens
  misc_feature: GZ8MTXP01DH1SN.15.67.G01.1.454.CMB.2.raw
  modified_base (382)..(382): a, c, t, g, unknown or other
  modified_base (509)..(509): a, c, t, g, unknown or other
  modified_base (518)..(518): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggaggtcgtggggggaggcttgggtccgaggcccgggggggtccctgagactctcctgtgcagtctctggattcacccttagaagtattggatgacctgggtccgccaggctccgaggggaagggctgggagtgggtggccaacaataaacaaagacggaaagtcaagaaaaaacctntagtggactcgtagtgaacggcgattccaccatctcagacgacaacgaccaagaacttacacttagttatttcgacaaatgaaacagccgtagaggaggcgaggacgacggccgtagtattagttgngcgcgaagngtgagtaggtagacttcttaacaaggtagcgtagggtggttatgaacgtttg

SEQ ID NO: 371072 - DNA, 976 bp, Homo sapiens
  misc_feature: GZ8MTXP01EV6QB.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcacatggagttgggctgagtcgttgggttttccttgttgtttattttagaaggtgtcagtgtgaggtgctagttggtggtagtcggtgggggaggtcgtttcgggtccgacggggtcccgggggggttccctggacgtaccttcctccgtgtcgctaggttcctcgtaggtacttacctaacccgtttaagtaagttagttaggacgttcggaaccggttcgggtcccgaccgacggccgtacccgggaaagggggtaacgggtcgtaggggaggtagggggtacggaaccaaaacgaaagtaaaaaaccgaaaaggtaaaccggaaaagttaaaccgaaaaagttaaaaaaaccccgtaggttacggtaacgggtaacctttacccggttaaagggttaaccgggaaacccggggttcccgtaaacgttttaccccgaaaccccttaaactttaccccgtaaaccgaaaacggaaaccgaaacccgttaaaaccccggaaacccgtaaaaaagttaaacgttaaccttaaaccggtttaacgttttaaacttttaaggaaaaacctaaaacgtaaagtaaacgtaaaccggacccggggttaacgggtaaacggggtaaagggaacggggaaaccggggaaacccggtaacccgggttaacccgggtttacggtttaaacgttttaagtttacgggttagggtaaccgggtaacgggaaggttaaaggttaaacgttaaacggttaaacggttaaagggttaacccgttacccgttaaacggtaacgggtaacggttaacgggttaaggggttaagggttaaggttaaggtttaacgttttaaggg

SEQ ID NO: 371073 - DNA, 756 bp, Homo sapiens
  misc_feature: GZ8MTXP01EUFZC.15.67.G01.1.454.CMB.2.raw
  modified_base (677)..(677): a, c, t, g, unknown or other
  modified_base (727)..(727): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcacatggagttgggctgagcgttggttttcttgttgttatttagaaggtgtccagtgtgaggtgctacgttggtggagtcggtgggggaggtcgttggtccgacgggtcccggggggtccctgacgaccttctccgtgtcgctagtcttcgtggtacttaccgtaaccctttaagaaagttagttggacttcggtacccgttcggggtccccgccgacgggtcccgtacccggaaaggggggtaacggggtcggtaggggacgggttgggggtacggacccctaaaacgaaagtaaaaaaccgaaaaggaacggaaagtaaacgaaaagaaaaaacccgttgtaggtacggaccttcggtaggtaacggaaccggtccgtaattacccgacctatccgtaaccgaagaacgaacaaaccgaccaaagtacgttactaacgttagtttaagtttacgaataaaacgtacgaaacgtacgtaccgtagggaacggaccgggacggtaaaggaccgaaccggttcgttagtttagtttagtgggtcgcggngaagttataggttaaagttagtaacgttaccgttacttacggtaagtagnggttaaggtggttaactggttaattccgg

SEQ ID NO: 371074 - DNA, 736 bp, Homo sapiens
  misc_feature: GZ8MTXP01AJ3Q0.15.67.G01.1.454.CMB.2.raw
  modified_base (341)..(341): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagtcttgggttttccttgttgtttattttagaaggtgtccagtgtgaggtgctacgttggtggaggtcggtggggggaggtcgttgggtccgacggggtccgggggggtccctggacgtacctcctccgtgtcgctagtctcgtggtacttcctaacccgttagtaagttatggatcggtaccgtcgggtccnccgaggctccggaagggggacgggcgtgggaggtgggggtacgaccgaaacaaagtaaaacgaaaaggacggtaaagtaacgaaacgtaaaaaaccttgtaggtcgtactctaagggtacggaaccggccgtaattccacctatccacaagacgaacaacgacaaagtacttactacgtaggttacttagaactaaaactaggaaaccacgtaccgggtaggaagggacgggtacggaacgggtacccgaccgggtaccgttaaggtttacgttaagttcggtacgggccggtaagaaggttacgttaggaaacgttaacgggtaacttaacgttcttaaccggtaaggtacggtaacggttaaggggttagggttaatcgggttaacgtttggg

SEQ ID NO: 371075 - DNA, 780 bp, Homo sapiens
  misc_feature: GZ8MTXP01DKXZM.15.67.G01.1.454.CMB.2.raw
  modified_base (306)..(306): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggtttttccttgttgtttattttagaaggtgtccagtgtggaggtgctacgttgggtggaggtcggtggggggaggtcgttgggtccgagggcccggggggtcctgacgactcctctgtgctagtctgtggtacttctaccttaagtaagtntggatgaccgtcgggtccgccgaggctaccggaggggaagggcgtgggaggtgggtacggacaaactaaactaaaacgaaagaacggaaagtacgaaagtaaaaaaccgtagtaggtacggtacctgttaacggtacgggaaccggcccgtaactttacccaaccctactaccttacccgaaaggaaccaaaccgaaaaccggaaccctaaagtaaactttccgaaagtttacggtttaatttaaacggaaacctaaaaagttacggaaaacgtaaccggtaccgggttaaggggaacgggaaacggggttaaccggaaacggggttacccggaccgggttacccggttagtttaacgtttaagtttcggacggaggtaaccggaaagttagtagttaagtaaaccgggttgttacccttagttaaggaagtaaaggtcggtaaggttgggttaaatggttaaccgttttaagg

SEQ ID NO: 371076 - DNA, 650 bp, Homo sapiens
  misc_feature: GZ8MTXP01DFOVV.15.67.G01.1.454.CMB.2.raw
  modified_base (629)..(629): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgtttattttagaaggtgtccagtgtgaggtgcacttgggtgggaggtcgtggggggaggcgtttgggtccgagggcccgggggggtccctggagactctcctgtgcagtctctggattcacccttagaagtattggatgacctggtccgccaggctcgaggggagggcgtggagtgggtggaccaacaagtaaaacgaaaggacgggaaagtacgaacgtaaaaaacctagtaggtggaccttcgtaggtacgggaacggcccgtaacgtttccaaccactacctaccaaggaacgaaacaaaccgaccgaaagtaaacttacaactttggttaattttacgactaaaatagaaactagacccgttaggaaggacgggacggaaggaccgtaccggccggttagtaatttagttagtaggccggaagtagatacggataggtagacttcttaagaagtacgngtagggtgttatgaagtttgg

SEQ ID NO: 371077 - DNA, 755 bp, Homo sapiens
  misc_feature: GZ8MTXP01CRNMF.15.67.G01.1.454.CMB.2.raw
  modified_base (724)..(724): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcgttgggtttttccttgtttgtttattttagaaggtgtccagtgtgaggtgctacgttggtggaggtcggtggggggaggtcgtttgggtcccgagggcccgggggggttccctgacgtactctcctgtgctagtctcgtggattccaccgttagtagttagttaggatcgaccgttgggtcccgaccgaggccgtaccggaagggggacggggtcgtggggaggttcgggggtacggacccaaaacgtaaagtaaaaaaccgaaaggtaaccgggaaaacttcgaaaaagtaaaaaaccccttgtaggtaggtaacctccgtaaggttacgaaccgggtccctaacgttcccaactacgtcctaccgaaagacgaaccaaaccggacctaaagacttaccaacgtttggttattacggaactaaagtacgaaacgtcgaccggtaggaaacgggacgggaccggaagggaacccgtaccgggtacccggttagtttacgttaagtttgggtacgccggtaacggaagttagtagttaagttaccggtaattaccgttcttaacgaaggttacgnggttaaggggtgttagttcgttaagttttcg

SEQ ID NO: 371078 - DNA, 777 bp, Homo sapiens
  misc_feature: GZ8MTXP01BPIUP.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcacatggagttggggctgagtcgttgggttttcttgttgttatttagaaggtgtcagtgtgaggtgctacgttggtggaggttcggtggggggaggtcgttgggtccgaggggccggggggtccctggacgtctctctgtgctagtctcgtggtacttccacccttaagtaagttagtggatcgaccgtgggtcccgccagggtcctaccggagggggacgggcgtggaggtgggtcgaccaaacaaagtaaaaacgaaaggaacggaaatacgaaaagaaaaacccttgtggtaggacctgtaaggtacggaaccggtcgtaacttaccgaacctacttcctacgaagaacgtaacgaaaccgaaccgtaaagtaacttactaacgttagtttaactttaagaacctaaaagttacgaaacgtaggacccggttaggaaacggggaacgggacgggaaacggggaacccgtaccgggggtacccgtttaaggtttaacgttttaaaggttcgggttaggcccggtaagggtaaggttaagttacgggttaaacgttagggggttaaacttaccgttaccttaacggtaaccggggttacgggtaacggttaagggggttagggtttattcgggttaagtttttcggg

SEQ ID NO: 371079 - DNA, 732 bp, Homo sapiens
  misc_feature: GZ8MTXP01DKBQQ.15.67.G01.1.454.CMB.2.raw
  modified_base (323)..(323): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttccttgttgttatttagaaggtgtccagtgtgaggtgctacgttggtggagtcggtgggggagtcgttcggtccgagggcccggggggtccctgacgactctccgtgtgcagtctcgtggtcttcctacccttaagtaagttagtggatcgaccgtcgggtcccncgaggcgtaccggaggggacgggcgtgggagtgggtacgaccaaacaaagtaaaacgaaaggacggaaagacaaagaaaaacctgtagtaggactcgtacggtaggaacccggtacgtacttaccgacctactcctaccgaacgaacgaaaccgaaaccgacccgaaaagttaacttaccgtaacctttagtttaatttacggaactaaaaacgtaggaaaaccgtacgtaccggggtaagggaaacgggaacggggtacggaacgggtaaccggtaccgggtaccgtttagggttaactttaaggttgtcggcggaagggtagttaaggttagttaaagttaacgtaacgttaccgttacgttaaccgtaaggtacgtcggtaggggttgttaggtcgttaagtttgg

SEQ ID NO: 371080 - DNA, 1040 bp, Homo sapiens
  misc_feature: GZ8MTXP01BWZAO.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgctacgttggtggagttcgtggggggaggtcgtttgggtcccgaggggcccgggggggtccctggacgaccttctcctgtgcagttctcgtggtacttcctaacccttaggaagttagttgggaattcggaacccgttcgggggtaccccgcccgtaacggggtccctaccccggaaaggggggggtaaacgggggtcgttacgggggtaagggttacggggggtacggggaacccctaaaaaacgtaaagttaaaaaaacccggaaaaagggaaaccgggggtaaaacgttaaaccgtaaaaacggtaaaaaaaaacccctttaggttaggggttaccggggaaaccctttccggtttaacggggttaaaccgggaaccccgggggtacccgtaaaccttttaccccggaaaacccctaaacgttccccggttaaacccgaaaacggggtaaaccgtaaaaccccgaaaacccgggacccctaaaaaagggttaaaccgttttaccctaaaaccgttttagggtttaaaattttccgggaaacttaaaaaagttaacgggaaaaccgtaaccgggtacccggggttaaaggggtaaacggggtaacggggaaccgggtaaaccgggggtaaacccggacccgggggtttaacccggttttaaggttttaacgttttaaggttttcgggtaccggtccgggaacgggtaaaggttaaaggttaggttaaacggttaaacgggtaacggttaaccgtttacccggttaaaacgttaacggggttaaacgggtaacgttaaaggggggttacggtttaaaggttcgtttaaggtttttaacccggg

SEQ ID NO: 371081 - DNA, 666 bp, Homo sapiens
  misc_feature: GZ8MTXP01AJLQS.15.67.G01.1.454.CMB.2.raw
  modified_base (603)..(603): a, c, t, g, unknown or other
  modified_base (606)..(606): a, c, t, g, unknown or other
  modified_base (610)..(610): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgtttgttattttagaaggtgtccagtgtgaggtgcacgttggtggaggttcgtggggggaggtcgtttgggtcccgacgggcccgggggggttccctggacgaccttcctccgtggtgctagtctctggtacttctacccttagaagttattggatgaccgtgggtccgccaggctccggaggggaacggggcgtggggaggtgggtcggaccaaacaataaaacgaaaggacggaaagtcaaagtaaaaaccctataggtacgacttacgtaggttacggaaccgggccgtaactttccgaccctactactacccgaaagaacgaacccaaaccggacctaaaggtaactttacaacgttgttaatttacgacaaactagaaacagaccggtaggacgaggacgaggacgacggcgttagttacttgttacgtgacgnganagtnaagtagtacgacgttacttacgaagtacgcgtagggtggttatcggttaagtttcg

SEQ ID NO: 371082 - DNA, 604 bp, Homo sapiens
  misc_feature: GZ8MTXP01CAJAJ.15.67.G01.1.454.CMB.2.raw
  modified_base (546)..(546): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaggtgtccagtgtgaggtgcacttggtggagtcgtgggggaggtcttggtccgagggcccggggggtccctgagactctctgtgcagtctctggattcacccttagagtatggatgaccgtgggtccgccgaggctccgaggggaaggggctgggagtggggtggaccaaacaataaaacaaaggaacggaagtacaagaaaaacctagtagtggactcgtgtacgaacggctattcacccatcctacagacgaacaaccgacaaacgtaattacacttagttatttagacaaattacgaaacacgccgtaggacggagggacggaacggaccgacgggtaccgttgttagttagttggtcggcgtaacgngttagtgagttaagtacgacttcttacgaagtagcgtagggtaggttagtgaagtttg

SEQ ID NO: 371083 - DNA, 619 bp, Homo sapiens
  misc_feature: GZ8MTXP01CP8HB.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttttagaaggtgtccagtgtgaggtgcacttggtggagtctgggggaggcttggtccagccgggggggtccctgagactctcctgtgcagtctctggattcaccttagaagtattggatgacctgggtccgccaggctccagggaaggggctggagtgggtggcccaaacaataaaacaaaagacggaaagtacaagaaaaaaaccctatagtggaactctagttacgaacggcccgtaattcaacccatactcccaaagagaacaaacggacccaaagaaactttacaacttaggttaatttagacaaaacttaaacgaaacaacgaccgtgaggaggacggaggacgacggaccgtacgtagttagttagtgcggcgagagtagttagtaaagtaagacgttcttacgtaaggtaagaacgtagggtagggttagtaagttaagtg

SEQ ID NO: 371084 - DNA, 720 bp, Homo sapiens
  misc_feature: GZ8MTXP01C1QH3.15.67.G01.1.454.CMB.2.raw
  modified_base (302)..(302): a, c, t, g, unknown or other
  modified_base (628)..(628): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgttgggttttccttgttgttattttagaaggtgtccagtgtgaggtgctacgttggtggaggtcgtggggggaggcgtttggtccgagggcccgggggggtccctggacgtacttctcctgtgcagtctcgtggattcacccttagaagtnttggatcgaccgtgggtccgcgaggcctccgagggggaacgggcgtgggaggtgggggtcggaccaaacgaaataaaacgaaaaggacggaaagtcaaagaaaaaccgtagtagtgtactcgtaagttacgaacggtccgtacttacccgaccaactctacgaacgaacgaacgaaaccggacccaaagtaaactttccaaacgtttagttaacttttacggaaacctaaaagttacgaaaaccgacgtacccgggttagggaaggggacgggacgggtaacgggaccgacccgggtacgtttagttaagttagttggtggccggnggaagttagtcgaagttaaaggtaccgttaagttacccgttaagtaaggttaggaaccgtaagggttaggttagtaagggttaaccgtttgg

SEQ ID NO: 371085 - DNA, 689 bp, Homo sapiens
  misc_feature: GZ8MTXP01DMR4C.15.67.G01.1.454.CMB.2.raw
  modified_base (658)..(658): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttccttgttgttattttagaaggtgtccagtgtgaggtgcacgttggtggaggtcgtgggggaggtcgttggtccgagggcccggggggtcctgagactctcctgtgctagtctctggtattcacccttagaagttattggatgaccgtcgggtccgccgaggcctccgagggggaaggggcgtgggaggttggggtcggaccaaacgaaataaaacgaaaaggaacggaaagtacaaagaaaaaacctgtagtacggactcgtagggttacgaaccgggtcctaactttaccaaccctattcctacccgaaagacgaacaaaccgacaaagaatttaccaagttagttatttagacctaaaagtacgaaacgagcccgttaggaacggagggaaccgggaacggtaaccgacgggtaccgttagttaattagttcggtcggccgaaggaagttagtagttaaaccgttaaggtacgacccttagttaaccgaaggttagngtaagggttaggttattggttaacgttttgg

SEQ ID NO: 371086 - DNA, 629 bp, Homo sapiens
  misc_feature: GZ8MTXP01EGZ91.15.67.G01.1.454.CMB.2.raw
  modified_base (266)..(266): a, c, t, g, unknown or other
  modified_base (322)..(322): a, c, t, g, unknown or other
  modified_base (342)..(342): a, c, t, g, unknown or other
  modified_base (490)..(490): a, c, t, g, unknown or other
  modified_base (556)..(556): a, c, t, g, unknown or other
  modified_base (558)..(558): a, c, t, g, unknown or other
tcagtctacgtagccacgaccggtgctcgatttagagtatacatattgggttttgaggtctcagagaggagccttagccctggactccaaggccctttccacttggtgatcagcactgagcacagaggactcaccatggagttggggctgagcttgggttttccttgttgttattttagaggtgtccagtgtgaggtgctacgttggtggtagtcgtgggggagtcgttggtccgagggcccggggggtcctgagactctcctgtnctagtctctggtacttccaccgttaagaagttatagggatcggaccgtgggtcccncgagcctacggaggggaggngtgggaggtcgggtagacaaaacaagtaaaaacgaaagacggaaagtacaaaaggaaaaactgtagtcggactcgagtacgaacggtctattacacatccaccgaagacgtaacaacgtaccaaataattccaattgtttaaattaanaactaaagtaagaacacgacggtagaaggacggacggacgacgacgtacgtagttagttagtgtgngngtaagttagtagttagtaagtaagttacgttacttactaagtagtaagtaggtaggttagtaagttgtaag

SEQ ID NO: 371087 - DNA, 625 bp, Homo sapiens
  misc_feature: GZ8MTXP01BJZC4.15.67.G01.1.454.CMB.2.raw
  modified_base (301)..(301): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccgggggggtccctgagactctcctgtgcagtctctggattcaccttagaagtatggatgacctgggtccncaggctccgaggggagggctgggaggtgggtggacaacaataaaacaaagacggaaagtacaaaggaaaaactgtagtggactcgtagtagaacggcgtaattccaccgatccacgagacgacaacgaccaaagtaattcacgttattaacgtttgaactaaacgtcaaacgtacgtaccggtaggaacgggacgggaacggaacggaccgacgggtaccgttagttaacgtttagtcgttacggcgaacggaagttagtgaagttaaggtacgttaacttcgttaacgaagttacgcgttagggtgttacgtgttaagtttgg

SEQ ID NO: 371088 - DNA, 777 bp, Homo sapiens
  misc_feature: GZ8MTXP01B5XWF.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccagggcccgggggggtccctggagactctcctgtgcagtctctggtacttccaccttagaagttatggatcgaccgtgggtcccgccgaggctaccggagggggaacgggtcgtagggaggtggggtacggaccaaaacgaagtaaaacgaaaggacggaaagtacgaaagtaaaaaccctagtaggtcggtactcgtaaggtacggaaccggcccgtaattacccgacctactcctaccgaacggaacgtaaccaaaccggacctaaaggtaaacttaccgaacgtttaggttaactttacggaactaaaacgttaacgaaacgtacgtacccggggtaggaacggggacgggaccgggaaacgggaaccgacccggggttacccgttagtttaacgtttagtttgggacggtccggtaaccgggtaaagttacggttaaggaacgttaaaggtaacggttaaccctttaacggttaaaccgttaaggggtaacggtaaccgggttaagggggttggtttaaacggtaaggttaaccgtttttaaggg

SEQ ID NO: 371089 - DNA, 659 bp, Homo sapiens
  misc_feature: GZ8MTXP01B2R9S.15.67.G01.1.454.CMB.2.raw
  modified_base (312)..(312): a, c, t, g, unknown or other
  modified_base (358)..(358): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacgttggtggagtcgtgggggagcgttggtccgaggcccgggggggtccctggacgactctcctgtgcagtctcgtggtattctacccttagaagttgtggatgaccgtgggtccncctaggctaccggaggggaagggcgtggaggttgggcgacctaaanaataaaacgaaagacggaaatacgaaacgtaaaaaactgtaggtaggtaccctgtaagtacggaaccgggctaattcccaaaccgtcttccacaagacaacgaaccggacaaagtaacttcgtaacttagttatttcgaaactaaacgtaacgaacgtacgacgggaggaacggaacgggacggacggaccggtaccggtacggttacgttagttagttacgtacgcgaagagagtagttagtaacgtacgttacgttacgttacgtaagtagtaacggtaggtagttagtaagttgtaag

SEQ ID NO: 371090 - DNA, 770 bp, Homo sapiens
  misc_feature: GZ8MTXP01EA9LN.15.67.G01.1.454.CMB.2.raw
  modified_base (579)..(579): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcacatggaggttgggctgagtcgttgggttttcttgtttgtttatttagaaggtgtcagtgtggaggtgctacgttggtggtaggtcggtggggggaggtcgtttcgggtccgacgggggcccgggggggttccctggacgtacttctcctgtgctagtcttcgtggtacttcctaccttaagtaagttattggatcgtaccgtcggtccgccgacgggctaccggagggggacgggtcgtgggaggtgggtcgtaccaaacgtaaataaaacgaaaggaacggaaagtaacaaagtaaaaaaccgtgtagtacggacttacgtagggtaacggtaaccgggaccgtaactttaccacctaacgtccctaccgaaacggaacgaaccgaaaccggaaccctaaagtaacctttacgtaaactttagtttaagttacgtaacaaaacgtanaaacgacgtaccggtaggaggacgggacggacggacgaacggttcggtagtttagttagttggtcggacggtaacgtaggacgtttacggttaaagttaaggtaacggttaacccttacgttaaacgtaaaggggttacggtaacgggttaagggggttaggttaggttaaccggttaagggtttttaagg

SEQ ID NO: 371091 - DNA, 604 bp, Homo sapiens
  misc_feature: GZ8MTXP01DZMAZ.15.67.G01.1.454.CMB.2.raw
  modified_base (543)..(543): a, c, t, g, unknown or other
  modified_base (545)..(545): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcttggtccgaggcccgggggggtccctgagactctcctgtgcagtctctggattcacccttagagtatggatgaccgtgggtccgccaggctccgaggggagggctgggagtgggtggaccaacaataaaacgaaagacggaaagtacgaagaaaaaaccctgtaggtggactccgtagtacgaacggccgtattaccaccatacctccgaagacgaacaaaccggacccaaagtaattacgaacttgttaatttgacaaaatacgaaacacgccggtagaggaagggacgaaggacgacggcgtagttattagtgtgcgngngagtgaagtagtagttaacttcttagaagtagtcgtaagggtggttaattgaacgtttg

SEQ ID NO: 371092 - DNA, 661 bp, Homo sapiens
  misc_feature: GZ8MTXP01ELZEI.15.67.G01.1.454.CMB.2.raw
  modified_base (311)..(311): a, c, t, g, unknown or other
  modified_base (404)..(404): a, c, t, g, unknown or other
  modified_base (629)..(629): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacgttggtggagtcgtgggggagcgttcggtccgaggcccgggggggtccctgacgactctcctgtgcagtctctggtacttcaccgttagtaagtattggatgacctgggtccnccgaggcctccgaggggaagggcgtgggaggtgggtcggaccaaacgaaataaaacgaaaaggaacggaaagtacgaaaagtaaaaaaccctntaggtagtacctcgtaaggttacgaaccgggtccaagttccaaccgattccgaccaagacgaaccaaacggaccaaagtaacttctaacttaggtttaactttgaaactaaatacgaaacgacgtaccggtaggaagggacggacggaacgggacgaccgggtaccggtttagttaagtttacgttggtacggcgcgaagttagtaggaacgtaagtacgacttnacgaagtagcgtagggtgttatgttaacgttg

SEQ ID NO: 371093 - DNA, 698 bp, Homo sapiens
  misc_feature: GZ8MTXP01CY3ZK.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgagtgcacgttggtggagtcgtgggggagtcgttgggtccgagggcccggggggtccctgagtactctccgtgtcgcagtctcgtggacttccacccttagtaagtagttaggatcgaccgtgggtcccgccgaggcctccggaagggggaacggggtctgggaggtgggtcgaccgaaacaataaaacgaaaggacggaaagtcaaaaggtaaaaaaccctgtaggtgtactcgtaggtacggaaccggccgtaattccaaccgtatccctacgaacgacgaaccgaaaccgacgaaacgtaattaccaagttacgttattttacgaaccttaaagtagaaacgtacgacccgggttagaagggaacgggacggaacggaaccgacggtaccggttagttaacgtttagtttaggcggcgtaacgtaaggattaggttaagtaaacggtcgaacttccgttaacgtaagtagtaaccggtagggtgttaagtgttaacgttttcgg

SEQ ID NO: 371094 - DNA, 630 bp, Homo sapiens
  misc_feature: GZ8MTXP01BUIXA.15.67.G01.1.454.CMB.2.raw
  modified_base (316)..(316): a, c, t, g, unknown or other
  modified_base (565)..(565): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttccttgttgttattttagaaggtgtccagtgtgaggtgctacgttggtggagtcgtgggggaggtcgttggtccgagggccggggggtccctggacgactctcctgtgcagtctcgtggtacttcaccttagtaagttatggatgaccgtcgggtccnccgaggctccggaggggaaggcgtgggagtgggtcggaccaaacaagtaaacaaaggaacggaagtacaaagaaaacctgtaggtacggactcgtaaggtacgaacggccgtacttccacctatctacagacgaacaaccgacaaagtattccgaacgttgttaattacgacaaagttacgaacacgtacgtaggacggagggacgacggaccgtacggtcgttagttattagttgtgcggaagtaagngtagaaagtacgtaagttacttacgttaacgtaagttacggaagtggttagttatgttgtttaag

SEQ ID NO: 371095 - DNA, 566 bp, Homo sapiens
  misc_feature: GZ8MTXP01A2QCQ.15.67.G01.1.454.CMB.2.raw
  modified_base (349)..(349): a, c, t, g, unknown or other
  modified_base (382)..(382): a, c, t, g, unknown or other
  modified_base (517)..(517): a, c, t, g, unknown or other
  modified_base (521)..(521): a, c, t, g, unknown or other
  modified_base (559)..(559): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcttggtccgaggccgggggggtccctgagactctcctgtgcagtctctggattcacccttagaagtattggatgacctgggtccgccaggctccgagggggaagggcgtggagtggggtggaccaanaataaacaaagacggaagtcaaggaaaaacctntgtggactcgtagtgaacggccgattcaccatcctccagacgacaacgccaaagattcacttgttatttgacaaagtgaaactagaccgtaggaggagggcgaaggaccgtacggccgttagtattattgtgcgngagntgatacgtacgcttcgactgtagcgagggtgttatcgngtttcgg

SEQ ID NO: 371096 - DNA, 566 bp, Homo sapiens
  misc_feature: GZ8MTXP01AELGD.15.67.G01.1.454.CMB.2.raw
  modified_base (308)..(308): a, c, t, g, unknown or other
  modified_base (325)..(325): a, c, t, g, unknown or other
  modified_base (340)..(340): a, c, t, g, unknown or other
  modified_base (363)..(363): a, c, t, g, unknown or other
  modified_base (503)..(503): a, c, t, g, unknown or other
  modified_base (505)..(505): a, c, t, g, unknown or other
tcagtctacgtagccacgaccggtgctcgatttagagtatacatattgggtttgaggtctcagagaggagtcttagccctggactccaaggccttttccacttggtgatcagcactgagcacagaggactcaccatggagttggggctgagctgggttttccttgttgttattttagaaggtgtccagtgtgaggtgcacgttggtggagtcgtggggggaggcttgggtccgaggccggggggtccctgagactctcctgtgctagtctctggtattcacccttagaagtatggatgacctggtccncagctcaggggaggtcnggagtgggtgacaanaagtaaacgaaagtacgaaagtnaaagaaaaacctgtgtagactcgtagagaacggcctattcaccattcaccagacgacaacgtaccaagtacttacagtgtattagacaatagaacagacgagagaggacgacgacgacgcgtagtagttagttagtgggngngagagtagttagtagtacgttacgttcttacgtaagtagaagtaggtaggttagtgttgtg

SEQ ID NO: 371097 - DNA, 636 bp, Homo sapiens
  misc_feature: GZ8MTXP01ETSQK.15.67.G01.1.454.CMB.2.raw
  modified_base (326)..(326): a, c, t, g, unknown or other
  modified_base (351)..(351): a, c, t, g, unknown or other
  modified_base (582)..(582): a, c, t, g, unknown or other
  modified_base (606)..(606): a, c, t, g, unknown or other
  modified_base (614)..(614): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgctacgttggtggagtcgtggggggaggtcgtttggtccgagggtcccgggggggtccctggacgacttctcctgtgctagtctcgtggtattctacccgttagtaagttattggatgaccgtgggtccncgaggctccgaggggagggctgggngtgggtcgaccgaaacaagtaaaacaaaggtacggaaagtacgaaagtaaaaaaccctgtaggtaggtacctcgtaggtacggaaccgggtccgtaaattaccacctactccgtacgaagacgaacaaaccgaccgaaagtaacttacgtaacttagtttattagaaccaaatagaaacagccgtaggaggacgggacgaggacgaccggtacgtgttaatgtagtcgcgngaagattggatacgagttaccttnacgtgtangtagggtgttagtgaacgtttg

SEQ ID NO: 371098 - DNA, 717 bp, Homo sapiens
  misc_feature: GZ8MTXP01CBPVY.15.67.G01.1.454.CMB.2.raw
  modified_base (286)..(286): a, c, t, g, unknown or other
  modified_base (330)..(330): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagtcttgggttttccttgtttgtttatttagaaggtgtcagtgtgaggtgctacgttggtggagttcggtggggggagtcgttgggtccgacggggccgggggggttccctggagtaccttctccgtgtgctagtctntggtacttcctaccttagaagttatggatcgaccgtgggtcccncgaggctacggaggggacggcgtagggaggtgggtcgaccaaataagtaaaacgaaaggtaacggaagtacaaagtaaaacctagtgtaggactgtaagtacggaacgcgtaataccacagtccacgagactacaacgacaaagtacttacacgtttgttaattacgaactaaagtacgaaacacgtaccggtaaaggggaagacgggggaccgaaacggggttaccgaccggggttaccgtttaagttaacgtttaggttcggttaccggtgggaaccgtaaggttacggttagttaaaccgttaaagggtacgttaaaccctttcgaaacggtaaggttaccggaacggttagggggttacgttaaggttgttaaccgttttggg

SEQ ID NO: 371099 - DNA, 700 bp, Homo sapiens
  misc_feature: GZ8MTXP01A2PXS.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgagggcccgggggggtccctgagactctcctgtgcagtctctggattcacccttagtaagtattggatgaccgtgggtccgccgaggctccgaggggaaggggcgtggagtgggtggaccaaacaagtaaaacaaaggacggaaagtacaaaggaaaaaacctagtaggtggtactcgtagtagaacggccgattccgaccatctaccaagacgacaaaccgaccaaaggtaattaccgtaactagttatttacgactaaaacgtacgtaaacgagtccccggtaaggtagggaacgggacggaaacggggacccgtaaccggggtacccggtttaggtttaatttaaggtttcgggtcgcgggcccggtaaggttaacgttgaaagtttaaacggtaacgttaccggttaccttaaccgaaggtacggtaacgtaagggggtggttaacgttaaggttcgttttaaggg

SEQ ID NO: 371100 - DNA, 564 bp, Homo sapiens
  misc_feature: GZ8MTXP01CAXWT.15.67.G01.1.454.CMB.2.raw
  modified_base (507)..(507): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagtatggatgacctgggtcgccaggctccagggaagggctggagtgggtggccaaacaataaaacaaaagacggaaagtcaagaaaaaaaccctatagtggaactctagtagaacggccgattcaccatctccagagaacaaacgaccaaagaaattcaactgtatttgacaaatagaaacaacgacgtagagagacggaggacgacggacgtagtattatgtgcgngagagtagagtagtagttacgcttactaagtagcgaggtaggttagtaagttaagtg

SEQ ID NO: 371101 - DNA, 699 bp, Homo sapiens
  misc_feature: GZ8MTXP01DLTN5.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgttgggttttccttgtttgtttattttagaaggtgtccagtgtgaggtgctacgttggtggaggtcggtggggggaggtcgtttgggtcccgaggggcccgggggggttccctggacgtacctctccgtgtgctagtctcgtggacttctacccttagaagttattggatgaccgtcgggtcccgccgaggctaccgaggggaagggcgtgggaggtgggtcggaccaaacaaataaaacgaaaggaacggaaagtacaaagtaaaaaaccctgtagtaggactcgtaggtacgaaccggccgtaactttccaacctactccgtaccaaaggacgaaccgaaccgaacccaaagtaaacttacctaacgttagtttaatttacgaactaaaatacgaaaccacgaccgtaggaaggacgggacgaaggacccgacggtccgttagttattagttgtacgcgtaagaagttagtgaaagttagtaacgttacgttacgttaacgtaaggtaacgtggtaaggggttagttagttaagttgttttaacgg

SEQ ID NO: 371102 - DNA, 587 bp, Homo sapiens
  misc_feature: GZ8MTXP01CR9P0.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtagtccagtgtgaggtgcacttggtggagtcgtggggggaggcgttggtccgaggcccgggggggtccctgagactctcctgtgcagtctctggattcacccttagtaagtattggatgaccgtgggtcccgccaggctccgaggggaaggggcgtgggaggtggggtggaccaacaataaacgaaagacggaagtcaagaaaaacctatagtggactcgtagtgaaccggcattcaccatctcagacgacaacgaccaagaattcacttgttatttgacaaatagaacacgcgtaggacggaggacgaggacgacggtcgtagtattagtgtagcggtcgagagtgagtaggtagttaccttcttacgaaggtaagtcgaagggttggttagtttcgaagtttcgg

SEQ ID NO: 371103 - DNA, 748 bp, Homo sapiens
  misc_feature: GZ8MTXP01AWM0T.15.67.G01.1.454.CMB.2.raw
  modified_base (725)..(725): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcgttgggttttccttgttgttattttagaaggtgtccagtgtgaggtgctacgttggtggaggtcggtgggggaggcgtttgggtccgacgggcccgggggggttccctggacgtacctctccgtgtgcgtagtctcgtggtacttctacccttagtaagttagtggatgaccgtgggtcccgccgaggccgtaccggaagggggtaacgggcgtagggtaggtggggtacgacccaaacgaagtaaaaacgaaaggaacggaaagtacgaaaacgtaaaaaaccgtagttacggtaggtaacctcgttaacgggtacggaacccgggtaccgtaactttacccgaccctacttacccgaacccgaaggaaacccgaaccgaaacccggaccaaaaacggttaacctttacctaaccgtttagtttaacgtttacgaacgtaaaacgttacgaaacgtacggtacccggtaggaacggggaacgggacgggaaacggaccgacggtccggttagtagtttacgtgtcggacgaagtaagagttagagttagtacgacttcgttaacgaagaacggngtaggtgttaagtgttaagtttg

SEQ ID NO: 371104 - DNA, 621 bp, Homo sapiens
  misc_feature: GZ8MTXP01DPQKV.15.67.G01.1.454.CMB.2.raw
  modified_base (393)..(393): a, c, t, g, unknown or other
tcagtctacgtagccacgaccggtgctcgatttagagtatacatattgggtttgaggtctcagagaggagccttagccctggactccaaggccctttccacttggtgatcagcactgagcacagaggactcaccatggagttggggctgagctgggttttccttgttgttattttagaaggtgtccagtgtgaggtgcacttggtggagtcgtgggggaggcttggtccgagggccggggggtccctgagactctcctgtgcagtctcgtggattcacccttagaagttattggatgaccgtgggtcccgccgaggctccgaggggaagggcgtgggaggtgggtggaccaaacaaataaaacgaaagacggaaagtacaaagaaaaaacctntagtaggactcgtagtaggaacggccgtaattccgaccatctaccaagaacgacaaacgaccaaagtaattacaacttagttaatttcgaacaaaagtagaaacgacgtaccgtaggaaggaagggaccggaaggaaccgacgggtccgtagtatttagtgtcggcgtgaagatagacgtaagtagacttcaagtaagtagcgtagggtaggttaagttgaagtttcg

SEQ ID NO: 371105 - DNA, 598 bp, Homo sapiens
  misc_feature: GZ8MTXP01BB8UC.15.67.G01.1.454.CMB.2.raw
  modified_base (310)..(310): a, c, t, g, unknown or other
  modified_base (544)..(544): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggagcgttgggtccgagggcccgggggggtccctgagactctcctgtgcagtctcgtggattcacccttagaagttatggatgacctgggtccnccgaggctccgaggggaagggctggaggtgggtggaccaaacgaataaaacgaaaggaccggaaagtacgaaagaaaaaacctgtaggtaggtactcgtaagtacgaaccgggccgtaattccaccctatcctaccaagagacaacgccaaagtattcaacgttgtatttgactaaatgaaacagaccgtgagaggcgaaggaccgacggcgtagtattagtgtcgcgtgaagngtagagtaagtacgacttcacgaagttgaagtgggtaggttatgttcgtttaag

SEQ ID NO: 371106 - DNA, 591 bp, Homo sapiens
  misc_feature: GZ8MTXP01CTN91.15.67.G01.1.454.CMB.2.raw
  modified_base (307)..(307): a, c, t, g, unknown or other
  modified_base (389)..(389): a, c, t, g, unknown or other
  modified_base (536)..(536): a, c, t, g, unknown or other
tcagtctacgtagccacgaccggtgctcgatttagagtatacatattgggttttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggtcttggtccgaggccggggggtccctgagactctcctgtgcagtctctggattcacccttagaagttattggatgacctgggtccnccaggctccgaggggaaggggctgggagtgggtcggccaaacaataaaacgaaaggacggaaagtcaaagaaaaaacccttntggtggaacttcgtaaggttagaaccgggcaaagttcccaaccatcctaccgagacgaacaacgacaaagaacttcaacttgtatttgacaaatgaaacagccgtaggacgagggcgacggacgacggcgtgtattatgtcgcgcgngattgataagtacgacgttcacgtaagtaggtcagggtggttatgttaagtttcg

SEQ ID NO: 371107 - DNA, 612 bp, Homo sapiens
  misc_feature: GZ8MTXP01A3N9M.15.67.G01.1.454.CMB.2.raw
  modified_base (311)..(311): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttatttagaaggtgtccagtgtgaggtgcacttggtggagtcgtggggggaggtcgttgggtccgagggcccgggggggtccctggagtactctcctgtgcagtctctggattcacccttagagtatggatgacctgggtccncaggctcgaggggagggctgggagtgggtgaccaacaataaacgaaagacggaagtacaagaaaaacctatgtaggactcgtagtacgaacggtccgattaccaccatcctacagaacgacaacgaccaaagtaacttacactagttatttagacctaaaatcgaactacgccggtaggaggacgggacggacggaccgaccgggtccgttagtaatttagttggtcggcgaacgtagataggttagtaaggtacgacttcgttacgtaagtagcgtagggtgttaacgtgttaagtttcg

SEQ ID NO: 371108 - DNA, 812 bp, Homo sapiens
  misc_feature: GZ8MTXP01EQ2JN.15.67.G01.1.454.CMB.2.raw
  modified_base (788)..(788): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggaggtcgtggggggagcttgggtccagggcccgggggggtccctggagtactctccgtgtcgctagtcttcgtggtacttccaaccctttaaggaagttagttggacttcggaacccgttggggtcccgccgtagggccttaccggagggggtaacggggcgtgggggacggtgggggtcggaccctaaaaccgtaaagtaaaaaccgaaaaggtaccttaaggaaacgtaccgaaaagtaaaaaaaaccgtttgaacggggtttaggacccttaaccgggttagggttaacggaaacccgggggtacccgttaactttacccccgaacccgttaactttacccgtaacccaagggaaacccgaaaccgtaaaccggaacccaaaacggtaaactttacctaaccgtttagttaagtttacggaaacctaaaacgttagaaaccgaacgggtacccgttaggaaaggacggggaccggaagggtaccgaaccggggttaccgtaggttaacgtttagttcgggtaggccggtggaaggtattagggtataggttaacgttccttagtaaccgaggtaacggngtaggggttagttcgttaagtaag

SEQ ID NO: 371109 - DNA, 644 bp, Homo sapiens
  misc_feature: GZ8MTXP01C6NCZ.15.67.G01.1.454.CMB.2.raw
  modified_base (502)..(502): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtgggagtcgtggggggaggcttgggtccgagggcccggggggggtccctggagactctcctgtgcagtctctgacttcaccttagaagtattggatcgacgttcgggtccgccgaggcctaccgaggggaaggggcgtagggaggtgggggtcggacctaaacgaataaaacgaaaagacggaaagtacaaacgtaaaaactgtgtagactcgtagtagaacggcctaagttcaacatctacagagaacaacggtaccaaagtaacttacacttagttaatttagaataaatgaaacncgtaccgtaggaggaggacgaggacgacggccgttagtacttagttgacgtgaacgagttatacggttattacggtaacgttaacgttcttaacgtggttaagccggttaagggtaggttacgttaagttaagttttaacgg

SEQ ID NO: 371110 - DNA, 582 bp, Homo sapiens
  misc_feature: GZ8MTXP01DKDJQ.15.67.G01.1.454.CMB.2.raw
  modified_base (343)..(343): a, c, t, g, unknown or other
  modified_base (377)..(377): a, c, t, g, unknown or other
  modified_base (412)..(412): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagtatggatgacctgggtccgcaggctccgaggggaagggctggagtgggtggaccaaanaataaaacaaagacgaaagtcaagaaaaaacctntagtagactctagtgaacggcccgtattccaaccntactaccagacgaacaaaccgcctaaagaattccattgtatttgacaatagaacagcgtagagaggacgaggacgacggaccgtagtagttattagttgcggcgagagtagttagtaagtaagttacgttacttacctaagtagaagaggtaggttatggggttaagttg

SEQ ID NO: 371111 - DNA, 557 bp, Homo sapiens
  misc_feature: GZ8MTXP01AB3RD.15.67.G01.1.454.CMB.2.raw
  modified_base (304)..(304): a, c, t, g, unknown or other
  modified_base (358)..(358): a, c, t, g, unknown or other
  modified_base (371)..(371): a, c, t, g, unknown or other
  modified_base (380)..(380): a, c, t, g, unknown or other
  modified_base (404)..(404): a, c, t, g, unknown or other
  modified_base (409)..(409): a, c, t, g, unknown or other
  modified_base (414)..(414): a, c, t, g, unknown or other
  modified_base (426)..(426): a, c, t, g, unknown or other
  modified_base (442)..(442): a, c, t, g, unknown or other
  modified_base (444)..(444): a, c, t, g, unknown or other
  modified_base (446)..(446): a, c, t, g, unknown or other
  modified_base (448)..(448): a, c, t, g, unknown or other
tcagtctacgtagccacgaccggtgctcgatttagagtatacatattggggtttgaggtctcagagaggagccttagccctggactccaaggcctttccacttggtgatcagcactgagcacagaggactcaccatggagttggggctgagctgggtttttccttgttgttatttttagaaggtgtccagtgtgaggtgcacttggtggagtctggggggagcttgggtccgagccggggggggtcccctgagactctcctgtgcagtctctggattcacccttagagtatgactgactggccncaggctcagggaagggtctggagtcgggtgccaaagataaacaaagacggtaancagaaaaaccctngtggactcngtgaacggcctattccacaggtcnccagnacganacataatcgaangtaacttggaccaaananananacgagagagacgacgacgacgacgtacgtagtagtagtcgcgcgagagtacgttacgtacgtacgttacgttcgttacgtaagtagtcgtacggtagttagtcgttgtg

SEQ ID NO: 371112 - DNA, 592 bp, Homo sapiens
  misc_feature: GZ8MTXP01DLDC5.15.67.G01.1.454.CMB.2.raw
  modified_base (388)..(388): a, c, t, g, unknown or other
  modified_base (553)..(553): a, c, t, g, unknown or other
  modified_base (568)..(568): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtgggagtcgtggggggaggcttgggtccaggccggggggggtccctgagactctcctgtgcagtctctggattcacccttagaagtatggatgacctgggtcccgccaggctcccgaggggaacggggctgggagtggggtggccaaacaataaaacaaagacggaaagtcaagaaaaaaccctntagtagggaactctaaggtgaacgggccgaattcacccatctaccagagacaacgtcaaagaattcaactagtatttagacaaaatgaaacaggcctagaggaaggcgaaggaccacggtaccgtgtattatgtagcgaacgagagtcgagtaagtagacccttnttaacctaagtacgntaagggtggttaagtggaatttgg

SEQ ID NO: 371113 - DNA, 636 bp, Homo sapiens
  misc_feature: GZ8MTXP01B52AB.15.67.G01.1.454.CMB.2.raw
  modified_base (544)..(544): a, c, t, g, unknown or other
  modified_base (584)..(584): a, c, t, g, unknown or other
  modified_base (588)..(588): a, c, t, g, unknown or other
  modified_base (616)..(616): a, c, t, g, unknown or other
tcagtctacgtagccacgaccggtgctcgatttagagtatacatattgggtttgaggtctcagagaggagccttagccctggactccaaggccctttccacttggtgatcagcactgagcacagaggactcaccatggagttggggctgagcgtgggttttccttgttgttattttagaaggtgtccagtgtgaggtgcattggtggagtcgtgggggaggcgttggtccgagggcccgggggggtccctgacgtacctcctcctggtgctagtctcgtggacttccaacccgttagaaagttagttggatgaccgtcgggtcccgaccgaggtccgtcccgaagggggaacggggtcgtaggggaggttaggggacggaccccaaaagaaataaaaaaccgaaaaggaaccggaaagtaaccaaaagaaaaaaaccctgtggtacggactctaaggtacgaaccggcgaattccacccatcacaagacacaacgaccaaagtaactcaagttagtattagaacaaaagttcgaaacagtaccnggaaggaggcggaagtacgacggcgtagtattatgtgcgngagntagagtacgtagaccttcgagtaagagngaggttggactgttaagttg

SEQ ID NO: 371114 - DNA, 620 bp, Homo sapiens
  misc_feature: GZ8MTXP01CXMRZ.15.67.G01.1.454.CMB.2.raw
  modified_base (310)..(310): a, c, t, g, unknown or other
  modified_base (314)..(314): a, c, t, g, unknown or other
  modified_base (503)..(503): a, c, t, g, unknown or other
  modified_base (509)..(509): a, c, t, g, unknown or other
  modified_base (521)..(521): a, c, t, g, unknown or other
  modified_base (559)..(559): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgtttggtccagggccgggggggtccctggagactctctgtgctaggtctgtggattcacccgttagaagtatggattgacgtgggtcnccgngctacgaggggaggctaggaggtggtcgaccaaataagaaaaacaaaggaaccgaaagtacgaaacgaaaaaaaaccgttgtacgtaggaaccttcgtaagggttaacggaaccgggcctaattccaacccatccctacaagaagaccaacgtaaccgaaagtaattcaacttgtaatttcgacaaagngaaacngaccgagaaggngacggaagtacgacggtagtgtaagttattgggcgcgngtagagtagttagtagtacgttacgttcacgtaagtagtaacgtaggtagttagtgttgtg

SEQ ID NO: 371115 - DNA, 858 bp, Homo sapiens
  misc_feature: GZ8MTXP01AO03R.15.67.G01.1.454.CMB.2.raw
  modified_base (829)..(829): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagtcttgggttttccttgttgtttatttagaaggtgtcgagtgtgaggtgctacgttggtggaggttcggtggggggtacggtcgtttcgggtccggacggggtcccggggggggttccctaggacgtaccgttccgtccgtggtcgcgtagttctcgtggtacttacctaacccgttaagtaagttacgttggactcggtaccgtggggtccccgccgacggtcctaccgggaacggggggtaagggggtcgtacgggggtaggtcgggggtaccgaaccgaaaactaaacgtaaaaaccggaaaggaacggaaacgtactaaaacggtaaaacccttaggtcggtacggtaccttcggtaagggtacgggtaacccggtcccgtaacttacccaaaccgtacgttacctaccggaaacgaacccgggaaaacccaacccgggtaaacccgtaaaacggttaaacctttacccgtaaaccgtttaagtttaaacggtttaccaaacgttaaaaaccgttaggaaacccgttaggacccgggttaaggggtaacccgggaggggttaaccgaacgggggtaaccaccgggggtacttttaaggtactttaggttcggcggtacggtcggaaaggttctaggttaagttaaacgtacgttacttaccgttaggaagttacgngttaagggtgttacggtaattgtttaacg

SEQ ID NO: 371116 - DNA, 541 bp, Homo sapiens
  misc_feature: GZ8MTXP01C80I0.15.67.G01.1.454.CMB.2.raw
  modified_base (348)..(348): a, c, t, g, unknown or other
  modified_base (369)..(369): a, c, t, g, unknown or other
  modified_base (376)..(376): a, c, t, g, unknown or other
  modified_base (386)..(386): a, c, t, g, unknown or other
  modified_base (437)..(437): a, c, t, g, unknown or other
  modified_base (494)..(494): a, c, t, g, unknown or other
  modified_base (499)..(499): a, c, t, g, unknown or other
  modified_base (511)..(511): a, c, t, g, unknown or other
  modified_base (522)..(522): a, c, t, g, unknown or other
  modified_base (535)..(535): a, c, t, g, unknown or other
tcagtctacgtagccacgaccggtgctcgatttagagtatacatattgggtttgaggtctcagagaggagccttagccctggactccaaggcctctccacttggtgatcagcactgagcacagaggactcaccatggagttggggctgagctgggttttccttgttgttattttagaaggtgtccagtgtgaggtgcacttgggtggaggtcgtggggggaggcgttgggtccgaggcccggggggggtccctggagactctcctgtgcagtctctggattcacccttagaagttatggatcgactgggtccgcaggctccagggaggggctggagtgggtggccaanataaacaaagacgaagtcaanaaaactngtgactctgngaaacggccattcaccatctccagagacaacgccgaaagtaaactcacgtntatttgaacaaatgaaacaggcctagaggacgcgagacacgggctgtatatgtgcgngagancgatgagacttntaacaggtaangtaggttgtaagngggtaa

SEQ ID NO: 371117 - DNA, 592 bp, Homo sapiens
  misc_feature: GZ8MTXP01B1DCJ.15.67.G01.1.454.CMB.2.raw
  modified_base (397)..(397): a, c, t, g, unknown or other
  modified_base (476)..(476): a, c, t, g, unknown or other
  modified_base (506)..(506): a, c, t, g, unknown or other
  modified_base (519)..(519): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttcttgttgttattttagaaggtgtccagtgtgaggtgcacgttggtggaggtcggtggggggagtcgttgggtccgagggcccggggggtcctggagactcctctgtgcagtctcgtggcttcaccttagaagtatggatgaccgtggtccgcgaggctcgaggggaagggctgggaggtgggtggaccaaacaataaacaaaggaccgaagtacaaaggaaaacctgtagtagacctntaagtcgaacgggctacttcaccatctccagacgacaacgacaataactcaatcgttatttagacaaatgaacagtcgngaaggaggacggtaacgacgacggacgttntagttattagggnggcgtaagagttagtagttaagtacgtagttacgttcaacgtaagtagaagtagggtgttagtaagttcgttg

SEQ ID NO: 371118 - DNA, 719 bp, Homo sapiens
  misc_feature: GZ8MTXP01A3RZY.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcaccctagaagtatgatgaccgtggtccgccaggctaccgaggggaaggggctgggaggtgggggtcgggaccaaacaaataaaacgaaaggaacgggaaagttacaaagaaaaaacccttgtaggtaggaactcgtaagttaggaaccgggtcccgactttaccgacctactcctaccgaacgacgaaaccgaaaccggacccaaaggtaaactttaccaaccgttgttaacttttgaactaaaacgttacgaaacccgaggaccctaggaaggacggacggacgggaacccgaacgggtcccggtttaggttaatttaaccgtttggtacgtccgggtaaccggaagttagttaaggaaacgttaaagggtttacggaacccttaccggttaaacgtaaggttacggaacgttaaggggttaggttagttaaggttaacgtttgg

SEQ ID NO: 371119 - DNA, 528 bp, Homo sapiens
  misc_feature: GZ8MTXP02HJNKN.15.67.G01.1.454.CMB.2.raw
  modified_base (302)..(302): a, c, t, g, unknown or other
  modified_base (337)..(337): a, c, t, g, unknown or other
  modified_base (370)..(370): a, c, t, g, unknown or other
  modified_base (381)..(381): a, c, t, g, unknown or other
  modified_base (400)..(400): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttcctgttgttattttagaaggtgtcagtgtgaggtgcacttggtggagtctgggggaggcttggtccaggccgggggggtccctgagactctcctgtgcagtctctggattcacccttagaagttatggatgacctgggtccncaggctccaggggagggctggagtgggtggccaanataaaacaaagacggaagtcaagaaaaacctangtggactctgngacggccgattcaccatcncagagacaacgccaagaattcactgtatttgacaaatgaaacagcctagagaggcgaggacacggcgtgtattatgtgcgcgagatagatagtagactactacaagtagacgagtaggtagtagtatg

SEQ ID NO: 371120 - DNA, 492 bp, Homo sapiens
  misc_feature: GZ8MTXP02JUH4M.15.67.G01.1.454.CMB.2.raw
  modified_base (345)..(345): a, c, t, g, unknown or other
tcagtctacgtagccacgaccggtgctcgatttagagtatacatattgggtttggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggtggtatcagcagaaatccgggaaagcccctaagctcctgatctgtgctgcatccactttacaaagtggggtcccccatcaaggttcagcggcngtggatctggcacagatttcactctcaccatcagcagcctgcagcctgaagatttcgcaacttatactgtctacaagattacaattacctcggacgttcggccaggggaccaaggtggaaatcaaacgaactgtacggctcgcacca

SEQ ID NO: 371121 - DNA, 590 bp, Homo sapiens
  misc_feature: GZ8MTXP02IERHN.15.67.G01.1.454.CMB.2.raw
  modified_base (384)..(384): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggttttctgtgttatttagaaggtgtcagtgtgaggtgcacttggtggagtcgtgggggaggcttggtccaggccgggggggtccctgagactctcctgtgcagtctctggattcaccttagaagttatggatgacctgggtccgccaggctccgaggggaaggggctgggagtggggtggccaaacataaaacaaaggacggtaaagtcaagaaaaacctatgtggactntggtacgaccggggccaattccaaccctattcctaccagaacgacaaaccggtcccaaagtaaatactactagttatttgtaacaatagaacacgacgagagaggacggaggacgacggacggtagtagttagttgtgcgacgagagtagtaagtaagtacgtacgtacgtaacgtaagtagtacgtaggtaggtagtagtagtag

SEQ ID NO: 371122 - DNA, 525 bp, Homo sapiens
  misc_feature: GZ8MTXP02JHG9W.15.67.G01.1.454.CMB.2.raw
  modified_base (376)..(376): a, c, t, g, unknown or other
  modified_base (505)..(505): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaaggggctgggagtgggtggccaacataaacaaagacggaagtacaagaaaaacctntgtggactctgtgacggcgattcaccatctccagagacaacgcaagattcactgtatttgacaaatgaaacagcctgagaggcgagacgacggcgtgtattatgtgcgcgagatgatagtagactctanaagtacgcaggtgtatgatg

SEQ ID NO: 371123 - DNA, 531 bp, Homo sapiens
  misc_feature: GZ8MTXP02J1QVX.15.67.G01.1.454.CMB.2.raw
  modified_base (507)..(507): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccgggggggtccctgagactctcctgtgcagtctctggattcacccttagaagttattggatgacctgggtccgccaggctccaggggaaggggctgggagtggggtggccaacataaaacaaagacggaagtcaagaaaaacctatgtggactctgtgacgggccgattcaccatctccagagacaacgccaaagaattcactgatttgcaaatgaacagcctgagaggcgaggacacggccgtgtattatgtgcgcgagatgatagtacgactntacaagtagcaggtggtatggatg

SEQ ID NO: 371124 - DNA, 521 bp, Homo sapiens
  misc_feature: GZ8MTXP02I2W7J.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccggggggtccctgagactctcctgtgcagtctctggattcacccttagaagttattggatgacctgggtccgccaggctccaggggaaggggctggagtgggtggccaaacataaacaaagacggaagtcagaaaaacctatgtggactctgtgacggccgattcaccatctccagagacaacgccaaagaattcactgtattgacaaatgaaacagcctgagaggcgaggacacggcgtgtattatgtgcgcgagatgatagtagactcacaagtagcaggtgtatgatg

SEQ ID NO: 371125 - DNA, 530 bp, Homo sapiens
  misc_feature: GZ8MTXP02GZK3C.15.67.G01.1.454.CMB.2.raw
  modified_base (363)..(363): a, c, t, g, unknown or other
  modified_base (526)..(526): a, c, t, g, unknown or other
tcagtctacgtagccacgaccggtgctcgatttagagtatacatattgggtttggggtccctgagactctcctgtgcagtctctggattcacccttagaagttattggatgacctgggtccgccaggctccagggaaggggctggagtgggtggccaacataaacaaagacggaagtcagaaaactatgtggactctgtgaacggccgattcaccatctccagagacaacgccaagaattcactgtatttgcaaatgaacagcctgagaggcgaggacacggccgtgtattatgtgcgcgagatgatagtagactctacagtagcaggtgtatgatgcttttgatatgtggggccaaggggcnggtggtcaccgtcacgttcagccctccaccaacgggcccatcggtccttccccctggccgccctgcctccgaggcgccaccgtccgagacgcacgacgcggccctgggcctgcctggtcaggactacgtccgctacgtacgactgaacgcggctggcaaggcncgag

SEQ ID NO: 371126 - DNA, 542 bp, Homo sapiens
  misc_feature: GZ8MTXP02J3BRI.15.67.G01.1.454.CMB.2.raw
  modified_base (386)..(386): a, c, t, g, unknown or other
  modified_base (475)..(475): a, c, t, g, unknown or other
  modified_base (486)..(486): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggggctgagctggggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccaggggaggggctggagtgggtggccaacataaacaaagacggaaagtcaagaaaaacccctatgtggactcngtgacggccgattcaccatctccagagacaacgccaagaattcactgtatttgacaaatgaacagcctgagaggcgaggacacggtccngtattattggngcgcgagatgatagacgactactaacgaagtacgcgtacggtaggtagtagtagtg

SEQ ID NO: 371127 - DNA, 550 bp, Homo sapiens
  misc_feature: GZ8MTXP02HBKL3.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctggagactctcctgtgcagtctctggattcacccttagaagttattggatgacctgggtccgccaggctccgaggggaaggggctggagtgggtggccaaacataaaacaaagaacggaagtcaagaaaaaacctatagtggactctgtagacgggccgattccaccatctaccagagacaaacgccaaagaatcactgtatttgacaaatgaaacagcctagagagcggaagacgacggcgtgtattagtgtgcgcgagagtagatacgtagactcgtaacaagtagcgtaggtgtatggattg

SEQ ID NO: 371128 - DNA, 525 bp, Homo sapiens
  misc_feature: GZ8MTXP02I968R.15.67.G01.1.454.CMB.2.raw
  modified_base (168)..(168): a, c, t, g, unknown or other
  modified_base (302)..(302): a, c, t, g, unknown or other
  modified_base (354)..(354): a, c, t, g, unknown or other
  modified_base (402)..(402): a, c, t, g, unknown or other
  modified_base (419)..(419): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggggctgagcgtggtttcgtgtagtntttagaagtgtcagtgtgaggtgcacttggtggagtctggggggaggcttggtccagccggggggggtccctgagactctcctgtgcagtctctggatcaccctagagtattggatgactggtcgccagctccnggaagggcgtggagtgggtggcacataaacaaagacgaagacagaaaactanagtggatctgtgacggcgattcaccatctccagagacaacgaccaaanaatacactatattatanatagacacgacagagaggacgagacgacggacgtgtagttagtgtgcgcgagagtagtagtagtacgacgtactacgtaagtagacgtaggtaggtagtagtagtg

SEQ ID NO: 371129 - DNA, 530 bp, Homo sapiens
  misc_feature: GZ8MTXP02H9YTT.15.67.G01.1.454.CMB.2.raw
tcagtctacgtagccacgaccggtgctcgatttagagtatacatattgggtttgaggtctcagagaggagcccttagccctggactccaaggcctttccacttggtgatcagcactgagcacagaggactcaccatggagttggggctgagctggggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccaggggaaggggctggagtggggtggccaacataaaacaaagacggaagtcagaaaaacctatgtggactctgtgacgggccgattcaccatctccagagacaacgccaagaattcaactgtaatttgcaaatgaaacagcctgagaggcgaggacacggccgtgtattatgtgcgcgagatgatagtagactctacaagtagctaggtgtatgatg

SEQ ID NO: 371130 - DNA, 538 bp, Homo sapiens
  misc_feature: GZ8MTXP02IHRG1.15.67.G01.1.454.CMB.2.raw
tcagtctacgtagccacgaccggtgctcgatttagagtatacatattgggtttgaggtctcagagaggagcccttagccctggactccaaggcctttccacttggtgatcagcactgagcacagaggactcaccatggagttggggctgagctgggtttttccttgttgttattttagaaggtgtccagtgtgaggtgcacttggtggagtctgggggaggcttggtccagccgggggggtccctgagactctcctgtgcagtctctggattcacccttagagttatggatgacctgggtccgccaggctccaggggaaggggctggagtggggtggccaaacataaaacaaagacggaagtacagaaaaacctatgtgactctgtgacgggccgattcaccatctacagagacaacgacaagaatcactgtattgacaaatgaaacagcctagagaggcgaggacacggcgtgtattattgtgcgcgtagatgatagtacgactctaacaagttagacgtaggtaggtactgattcg

SEQ ID NO: 371131 - DNA, 530 bp, Homo sapiens
  misc_feature: GZ8MTXP02GWXDO.15.67.G01.1.454.CMB.2.raw
  modified_base (374)..(374): a, c, t, g, unknown or other
  modified_base (473)..(473): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctggggtccgccaggctccgaggggaaggggctggagtgggtggccaacataaacaaagacgaagtcaagaaaaacctangtaggactctgtgacggcgatcaccatctccagagacaacgacaagaatcactgtatttgacaaatgaaacagacctagagaggcgagacgacggccgngtatatgtgcgcgagatgatagtagactctacgaagtagacgtaggtggtatgattg

SEQ ID NO: 371132 - DNA, 551 bp, Homo sapiens
  misc_feature: GZ8MTXP02GREMR.15.67.G01.1.454.CMB.2.raw
  modified_base (372)..(372): a, c, t, g, unknown or other
  modified_base (407)..(407): a, c, t, g, unknown or other
  modified_base (432)..(432): a, c, t, g, unknown or other
  modified_base (437)..(437): a, c, t, g, unknown or other
  modified_base (441)..(441): a, c, t, g, unknown or other
  modified_base (444)..(444): a, c, t, g, unknown or other
  modified_base (446)..(446): a, c, t, g, unknown or other
  modified_base (450)..(450): a, c, t, g, unknown or other
  modified_base (488)..(488): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttcgtgtagtatttagaagtgtcagtgtgaggtgcacttggtggagtctgggggaggcttggtccagccgggggggtccctgagactctcctgtgcagtctctggattcacccttagaagttattggatgacctgggtccgccaggctccaggggaaggggctggagtggggtggccaaacgataaaacaaagacggaaagtcaagaaaaaacctntagtaggaactctgtgacgggccaattcaccatcnccagagacaacgccaaagaatcatntattntaanaananacanacagagagaggagacgacggacgtagtattagttgtgngacgagagtagtagtagtacgtacgtactacgtaagtagacgtacggtaggtagtagtagtag

SEQ ID NO: 371133 - DNA, 535 bp, Homo sapiens
  misc_feature: GZ8MTXP02HAP8R.15.67.G01.1.454.CMB.2.raw
  modified_base (346)..(346): a, c, t, g, unknown or other
  modified_base (408)..(408): a, c, t, g, unknown or other
  modified_base (508)..(508): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttgggtccaggccgggggggtccctgagactctcctgtgcagtctctggattcacccttagaagttattggatgacctgggtccgccaggctccaggggaaggggctgggagtggggtggccaaanataaacaaagacggaagtcaagaaaaacctatgtggactctgtgacggccgattcaccatcncagagacaacgccaagaattcactgtatttgcaaatgaaacagcctgagaggcgaagacacggccgtagtattatgtgcgcgagatggatacgtagactntaacaagtagcaggtggtatggattgg

SEQ ID NO: 371134 - DNA, 533 bp, Homo sapiens
  misc_feature: GZ8MTXP02HM62R.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttatggatgacctgggtccgccaggctccaggggaaggggctggagtgggtggccaaacataaaacaaaagacggaagtcagaaaaacctatgtggactctgtgacgggccgattcacccatctccagagacaaacgccaaagaattcaactgtatttgacaaaatgaaacagcctgagaggcgaggacacggccgtgtattattgtgcgcgagatgatagtagactctacaagtagcaggtggtatgatg

SEQ ID NO: 371135 - DNA, 565 bp, Homo sapiens
  misc_feature: GZ8MTXP02FTH9T.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacttggtggagtcgtgggggaggcttggtccaggccgggggggtccctggagactctcctgtgcagtctctggattcacccttagaagttattggatgacctgggtcccgccaggctccgaggggaaggggctggagtggggtggccaaacataaaaccaaagacggaaagtcaagaaaaacctatagtaggactctgtagacgggccgattacaccatcctaccagacgacaacgccaaagattcactgtatttgacaaatgaaacagaccctagaggacggacggaggaaccgacgggccgtaggttattagttgtgcgacgagatagatagtagactctagaagtagcgaggtgtagtgtattg

SEQ ID NO: 371136 - DNA, 546 bp, Homo sapiens
  misc_feature: GZ8MTXP02H1U2O.15.67.G01.1.454.CMB.2.raw
  modified_base (490)..(490): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggggctgagctgggttttccttgttgttattttagaaggtgtccagtgtgaggtgcacttggtggagtctgggggaggcttggtccaggccggggggtccctgagactctcctgtgcagtctctggattcacccttagaagttatggatgacctgggtccgccaggctccgaggggaaggggctggagtgggtggccaacataaaacaaagacggaaagtcaagaaaaacctatgtaggactctggtgacgggccgattcaccatctccagagacaacgccaagaattcactgtatttgacaaatgaaacagcctagagaggcgaggacacggccgttagattattgngtcgacgagatgaatagtacgactcacaagtgacgagggttaggtatcggaattgg

SEQ ID NO: 371137 - DNA, 525 bp, Homo sapiens
  misc_feature: GZ8MTXP02JGRIG.15.67.G01.1.454.CMB.2.raw
  modified_base (374)..(374): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacttggtggagtcgtggggggaggcttggtccaggccgggggggtccctgagactctcctgtgcagtctctggattcacccttagaagttatggatgacctgggtccgccaggctccaggggaaggggctggagtgggtggccaacataaacaaagacggaagtcagaaaaacctntagtgactctgtgacggcgatcaccatctccagagacaacgccaagattcactgtatttgacaaatgaacagcctgagaggcgagacgacggcgtgtattagttgtgcgcgagatgatagtagactctacaagtagcgaggtgtatgattg

SEQ ID NO: 371138 - DNA, 616 bp, Homo sapiens
  misc_feature: GZ8MTXP02IOSQ4.15.67.G01.1.454.CMB.2.raw
  modified_base (264)..(264): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttcctgtaggttatttagaaggtgtccagtgtgaggtgcattggtggagtctgggggagcttggtccagccggggggtccctgagactctcctgtgcagtctctgntctacctagtaagttattggtatgaccgtcgggtccgccgacggcgtcgaggggaggggcgtggaggtgggtcggaccgaaacaaataaaacgaaaaggaaacggaaagtaacgaaagaaaacgtaagtagtagtactactgtagacggacgactacaccactctacagagaacaaaccgacaaagaaactactactagttattagtaacaaataacgaaacgaacgtaccgtacggaggagggacggaacggaacgacggacggtacgttaagttagtttagtgacggtacggagagtagtaagtaagtacgtaactactacgaagtagacgtaggtaggtagtagtagtg

SEQ ID NO: 371139 - DNA, 634 bp, Homo sapiens
  misc_feature: GZ8MTXP02G309K.15.67.G01.1.454.CMB.2.raw
  modified_base (167)..(167): a, c, t, g, unknown or other
  modified_base (251)..(251): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttcgtgtagtntttagaagtgtcagtgtgagtgcattggtggagtctgggggaggcttggtccagccggggggtcccgtgagactctcctgtgcngtctctgtatctacctagtaagttattgtagtgacgtcggtccgcgacgcgcgagggagggcgtggaggtgggtcggaccgaaacaaacgtaaaacgaaaagaaacggaaagtaacgaaagaaaactaagtagtagtacgtcgtgtacgacggaccgtactacaccactactaccacgaacgaacgaaaccgaaccgaaacgtaaactactacgtagttatttagtaactaaagtaagaaacgaacgtacgtagaggagggacggaacggaacgaccggtaccggtacgttaagtttagttagtcgtacggacggagtagtagtaagtaagtaacgtaacgtaacgtaacgtaacgtaagtacgtaggtaggtagtagtagtg

SEQ ID NO: 371140 - DNA, 536 bp, Homo sapiens
  misc_feature: GZ8MTXP02HKFL1.15.67.G01.1.454.CMB.2.raw
  modified_base (304)..(304): a, c, t, g, unknown or other
  modified_base (342)..(342): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccnccaggctccaggggaaggggctggagtgggtggccaanataaaacaaagacggaaagtacaagaaaaaacctatagtggactctgtgacggccgattcaccatctccagagacaaacgccaaagaattcactgtatttgacaaatgaaacagcctagagaggacgagacacggcgtgtattatgtgcgcgagatgatagtacgactactacaagtagcaggtgtatggatcg

SEQ ID NO: 371141 - DNA, 534 bp, Homo sapiens
  misc_feature: GZ8MTXP02IY6PO.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttgggtccaggccgggggggtccctgagactctcctgtgcagtctctggattcacccttagagttattggatgacctgggtccgccaggctccaggggaaggggctgggagtggggtggccgacataaaacaaagacggaagtcaagaaaaacctatgtggactctgtgacggccgattcaccatctccagagacaacgccaaagaattcactgtatttgacaaatgaaacagcctgagaggcgaggacacgggccgtgtattagttgtgcgcgagatgatacgtagactctacaagtagcaggtgtatgatcg

SEQ ID NO: 371142 - DNA, 530 bp, Homo sapiens
  misc_feature: GZ8MTXP02F3MX7.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattgggatgacctgggtccgccaggctccaggggaggggctggagtgggtggccaacataaacaaagacggaagtacaagaaaaacctatgtaggactctgtgacggccgattcaccatctccagagacaacgccaagattcactgtattgacaaatgaaacagcctgagaggcgagacgacggcgtgtatagtgtgcgcgagatgatagtacgactctacaagtacgcgtaggtgtatgattg

SEQ ID NO: 371143 - DNA, 607 bp, Homo sapiens
  misc_feature: GZ8MTXP02JG1K9.15.67.G01.1.454.CMB.2.raw
  modified_base (313)..(313): a, c, t, g, unknown or other
  modified_base (356)..(356): a, c, t, g, unknown or other
  modified_base (582)..(582): a, c, t, g, unknown or other
tcagtctacgtagccacgaccggtgctcgatttagagtatacatattgggtttgaggtctcagagaggagccttagccctggactccaaggtcctttccacttggtgatcagcactgagcacagaggactcaccatggagttggggctgagcttgggttttccttgttgttattttagaaggtgtccagtgtgaggtgcacgttggtggagtcgtgggggaggtcttggtccgagggcccggggggtccctggagactctcctgtgcagtctctggattccaccttagaagttattggatgaccgtgggtccnccgaggctccgaggggaagggctggaggtggggtggaccaaanaataaacgaaaggacggaagtacaaagaaaaacctgtagtaggaacttcgtaggttacgaaccgggtccgtaactttccaacctaatcctaccgaagaacgaacaaaccgaccaaagtacttacactgttaatttgacaaaagtgaaacagacctagaggaggacggaagaccgacggccgttagtattagttgtgcgacgagagtagagtacgtagactacgtanaagtacgcgaggtgtatggatttcg

SEQ ID NO: 371144 - DNA, 543 bp, Homo sapiens
  misc_feature: GZ8MTXP02HJN65.15.67.G01.1.454.CMB.2.raw
  modified_base (520)..(520): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgccaggctccgaggggaagggctggagtggggtggccaacataaaacaaagacggaagtacaagaaaaaacctatagtggaactctgtagaacgggccgaattcaccatctaccagagacaacgccaaagaattcactgtatttgacaaatgaaacagcctgagaggcgagacgacggccgtgtattattgtgcgcgagatgaatagacgactctanaagtagcgaggtgtatggtattg

SEQ ID NO: 371145 - DNA, 527 bp, Homo sapiens
  misc_feature: GZ8MTXP02IUWSF.15.67.G01.1.454.CMB.2.raw
  modified_base (340)..(340): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccggggggtccctgagactctcctgtgcagtctctggattcacccttagaagttattggatgacctgggtccgccaggctccaggggaaggggctggagtgggtggccaanataaaacaaagacggaagtcaagaaaaacctatgtggactctgtgacggccgattcaccatctccagagacaacgccaaagaattcactgtatttgacaaatgaaacagcctagagaggacgaggacacggccgtgtattatgtgcgcgagatgatagtagactctacaagtagcaggtgtatgatg

SEQ ID NO: 371146 - DNA, 530 bp, Homo sapiens
  misc_feature: GZ8MTXP02G76J6.15.67.G01.1.454.CMB.2.raw
  modified_base (411)..(411): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccaggggaaggggctggagtgggtggccaacataaaacaaagacggaagtcaagaaaaacctatgtggactctgtgacggcgattcaccatctccaganacaacgccaagaatcactgtatttgacaaatgaaacagcctgagaggcgaggacacggcgtgtattatgtgcgcgagatgatagtagactctaacaagtagctagggtgtatggattcg

SEQ ID NO: 371147 - DNA, 532 bp, Homo sapiens
  misc_feature: GZ8MTXP02INDL3.15.67.G01.1.454.CMB.2.raw
  modified_base (303)..(303): a, c, t, g, unknown or other
  modified_base (484)..(484): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccnccaggctccaggggaaggggctggagtgggtggccaaacataaacaaagacggaagtacagaaaaacctatgtggactctgtgacggcgattcaccatctccagagacaacgccaaagaattcactgtatttgacaaatgaaacagcctgagaggcgaggacacggccgtgtaattattgngcgcgagatgaatagtacactctaagaagtagacgtaggtgtatgatg

SEQ ID NO: 371148 - DNA, 531 bp, Homo sapiens
  misc_feature: GZ8MTXP02HMAOL.15.67.G01.1.454.CMB.2.raw
  modified_base (380)..(380): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcctgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccaggggaaggggctggagtggggtggccaacataaacaaagacgaagtcagaaaaacctatgtggactcngtgacggccgattcaccatctccagagacaacgccaaagaattcactgtatttgacaaatgaaacagcctgaagaggcgaggacacggccgtgtattattgtgcgcgagatgatagtagactctacaagtgacgaggtggtatggtattcg

SEQ ID NO: 371149 - DNA, 539 bp, Homo sapiens
  misc_feature: GZ8MTXP02HXB69.15.67.G01.1.454.CMB.2.raw
  modified_base (488)..(488): a, c, t, g, unknown or other
  modified_base (497)..(497): a, c, t, g, unknown or other
  modified_base (513)..(513): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttatggatgacctggtccgccaggctccgaggggaagggctggagtggggtggccaacataaaacaaagaacggaaagtcaagaaaaaacctatgtaggactctgtgacggccgattcaccatcaccagagacaaacgccaaagaattcactagtatttagacaaatgaaacagcctagagagcgagacacggctgtattattgngcgcgagangatagtacgactacanaagtacgacgtaggtagtatgtatcg

SEQ ID NO: 371150 - DNA, 549 bp, Homo sapiens
  misc_feature: GZ8MTXP02IYW43.15.67.G01.1.454.CMB.2.raw
  modified_base (325)..(325): a, c, t, g, unknown or other
  modified_base (438)..(438): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttcgtgtagtatttagaagtgtcagtgtgaggtgcattggtggagtctggggggagcttggtccagccggggggggtccctgagactctcctgtgcagtctctggattcacccttagaagttattggatgacctgggtccgccaggctcaggggagggctggagtgggngccaagataaacaaagacgaagacagaaaactaatagtagatctgtagacggaccgacttcaccactactaccagagacaacgaccaaagaatactactattattagtacaanagaacacgacgagagaggacggagacgacggacgtagtagttagtgtgcgacgagagtagtagtagtacgtactactacgtaagtagtacgtaggtaggtagtagtagtag

SEQ ID NO: 371151 - DNA, 524 bp, Homo sapiens
  misc_feature: GZ8MTXP02GOSCR.15.67.G01.1.454.CMB.2.raw
  modified_base (443)..(443): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttatggatgacctgggtccgccaggctccaggggaaggggctgggagtgggtggccaacataaacaaagacggaagtcagaaaaacctatgtggactctgtgacggcgattcaccatctccagagacaacgccaagatcactgtatttgcaaatgaaacngcctgagaggcgagacacggccgtgtattatgtgcgcgagatggatagtagactctaacaagtagcaggtggtactgattg

SEQ ID NO: 371152 - DNA, 539 bp, Homo sapiens
  misc_feature: GZ8MTXP02JJXX2.15.67.G01.1.454.CMB.2.raw
  modified_base (454)..(454): a, c, t, g, unknown or other
  modified_base (516)..(516): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctggagtgggtggccaaacataaaacaaagacggaagtacaagaaaaacctatgtgactctgtgacggccgattcaccatctccagagacaacgccaagaattcactgtaatttgacaaaatgaaacngcctaggagaggcgaggacacgggccgtgtattatgtgcgcgagatgatagtacgactctanaagtagcagggtgtatggattcg

SEQ ID NO: 371153 - DNA, 526 bp, Homo sapiens
  misc_feature: GZ8MTXP02G6OGW.15.67.G01.1.454.CMB.2.raw
  modified_base (505)..(505): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaagggctggagtgggtggccaacataaacaaagacggaaagtcaagaaaaacctatgtggactctgtgacggccgattcaccatctccagagacaacgccaagaattcactgtatttgacaaatgaaacagcctgagaggacgagacgacggcgtgtattatgtgcgcgagatgatagtagactcanaagtagcgaggtgtatggatg

SEQ ID NO: 371154 - DNA, 536 bp, Homo sapiens
  misc_feature: GZ8MTXP02F5SJF.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaaggggctggagtggggtggccaacataaaacaaagacggaaagtacaagaaaaacctatagtaggactctgtgacgggccgattcaccatctccagagacaaacgccaaagaattcactgtatttgacaaatgaaacagcctagagaggcgaggacacggccgtgtattatgtgcgcgagatgatagtagactctacaagtagcaggtgtatgatcg

SEQ ID NO: 371155 - DNA, 533 bp, Homo sapiens
  misc_feature: GZ8MTXP02F0ZM8.15.67.G01.1.454.CMB.2.raw
  modified_base (305)..(305): a, c, t, g, unknown or other
  modified_base (377)..(377): a, c, t, g, unknown or other
  modified_base (380)..(380): a, c, t, g, unknown or other
  modified_base (480)..(480): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagagttattggatgacctgggtccnccaggctccgaggggaaggggctgggagtggggtggccaacataaacaaagacggaagtcaagaaaaacctntgnggactctgtgacggccgattcaccatctcagagacaacgccaaagatcactgtattgacaaatgaaacagcctgagaggcgaggacacggcgtgtaattntgtgcgcgagatgatagtagactctaagaagtagacgaggtaggtagtagatg

SEQ ID NO: 371156 - DNA, 546 bp, Homo sapiens
  misc_feature: GZ8MTXP02H82L7.15.67.G01.1.454.CMB.2.raw
  modified_base (306)..(306): a, c, t, g, unknown or other
  modified_base (461)..(461): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttgggtccaggccgggggggtccctgagactctcctgtgcagtctctggattcacccttagaagttattggatgacctggggtccnccaggctccaggggaaggggctgggagtgggtggccaaacataaaacaaaagacggaagtacaagaaaaacctatgtaggactctgtgacgggccgattccacccatcctccagagacaacgccaaagaattcaactgtatttgcaaatgaaacngcctgagaggcgaggacacggccgtgattatgtgcgcgagatagatagtagactactacaagtagacgaggaggtagtgtagttg

SEQ ID NO: 371157 - DNA, 542 bp, Homo sapiens
  misc_feature: GZ8MTXP02GWLF5.15.67.G01.1.454.CMB.2.raw
  modified_base (519)..(519): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaaggggctgggagtggggtggccaacataaaacaaagacggaagtcaagaaaaacctatagtggactctgtgacggccgattcaccatctccagagacaacgccaaagattacactgtatttgacaaatgaaacagacctaggagagggacgaggaccgacggccgtggtattagttgtgcgcgagatgatacgagactntacaagtagcaggtgagtgattg

SEQ ID NO: 371158 - DNA, 538 bp, Homo sapiens
  misc_feature: GZ8MTXP02HB8IQ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccgaggggaaggggctggagtggggtggccaacataaaacaaagacggaagtcaagaaaaacctatgtggactctgtgacggccgattcaccatctccagagacaacgccaaagaattcactgtatttgacaaaatgaaacagcctagagaggcgaggacgacggccgtgtattatgtgcgcgagatgatagtagactctaacaagtagcgaggtagtatggattcg

SEQ ID NO: 371159 - DNA, 529 bp, Homo sapiens
  misc_feature: GZ8MTXP02HWUM6.15.67.G01.1.454.CMB.2.raw
  modified_base (403)..(403): a, c, t, g, unknown or other
  modified_base (408)..(408): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagaagttattggatgacctgggtccaccaggctccaggggaaggggctggagtgggtggccaacataaacaaagacggaagtcaagaaaaacctatgtggactctgtgacggcgattcaccatcncaganacaacgccaagaattcactgtatttgacaaatgaaacagacctgagaggcgaggacgacggcgtagtattatagtgcgtgagatgatagtagactctacaagtagacaggtgtatgtattg

SEQ ID NO: 371160 - DNA, 542 bp, Homo sapiens
  misc_feature: GZ8MTXP02HBB5O.15.67.G01.1.454.CMB.2.raw
  modified_base (524)..(524): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctggggtccgccaggctccaggggaaggggctggagtggggtggccaacataaacaaagacggaagtcaagaaaaacctatgtaggactctagtgacgggccgattcgaccatctccagacacaaacgccaaagaattcactgtaatttgacaaatgaaacagcctagagaggcgaggacacggccgtagtattattgtgcgcgaggatgatagagactctacaaggtancgaggtgtactggattgg

SEQ ID NO: 371161 - DNA, 534 bp, Homo sapiens
  misc_feature: GZ8MTXP02FXPL5.15.67.G01.1.454.CMB.2.raw
  modified_base (476)..(476): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctggagtgggtggccaacataaacaaagacggaagtacaagaaaaacctatgtaggactctgtgacgggccgattcaccatctccagagacaacgaccaaagaattcactgtatttgacaaaatgaaacagcctagacgaggacgagacncggcgtgtatatgtgcgagagatgatagagactctacaagtagcaggtgtatgattcg

SEQ ID NO: 371162 - DNA, 550 bp, Homo sapiens
  misc_feature: GZ8MTXP02F1I9G.15.67.G01.1.454.CMB.2.raw
  modified_base (377)..(377): a, c, t, g, unknown or other
  modified_base (407)..(407): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttgggtccaggccgggggggtccctgagactctcctgtgcagtctctggattcacccttagaagttattggatgacctgggtccgccaggctccaggggaaggggctgggagtggggtggccaaacataaacaaagacggaagtcaagaaaaacctntgtggactctgtgacggccgatcaccatcnccagagacaacgccaaagaattcactgtatttgcaaaatgaaacagcctagagaggacgaggacacggccgtgtattattgtgcgacgaggatggaataggtacgaacttctaaacgaagtacgacgtaggtgtagtgagtcg

SEQ ID NO: 371163 - DNA, 525 bp, Homo sapiens
  misc_feature: GZ8MTXP02HK0CD.15.67.G01.1.454.CMB.2.raw
  modified_base (403)..(403): a, c, t, g, unknown or other
  modified_base (479)..(479): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctggtccgccaggctccaggggaggggctggagtgggtggccaacataaaacaaagacggaaagtcaagaaaaaacctatgtggactctgtgacggccgatcaccatcncagagacaacgccaaagattcactgtatttgcaaatgaaacagcctgagaggcggagacacggcgtgtattattgngcgcgagatcgatagacgactctacaagtagcaggtgtatgattcg

SEQ ID NO: 371164 - DNA, 528 bp, Homo sapiens
  misc_feature: GZ8MTXP02FREIF.15.67.G01.1.454.CMB.2.raw
  modified_base (485)..(485): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctggagtggggtggccaaacataaaacaaagacggaaagtcaagaaaaacctatgtaggactctgtagacggcgattcaccatctcagagacaacgccaagattcactgtattgcaaatgaaacagcctgagagcgagacacggcgtgtatatgtgcgngagatgatacgtagactctacgaagtagcgaggtgtatgattg

SEQ ID NO: 371165 - DNA, 539 bp, Homo sapiens
  misc_feature: GZ8MTXP02IFABD.15.67.G01.1.454.CMB.2.raw
  modified_base (416)..(416): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcctgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctgggagtgggtggccaaacataaaacaaagacggaagtacaagaaaaacctatgtggactctgtgacgggccgattccaccatctcaganacaacgaccaagaattcactgtatttgacaaatgaaacagcctaggagaggcgaggacgacggcgtgtattatgtgcgcgagatgaatacgtagactcacaagtagacgaggtgtagtgattg

SEQ ID NO: 371166 - DNA, 581 bp, Homo sapiens
  misc_feature: GZ8MTXP02I57MY.15.67.G01.1.454.CMB.2.raw
  modified_base (168)..(168): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggggctgagcgtggtttcgtgtagtntttagaagtgtcagtgtgaggtgcattggtggagtctgggggagcttggtccaggccgggggggtccctgagactctcctgtgcagtctctggattcacccttagagttattggatgactggtcgccgagctccagggaaggggcgtggagtgggtggcgaacataaacaaagacggaaggtacaagaaaactaatagtggaacgtctgttagacgggaccggacttacaccaactctcccagacgaacaaacggacccgaaaacgtaactactactagttattagtaacaaataagaacgacgacgagaggaggacggacggacgacggacgtagtagttagttgtgcgacgagagtagtagtacgtacgtactacgtacgtaacgtagacgtacggtaggtagtagtagtg

SEQ ID NO: 371167 - DNA, 546 bp, Homo sapiens
  misc_feature: GZ8MTXP02IMZ9F.15.67.G01.1.454.CMB.2.raw
  modified_base (306)..(306): a, c, t, g, unknown or other
  modified_base (344)..(344): a, c, t, g, unknown or other
  modified_base (377)..(377): a, c, t, g, unknown or other
  modified_base (408)..(408): a, c, t, g, unknown or other
  modified_base (413)..(413): a, c, t, g, unknown or other
  modified_base (501)..(501): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttcttgttgttatttagaaggtgtccagtgtgaggtgcacttggtggagtcgtggggggaggcttggtccaggcccgggggggtccctggagactctcctgtgcagtctctggattcaccttagaagttattggatgacctgggtccncaggctccgaggggaagggctggagtgggtggccaaanataaaacaaagacggaagtacaagaaaaacctntgtggactctgtgacggcgattccaccatcncaganacaacgccaaagaattcactgtatttgactaaatgaaacagcctagagaggcggaaggacgacggcgtagtattattgtgacgtcganatgaagtacgtagaacttctaacaagtagctaggtgtactgattg

SEQ ID NO: 371168 - DNA, 529 bp, Homo sapiens
  misc_feature: GZ8MTXP02GUFCO.15.67.G01.1.454.CMB.2.raw
  modified_base (411)..(411): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccaggggaaggggctggagtggggtggccaacataaacaaagacggaagtcaagaaaaacctatgtggactctgtgacgggccgattcaccatctccaganacaacgccaaagaattcactgtatttgacaaatgaaacagcctagagaggcgagacacggcgtgtattattgtgcgacgagatgatagtagactctacaagtagcaggtgtatgattg

SEQ ID NO: 371169 - DNA, 849 bp, Homo sapiens
  misc_feature: GZ8MTXP02IYZRN.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccggggggtccctgagactctcctgtgcagtctcgtggtatcctaccctagaagttattggatcgacgtcgggtcccgccgacggtcctaccggaagggggaacggggtcgtaggggtagggtggggtaccggggacccaaaaccgtaaagttaaaaaaccgaaaacggggaaaccgggtaaacggttaccgaaaaacggtaaaaaaaacccttggtaggtacggggtaaccctttccgtaggttacgggaaccgggggtacccgtaactttacccgaaccctaagttcccctacccgaaaggaaacccgaaaccgaaaaccccggttaccccgaaaaaggtaaacccgtttacccgtaaacccttagggtttaaatttttacgggaaaacctaaaagttacgaaaaccgtaccggtacccgttaagggaaaggacggggaccggggaaagggtaaccccggaacccggggtccggttaagtttaaagtttagtttagggtacgcccgggacggtaaggtagtttaaggaagttaaacggggtaacgtaacccttaccgttaaaacgaagggttaaaccggacgtaagggggtttaacgtcgtaagggtaattttccggg

SEQ ID NO: 371170 - DNA, 566 bp, Homo sapiens
  misc_feature: GZ8MTXP02IQEAQ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggggtccctggagactctcctgtgcagtctctggattcacccttagaagttatggatgacctgggtccgccaggctccgaggggaaggggctggagtgggtggccaaacataaaacaaagaacggaagtacaagaaaaacctatagtaggactctggtagacggccgattcacccatctaccagacgaccaaacgacccaaagaattacacttgtatttagacaaatgaaacagcctagagaggacgagacgacggaccgtgtacttattggtgcgcgtagagtagatagtacgacttctaacaagtacgcgaaggtgtagtgacttgg

SEQ ID NO: 371171 - DNA, 527 bp, Homo sapiens
  misc_feature: GZ8MTXP02HWQE2.15.67.G01.1.454.CMB.2.raw
  modified_base (377)..(377): a, c, t, g, unknown or other
  modified_base (507)..(507): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttgggtccaggccggggggggtccctgagactctcctgtgcagtctctggattcacccttagaagttattggatgacctgggtccgccaggctccaggggaaggggctggagtggggtggccaacataaaacaaagacgaagtcaagaaaaacctangtggactctgtgacgcgatcaccatctccagagacaacgccaaagatcactgtatttgacaaatgaaacagcctgagaggcgagacacggccgtgtattattgtgcgcgagatgatacgtagactactanaagtagcagggtgtatgatg

SEQ ID NO: 371172 - DNA, 557 bp, Homo sapiens
  misc_feature: GZ8MTXP02GVY2T.15.67.G01.1.454.CMB.2.raw
  modified_base (380)..(380): a, c, t, g, unknown or other
  modified_base (468)..(468): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggattcacccttagaagttattggatgacctgggtccgccaggctccaggggaaggggctggagtgggtggccaaacataaaacaaagaacggaagtacaagaaaaaacctntagtaggactctgtagacgggcccgaattccaccatctaccagacgacaaccgaccaaagaattcactgtatttgacaaatagaaacngacctgagaggacgagaccacggaccgtgtattagtgtgcgcgagatgatacgtagactactacaagtagcgtagggtgtatcgagttg

SEQ ID NO: 371173 - DNA, 538 bp, Homo sapiens
  misc_feature: GZ8MTXP02I9NOR.15.67.G01.1.454.CMB.2.raw
  modified_base (372)..(372): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggggttttccttgttgttattttagaaggtgtccagtgtgaggtgcacttggtggagtctgggggaggcttggtccagccgggggggtccctgagactctcctgtgcagtctctggattcacccttagagttatggatgacctgggtccgccaggctccaggggaaggggctggagtggggtggccaacataaacaaagacggaagtcaagaaaaacctntgtggactctgtgacgggccgattcaccatctccagagacaacgaccaagaatacactgtattgacaaatagaaacagacctagagaggcgaggacgacggccgtgtattattgtgcgcgagatggggataggtagactctacgaagtagacgaggtggtatgatg

SEQ ID NO: 371174 - DNA, 536 bp, Homo sapiens
  misc_feature: GZ8MTXP02I8YC2.15.67.G01.1.454.CMB.2.raw
  modified_base (345)..(345): a, c, t, g, unknown or other
  modified_base (377)..(377): a, c, t, g, unknown or other
  modified_base (388)..(388): a, c, t, g, unknown or other
  modified_base (404)..(404): a, c, t, g, unknown or other
  modified_base (424)..(424): a, c, t, g, unknown or other
  modified_base (492)..(492): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttcctgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaagggctggagtggggtggccaaanataaaacaaagacggaatcaagaaaaacctangtagactctgngacggcatcaccatcncagagacaacgcaaagatanactgtatttgacaaatgaacaagcctagagaggcgaggacacggccgtagtattattgtgcgcgagangagtagtagactactaacaagagacgaggtaggtagtagtagtg

SEQ ID NO: 371175 - DNA, 528 bp, Homo sapiens
  misc_feature: GZ8MTXP02GZBN9.15.67.G01.1.454.CMB.2.raw
  modified_base (375)..(375): a, c, t, g, unknown or other
  modified_base (485)..(485): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggattcacccttagaagttattggatgacctgggtccgcaggctccaggggaggggctgggagtggggtggccaacataaacaaagacggaagtcaagaaaaacctntgtggactctgtgacggcgattcaccatctccagagacaacgccaaagaattcactgtatttgcaaatgaaacagcctgagagcgagacgacggcgtgtattatgtgcgngagatgatagtacgactctacaagtagcgaggtggtatgattg

SEQ ID NO: 371176 - DNA, 521 bp, Homo sapiens
  misc_feature: GZ8MTXP02HX53Q.15.67.G01.1.454.CMB.2.raw
  modified_base (401)..(401): a, c, t, g, unknown or other
  modified_base (404)..(404): a, c, t, g, unknown or other
  modified_base (482)..(482): a, c, t, g, unknown or other
  modified_base (499)..(499): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttatggatgacctggtccgccaggctccaggggagggctggagtgggtggccaacataaacaaagacggaagtcaagaaaaacctatagtggactctgtgacggccgattcaccatcncanagacaacgccaagatcactgtattgacaaatgaaacagacctgacgaggcgaggacacggccgtgtattatagtgcgngagatgatagtagactntacaagtagcaggtgtatgatg

SEQ ID NO: 371177 - DNA, 542 bp, Homo sapiens
  misc_feature: GZ8MTXP02FY0P6.15.67.G01.1.454.CMB.2.raw
  modified_base (507)..(507): a, c, t, g, unknown or other
  modified_base (520)..(520): a, c, t, g, unknown or other
  modified_base (526)..(526): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggggttttccttgttgttattttagaaggtgtccagtgtgaggtgcacttggtggagtctgggggaggcttgggtccaggccgggggggtccctgagactctcctgtgcagtctctggattcacccttagaagttattggatgacctggtccgccaggctccaggggaagggctggagtgggtggccaacataaacaaaagacggaaagtacaagaaaaacctatagtggaactctgtagacgggccgattcaccatctccagagacaacgccaaagaattcactgtatttgacaaaatgaaacagacctagagaggcgaggacacggccgtgtattagtgtgcgcgagatgaanagtagactctaanaagtanacgaggtgtatgattg

SEQ ID NO: 371178 - DNA, 546 bp, Homo sapiens
  misc_feature: GZ8MTXP02GYK0N.15.67.G01.1.454.CMB.2.raw
  modified_base (304)..(304): a, c, t, g, unknown or other
  modified_base (517)..(517): a, c, t, g, unknown or other
  modified_base (528)..(528): a, c, t, g, unknown or other
  modified_base (537)..(537): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccnccaggctccaggggaagggctggagtgggtggccaacgataaaacaaagacggaaagtacaagaaaaaacctatgtggaactctgtgacggccgattcaccatctccagagacaacgcctaaagaattcactgtatttgacaaatgaaacagcctagagaggacggaggactacggccgtagtattatgtgcgcgagatggatacgtagactntaacaagtagngagtggtanggaattcgg

SEQ ID NO: 371179 - DNA, 553 bp, Homo sapiens
  misc_feature: GZ8MTXP02G6618.15.67.G01.1.454.CMB.2.raw
  modified_base (488)..(488): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctggtccgccaggctccaggggaagggctggagtgggtggccaaacataaaacaaagacggaaagtacaaagaaaaaacctatagtaggaactctgtagacgggccgattccaccatctaccagagacaaacgccaaagaattcactgtatttagacaaatagaaacagacagagaggacgagacgacgacgngtattatgtgcgcgagatagagtagtagactactaacgaagtagacgaggtaggtagtagtagtg

SEQ ID NO: 371180 - DNA, 706 bp, Homo sapiens
  misc_feature: GZ8MTXP02I60Q8.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtccctgagactctcctgtgcagtctctggattcaccttagagttatggatgacctggtccgccaggctccgaggggaagggctgggaggtggggtcggaccaaacataaaacgaaaggaaccggaagtacaaagaaaaacctagtgtacggactcgtggtacggaaccgggccgtaactttccgaaccctacttcctacccgaacggaaacgaaaccaaaccgacccgaaaagtaaactttccaacttgttaatttagaactaaaatacgaaacacggccgtaggaaggacgggacgggaacgggaaccgtacggggtacccgtttaggttaacgttttagttgggtacgggaccggtacggtaaaggtacgtaggtaaagttaagggttaacgtaacctttaccgtaaacgtaacgggttaagacggttaacgggggtttggtaaactttcggtaagttttacgg

SEQ ID NO: 371181 - DNA, 532 bp, Homo sapiens
  misc_feature: GZ8MTXP02JHGI0.15.67.G01.1.454.CMB.2.raw
  modified_base (412)..(412): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggagcttggtccagccggggggtccctgagactctcctgtgcagtctctggattcaccccttagaagttattggatgacctgggtccgccaggctccaggggaaggggctggagtgggtggccaaacataaaacaaagacggaagtcaagaaaaaccctatgtggactctgtgacgggccgattcaccatctccaganacaacgccaagattcactgtatttgacaaatgaaacagcctgagaggcgagacgacggccgtgtattatgtgcgcgagatgatacgtagaactctaacaagtagcagggtgtatgattcg

SEQ ID NO: 371182 - DNA, 530 bp, Homo sapiens
  misc_feature: GZ8MTXP02J0X86.15.67.G01.1.454.CMB.2.raw
  modified_base (374)..(374): a, c, t, g, unknown or other
  modified_base (512)..(512): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccaggggaaggggctggagtggggtggccaaacataaacaaagacggaagtcaagaaaaacctntgtggactctgtgacggcgattcaccatctccagagacaacgccaaagaattcactgtatttgacaaatgaaacagcctaggagaggcggaggtacacggccgtgtattatgtgcgcgagatgatagtagactctacngtagcaggtgtatgatcg

SEQ ID NO: 371183 - DNA, 553 bp, Homo sapiens
  misc_feature: GZ8MTXP02I3Y4J.15.67.G01.1.454.CMB.2.raw
  modified_base (301)..(301): a, c, t, g, unknown or other
  modified_base (446)..(446): a, c, t, g, unknown or other
  modified_base (451)..(451): a, c, t, g, unknown or other
  modified_base (455)..(455): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttcctgtagttatttagaaggtgtccagtgtgaggtgcacttggtggagtcgtgggggaggcttggtccaggccgggggggtccctgagactctcctgtgcagtctctggattcaccctagaagttattggatgacctgggtccnccaggctccgaggggaaggggctgggaggtggggtggaccaacataaacaaagacggaaagtacaagaaaaacctatgtaggactctgtagacgggccgattcaccatctaccagagacaacgccaaagaattcactgtatttanacaanaganagcgagagaggacgaggacgacggcgtagtagttagtgtgcgacgagagtagagtagtacgtactactacgaagagacgtaggtaggtagtagtagtg

SEQ ID NO: 371184 - DNA, 560 bp, Homo sapiens
  misc_feature: GZ8MTXP02HBNVU.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgccaggctccaggggaaggggctggagtggggtggccaacataaaacaaagacggaaagtacaagaaaaaaccctatagtaggactctgtagaccgggccgattccaccatctaccagagacaaacgccaaagaattcactgtatttgacaaatagaaacagcctagagaggacggaaggacaacggccgtgttaattattgtgcgcgagatgaagtagtacgactcgtacaagtgacgagggttagagtgacttgg

SEQ ID NO: 371185 - DNA, 535 bp, Homo sapiens
  misc_feature: GZ8MTXP02JYQPY.15.67.G01.1.454.CMB.2.raw
  modified_base (514)..(514): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccaggccgggggggtccctgagactctcctgtgcagtctctggattcacccttagaagttattggatgacctgggtccgccaggctccaggggaaggggctggagtgggtggccaacataaacaaagacggaagtcaagaaaaacctatgtggaactctagtgacgggccgaattcaccatctccagacgacaacgccaaagattcactgtatttgcaaatgaaacagcctgagaggcgaggacacggccgtgtattattgtgcgcgagatgatagtagactctacngtagcgaggtggtatgattcg

SEQ ID NO: 371186 - DNA, 529 bp, Homo sapiens
  misc_feature: GZ8MTXP02F1JQ7.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaaggggctggagtggggtggccaacataaaacaaagacggaagtcaagaaaaacctatgtggactctgtgacggcgattcaccatctccagagacaacgccaaagattcactgtatttgacaaatgaaacagcctgagaggcgaggacacggcgtgtattatgtgcgcgagatgatagtagactctacaagtacgcgtaggtgtatgtatg

SEQ ID NO: 371187 - DNA, 529 bp, Homo sapiens
  misc_feature: GZ8MTXP02IRZD6.15.67.G01.1.454.CMB.2.raw
  modified_base (510)..(510): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttatggatgacctgggtccgccaggctccgaggggaaggggctggagtgggtggccaaacataaaacaaagacggaagtacaagaaaaacctatgtaggactctgtgacggccgatcaccatctccagagacaacgccaaagaattcactgtaatttgacaaatgaaacagcctagagaggcgagacacggcgtgtattatgtgcgcgagatgatagtagactctanaagtagcaggtgtatgatg

SEQ ID NO: 371188 - DNA, 538 bp, Homo sapiens
  misc_feature: GZ8MTXP02FP5V6.15.67.G01.1.454.CMB.2.raw
  modified_base (306)..(306): a, c, t, g, unknown or other
  modified_base (405)..(405): a, c, t, g, unknown or other
  modified_base (450)..(450): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagttattggatgacctgggtccncaggctccaggggagggctggagtgggtggccaaacataaaacaaagacgaagtacaagaaaaacctatgtagactcgtgtgacggccattcaccatcncagagacaaacgccaaagaattcactgtattgacaaatgaaacancctgacgaggcgaggacacggctagtattagtgtgccgagagatcgaatagtagactctaagaagtagcgaggtaggtatcggattcg

SEQ ID NO: 371189 - DNA, 550 bp, Homo sapiens
  misc_feature: GZ8MTXP02IE0TZ.15.67.G01.1.454.CMB.2.raw
  modified_base (298)..(298): a, c, t, g, unknown or other
  modified_base (317)..(317): a, c, t, g, unknown or other
  modified_base (323)..(323): a, c, t, g, unknown or other
  modified_base (430)..(430): a, c, t, g, unknown or other
  modified_base (432)..(432): a, c, t, g, unknown or other
  modified_base (435)..(435): a, c, t, g, unknown or other
  modified_base (444)..(444): a, c, t, g, unknown or other
tcagtctacgtagccacgaccggtgctcgatttagagtatacatattgggtttggggtctcagagaggagccttagccctggactccaaggcctttccacttggtgatcagcactgagcacagaggactcaccatggagttggggctgagcgtggtttcgtgtagtatttagaagtgtcagtgtgaggtgcacttggtggagtctgggggagcttggtccaggccggggggtccctgagactctcctgtgcagtctctggattcacccttagaagtattggatgctggtccgccagcnccaggaaggggcgtggggnggtggnggacgaacaataaacgaaagaacgaagacgaaagaaaactatagtagactctgtagacgcgtactacaccactctacagacacaacgacaacaatactatatattananaanagacagacngagagagagacgacgcgtagtagttattgtgcgacgacgagtagtagtaagtaacgtacgtacgtaacgtagtaagtacgtaggtaggtagtagtagttacgttcg

SEQ ID NO: 371190 - DNA, 540 bp, Homo sapiens
  misc_feature: GZ8MTXP02JYK9X.15.67.G01.1.454.CMB.2.raw
  modified_base (304)..(304): a, c, t, g, unknown or other
  modified_base (495)..(495): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccnccaggctccaggggaaggggctggaggtggggtggccaacataaaacaaagacggaagtcaagaaaaacctatgtggactctgtgacggccgattccaccatctccagagacaaacgccaaagaattcactgtatttgacaaatgaaacagcctgagaggcgagacacggcgtagtattatgtgcgcgagntagatacgtagactacagaagtacggacgtaggtagagtgtatcg

SEQ ID NO: 371191 - DNA, 537 bp, Homo sapiens
  misc_feature: GZ8MTXP02HLRVE.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccaggggaaggggctggagtgggtggccaacataaacaaagacggaaagtcaagaaaaacctatgtggactctgtgacggccgattcaccatctccagagacaacgccaagaattcactgtatttgacaaatgaaacagcctgagaggcgagacgacggcgtgtattattgtgcgcgagatgatacgtagactctaacaagtaaggcgtaggtgtagtgtacgtg

SEQ ID NO: 371192 - DNA, 539 bp, Homo sapiens
  misc_feature: GZ8MTXP02GH6US.15.67.G01.1.454.CMB.2.raw
  modified_base (375)..(375): a, c, t, g, unknown or other
  modified_base (488)..(488): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggggttttccttgttgttattttagaaggtgtccagtgtgaggtgcacttggtggagtctgggggaggcttggtccaggccggggggtccctgagactctcctgtgcagtctctggattcacccttagaagttattggatgacctgggtccgccaggctccaggggaaggggctggagtggggtggccaaacataaacaaagacggaagtcaagaaaaacctntgtggactctgtgacggccattcaccatctccagagacaacgcaagaatcactgtatttgcaaatgaaacagacctgagaggcgaaggacacggccgtgtattagttgtgcgngagatgagtacgacgtactactacaagtagacgtaggtggtagtagtatcg

SEQ ID NO: 371193 - DNA, 534 bp, Homo sapiens
  misc_feature: GZ8MTXP02G329E.15.67.G01.1.454.CMB.2.raw
  modified_base (488)..(488): a, c, t, g, unknown or other
  modified_base (508)..(508): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccaggggaaggggctggagtgggtggccaacataaaacaaagacggaaagtcagaaaaaacctatgtggactctgtgacggccgattcaccatctccagagacaacgccaagaattcactgtatttgacaaatgaaacagcctgagaggcgaggacaggccgtgtattatgtgcgcngatgatagtacgactctaanaagtagacgaggtagtagtagtagtg

SEQ ID NO: 371194 - DNA, 542 bp, Homo sapiens
  misc_feature: GZ8MTXP02GZDAG.15.67.G01.1.454.CMB.2.raw
  modified_base (318)..(318): a, c, t, g, unknown or other
  modified_base (324)..(324): a, c, t, g, unknown or other
  modified_base (336)..(336): a, c, t, g, unknown or other
  modified_base (430)..(430): a, c, t, g, unknown or other
  modified_base (434)..(434): a, c, t, g, unknown or other
  modified_base (436)..(436): a, c, t, g, unknown or other
  modified_base (438)..(438): a, c, t, g, unknown or other
  modified_base (441)..(441): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggttttctgtagtatttagaaggtgtcagtgtgaggtgcattggtggagtctgggggagcttggtccaggccggggggggtccctgagactctcctgtgcagtctctggattcaccttagaagttatggatgacctgggccgccaggctccgaggggaagggcgnggaggngggtggcaacanaaacaaagacggaagacaagaaaacctaatagtagactctgtgacggaccgattacaccatctccagagacaacacaacgaatacactatattntaanananaanagacagagagagagacgacgacgtagtagttagtgtgcgacgagagtagtagtaagtacgtactacgtaacgtaagtagacgtaggtaggtagtagtagtg

SEQ ID NO: 371195 - DNA, 533 bp, Homo sapiens
  misc_feature: GZ8MTXP02GY5H9.15.67.G01.1.454.CMB.2.raw
  modified_base (377)..(377): a, c, t, g, unknown or other
  modified_base (405)..(405): a, c, t, g, unknown or other
  modified_base (411)..(411): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccaggcccgggggggtccctggagactctcctgtgcagtctctggattcacccttagaagttattggatgacctgggtccgccaggctccgaggggaaggggctgggagtgggtggccaacataaacaaagacggaagtcaagaaaaacctntgtgactctgtgacggccatcaccatcnccaganacaacgcaagatcactgtattgacaaatgaaacagcctgagaggacgaggacgacggcgtagtattatgtgcgacgagatgatagtagactctacaagtacgacgtagggtagtagtgattg

SEQ ID NO: 371196 - DNA, 644 bp, Homo sapiens
  misc_feature: GZ8MTXP02JZWAL.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccggggggtccctgagactctcctgtgcgagtctcgtggtattccacccttagaagtttagttggatcgaccgtcgggtcccgccgaggcctccgagggggaacgggcgtgggaggtggggtcggacccaaacgaaataaaacgaaaggaacggtaaagtacgaaaagtaaaaacctagtaggtacggaacttcgtaggtacggaccgggccgtacttaccaccactcctaccgagaacgaaccaaccgacccaaagtaacttacacttgttaagtttcgaactaaattacgaaacacgaccgtaggaggacgggacggaacggaccgaccgggtccgtagttattagttggacgccgacgagatggaattaggacgactactaagaagtacgcgtagggtgtatacgatttgg

SEQ ID NO: 371197 - DNA, 528 bp, Homo sapiens
  misc_feature: GZ8MTXP02GPBTF.15.67.G01.1.454.CMB.2.raw
  modified_base (407)..(407): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccgaggggaggggctggagtgggtggccaacataaacaaagacggaagtcaagaaaaacctatgtgactctgtgacggcgattcacatctccaganacaacgcaaagatcactgtatttgacaaatgaaacagcctagagaggcggaggacacggccgtgtattattgtgcgtcgagatagatagtagactctacgaagtacgcaggtggatgattg

SEQ ID NO: 371198 - DNA, 637 bp, Homo sapiens
  misc_feature: GZ8MTXP02JX0BF.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacttggtggagtctgggggaggcttggtccagccgggggggtccctgagactctcctgtgcagtctctggattcacccttagaagttattggatgacctggtccgccaggctccagggaaggggctggagtggggtggccaaacataaaacaaaagacggaaagtcaagaaaaaaaccctatagtggaaccttctgtaggaccggccgacttaccaccatcctaccgaagaacgaaaccaaaccgaccaaaagtaaacttaactactagtatttagtaacaaactaacgaaacaacgtaccgtacggaaggagggacgggaacgggaaccgaaccgggtaccggttacggttaagtttaagttagtaggacggacggaaggagtagtaagtaagtaacgtactactaacgaacgtaagacgaggtaggtagtagtagtg

SEQ ID NO: 371199 - DNA, 658 bp, Homo sapiens
  misc_feature: GZ8MTXP02H8RRV.15.67.G01.1.454.CMB.2.raw
  modified_base (299)..(299): a, c, t, g, unknown or other
  modified_base (341)..(341): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggtttcttgttagttatttagaaggtgtcagtgtgaggtgcacttggtggagtctgggggaggcttggtccaggccggggggtcctgagactctcctgtgcagtctctggattcacccttagaagttatggatgacctgggtccnccaggctccgaggggaagggctggaggtgggtggaccaaaanaaataaaacgaaaggaacggaaagtacaaaagtaaaaaaacctagtaggtacgaacttcgtaggtacggaccggaccggtaacttacctacctaactacctaccaacgaacgaaacgaaaccgaaccgaaacgtaaactaactaacttagttaagtttagtaactaaataagaaacgaacgtaccgtaggaaggagggacggaacgggaacggaaccggaccggtacggttaagtttaagtttagtaggtacggtacggagagtagtagtaagtacgtactactaacgtaagtagacgtaggtaggtagtagtagtg

SEQ ID NO: 371200 - DNA, 529 bp, Homo sapiens
  misc_feature: GZ8MTXP02HT2HR.15.67.G01.1.454.CMB.2.raw
  modified_base (304)..(304): a, c, t, g, unknown or other
  modified_base (375)..(375): a, c, t, g, unknown or other
  modified_base (509)..(509): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccncaggctccgaggggaggggctgggagtgggtggccaacataaaacaaagacggaaagtcaagaaaaacctntgtggactctgtgacggccgattcaccatctcagagacaacgccaaagaattcactgtatttgacaaatgaacagcctgagaggcgaggacacggccgtggtattagtgtgcgcgagatgatagtacgactcanaagtagcaggtgtatgatcg

SEQ ID NO: 371201 - DNA, 529 bp, Homo sapiens
  misc_feature: GZ8MTXP02IUIHJ.15.67.G01.1.454.CMB.2.raw
  modified_base (374)..(374): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggggttttccttgttgttattttagaaggtgtccagtgtgaggtgcacttggtggagtctgggggaggcttggtccagccggggggtccctgagactctcctgtgcagtctctggattcacccttagaagttattggatgacctgggtccgccaggctccaggggaaggggctggagtggggtggccaaacataaaacaaagacggaagtcagaaaaacctntgtggactctgtgacggccgattcaccatctccagagacaacgccaaagaattcactgtatttgacaaatgaaacagcctagagaggcgagacacggcgtgtattatgtgcgcgagatgatagtagactctaacaagtagcgaggtgtatgattg

SEQ ID NO: 371202 - DNA, 563 bp, Homo sapiens
  misc_feature: GZ8MTXP02HW688.15.67.G01.1.454.CMB.2.raw
  modified_base (303)..(303): a, c, t, g, unknown or other
  modified_base (462)..(462): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttatggatgacctgggtccnccaggctccaggggagggctggagtgggtggccaacataaaacaaagacggaagtacaagaaaaacctatagtggaactctgtgacgggccgattccaccatctccagagacaacgccaagaatcactgtatttgacaaatgaaacagcctagagaggngaggacacgggccgtgtattattgtagcggtacgaggatggattaacgttagaacctattaacgaaggttagacgtaggggtaggtaactggtaactttgg

SEQ ID NO: 371203 - DNA, 530 bp, Homo sapiens
  misc_feature: GZ8MTXP02J0CNV.15.67.G01.1.454.CMB.2.raw
  modified_base (485)..(485): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttgggtccaggccgggggggtccctgagactctcctgtgcagtctctggattcacccttagaagttattggatgacctgggtccgccaggctccgaggggaaggggctggagtggggtggccaacataaacaaagacggaagtcaagaaaaacctatgtggactctgtgacggcgatcaccatctcagagacaacgccaaagattcactgtatttgacaaatgaaacagctagagaggcgaggacacggctgtattagtgtgcgngagatgatagtagactctacgaagttagcgaggtgtatggattcg

SEQ ID NO: 371204 - DNA, 584 bp, Homo sapiens
  misc_feature: GZ8MTXP02F6EUR.15.67.G01.1.454.CMB.2.raw
  modified_base (455)..(455): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaagtgtccagtgtgaggtgcacttggtggagtctggggggaggcttggtccaggccgggggggtccctgagactctcctgtgcagtctctggattcacccttagagttattggatgacctgggtccgccaggctccaggggaagggctggagtggggtggccaacataaaacaaagacggaagtacaagaaaaacctatagtgactctgtagacgggccgattcacccatctccagagacaaacgccaaagaattcactgtatttagacaaaatgaaanagacctagaggaggaccggaggaaccgtacggaccggtagttaagttattggtgccgacgaaggattacggattaaaggtacgactaccttaacgaagttagacgagggttaggaattggaagtttcgg

SEQ ID NO: 371205 - DNA, 536 bp, Homo sapiens
  misc_feature: GZ8MTXP02JE9BO.15.67.G01.1.454.CMB.2.raw
  modified_base (413)..(413): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccaggggaaggggctggagtggggtggccaacataaacaaagacggaagtcaagaaaaacctatagtggactctgtgacggccgattcaccatctccaganacaacgccaagaattcactgtatttgacaaatgaaacagcctgagaggcgaggacgacggcgtgtattattgtgcgcgtagatgatacgtagactcgtacaagtagacgaggtgtatgagtcg

SEQ ID NO: 371206 - DNA, 535 bp, Homo sapiens
  misc_feature: GZ8MTXP02HV8KV.15.67.G01.1.454.CMB.2.raw
  modified_base (344)..(344): a, c, t, g, unknown or other
  modified_base (412)..(412): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccaggggaggggctggagtggggtggccaaanataaaacaaagacggaagtcaagaaaacctatgtggactctgtgacgggcgattcaccatctccaganacaacgcaagaattcactgtatttgacaaatgaaacagcctagagaggcgaggacacggccgtggtattagtgtgcgtcgagatgatagtagactacacaagtagacgaggtggtactgattg

SEQ ID NO: 371207 - DNA, 529 bp, Homo sapiens
  misc_feature: GZ8MTXP02HU3L4.15.67.G01.1.454.CMB.2.raw
  modified_base (492)..(492): a, c, t, g, unknown or other
  modified_base (507)..(507): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaaggggctggagtgggtggccaaacataaaacaaaagacggaagtcagaaaaacctatagtggactctgtgacgggccgattcaccatctccagagacaacgcaagattcactgtattgacaaatgaaactagcctgagaggcgagacacggccgtgtattatgtgcgcgagangatagtagactctanaagtagcgtaggtgtatgtatg

SEQ ID NO: 371208 - DNA, 533 bp, Homo sapiens
  misc_feature: GZ8MTXP02GGI1K.15.67.G01.1.454.CMB.2.raw
  modified_base (505)..(505): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctggagtgggtggccaaacataaacaaagacggaaagtcaagaaaaacctatagtggactctgtgacggcgattcaccatctccagagacaacgccaagaattcactgtatttgacaaatgaaacagcctgagaggcgagacacggcgtgtatatgtgcgcgagatgatacgtagactntacaaggtagacgagggtgtatggattg

SEQ ID NO: 371209 - DNA, 570 bp, Homo sapiens
  misc_feature: GZ8MTXP02HO6PS.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgaggcccggggggtccctggagactctcctgtgcagtctctggattcacccttagaagttatggatgacctggtccgcaggctccgaggggaaggggctggaggtggggtggccaaacaataaaacaaagaacggaagtacaaagaaaaaacctatagtggactcgtgtagacggccgattcaccatctaccagagacaacgaccaagaatcactgttatttagactaaatagaaacagacctagagaggacggaaggacgacggccgtagtattaattgtagcgcgagagtagagtaacgtagactacaacgtaagtacgacgaggtagtatgtagttcg

SEQ ID NO: 371210 - DNA, 552 bp, Homo sapiens
  misc_feature: GZ8MTXP02F26PZ.15.67.G01.1.454.CMB.2.raw
  modified_base (376)..(376): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacttggtggagtctggggggaggcttgggtccaggccgggggggtccctgagactctcctgtgcagtctctggattcacccttagaagttattggatgacctgggtccgccaggctccaggggaaggggctggagtgggtggccaaacataaacaaagacggaagtcagaaaaacctngtggactctgtgacggccgaattcaccatctccagagacaacgaccaaagaattcactgtatttagacaaatagaaacagacctgagaggacggaggacgacggccgtgtagttagtgtgcgcgagagtagatagtagtactcttacgaagtacgacgaggtaggtagtagagttg

SEQ ID NO: 371211 - DNA, 532 bp, Homo sapiens
  misc_feature: GZ8MTXP02GM10F.15.67.G01.1.454.CMB.2.raw
  modified_base (511)..(511): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcacctatggagttggggctgagctgggttttccttgttgttattttagaaggtgtccagtgtgaggtgcacttggtggagtcgtgggggaggcttggtccaggccgggggggtcctgagactctcctgtgcagtctctggattcacccttagaagttattggatgacctgggtccgccaggctccaggggaaggggctggagtgggtggccaacataaaacaaagacggaaagtcaagaaaaacctatagtggactctgtgacggccgattcaccatctccagagacaaacgcaaagaattcactgtatttgacaaatgaaacagcctgagaggcgaggacacggcgtgtattatgtgctcgagatgatagtacgactctanaagtagcgaggtgtatgattg

SEQ ID NO: 371212 - DNA, 545 bp, Homo sapiens
  misc_feature: GZ8MTXP02HM7UH.15.67.G01.1.454.CMB.2.raw
  modified_base (346)..(346): a, c, t, g, unknown or other
  modified_base (376)..(376): a, c, t, g, unknown or other
  modified_base (386)..(386): a, c, t, g, unknown or other
  modified_base (406)..(406): a, c, t, g, unknown or other
  modified_base (411)..(411): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccagggcccgggggggtccctggagactctcctgtgcagtctctggattcaccccttagaagttattggatgacctgggtccgccaggctccgaggggagggctggagtgggtgccaanataaacaaagacgaagtcaagaaaaacctntgtggactcngtagacggcgatcaccatcncaganacacgccaagattcactgtattcgacaaatgaaacacgcctagagaggacggaggacgacggccgtagtattagtgtgcgacgagatagatagtacgacgtactacaagtagacgtagggtgtaatggatttgg

SEQ ID NO: 371213 - DNA, 533 bp, Homo sapiens
  misc_feature: GZ8MTXP02G8IHN.15.67.G01.1.454.CMB.2.raw
  modified_base (344)..(344): a, c, t, g, unknown or other
  modified_base (406)..(406): a, c, t, g, unknown or other
  modified_base (411)..(411): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttgggtccaggccgggggggtccctgagactctcctgtgcagtctctggattcacccttagaagttattggatgacctgggtccgcaggctccaggggaaggggctgggagtggggtggccaanataaacgaaagacggaagtacaagaaaaacctatgtggactctgtagacggcgatcacatcncaganacacgcaagaatcactgtattgacaaatgaaacagacctagagaggcggaagacgacggccgtagtattattgtgcgcgagatgatagtagactctacgaagtagcgaggtgtatggtatcg

SEQ ID NO: 371214 - DNA, 547 bp, Homo sapiens
  misc_feature: GZ8MTXP02F6A5D.15.67.G01.1.454.CMB.2.raw
  modified_base (416)..(416): a, c, t, g, unknown or other
  modified_base (451)..(451): a, c, t, g, unknown or other
  modified_base (494)..(494): a, c, t, g, unknown or other
  modified_base (522)..(522): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagttattggatgacctgggtcccgccaggctccaggggaaggggctggagtggggtggccaaacataaaacaaagacggaagtacaagaaaaacctagtgtaggactctgtgacggcgattcaccatctccanacgacaacgccaaagattcactgtattgacaaatnaaacagcctagagaggacgaggacacggccgtgtattagttgngtcgcgagatgaataggagtactctaanaagtagcgtagggtgtaatgtattg

SEQ ID NO: 371215 - DNA, 533 bp, Homo sapiens
  misc_feature: GZ8MTXP02J2GG7.15.67.G01.1.454.CMB.2.raw
  modified_base (518)..(518): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccaggccgggggggtccctgagactctcctgtgcagtctctggattcacccttagaagttattggatgacctgggtccgccaggctccaggggaaggggctggagtgggtggccaacataaacaaagacggaagtacagaaaaacctatgtggactctgtgacggcgattcaccatctccagagacaacgccaaagaatcactgtaatttgacaaatgaaacagcctagagagcgaggacacggcgtgtattatgtgcgcgagatgaataggtacgactctaacaagtacngaggtgtaactgatg

SEQ ID NO: 371216 - DNA, 534 bp, Homo sapiens
  misc_feature: GZ8MTXP02IK2CA.15.67.G01.1.454.CMB.2.raw
  modified_base (305)..(305): a, c, t, g, unknown or other
  modified_base (339)..(339): a, c, t, g, unknown or other
  modified_base (370)..(370): a, c, t, g, unknown or other
  modified_base (378)..(378): a, c, t, g, unknown or other
  modified_base (398)..(398): a, c, t, g, unknown or other
  modified_base (527)..(527): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtccagtgtgaggtgcacttggtggagtcgtgggggaggcttggtccaggccgggggggtccctggagactctcctgtgcagtctctggattcacccttagaagttattggatgacctgggtccncaggctccgaggggagggctggagtgggtgcaanataaacaaagacgaagtcaagaaaaacctangtggactntgtgacgcgattcaccatcncagagacaacgccaagatcactgtatttgacaaatgaaacagacctagaagaggacgaggacgacggaccgtgtagttattgtgcgcgaagatgatagtacgacttactacaagtagacgagtggtaangtagtcg

SEQ ID NO: 371217 - DNA, 553 bp, Homo sapiens
  misc_feature: GZ8MTXP02GJ2KL.15.67.G01.1.454.CMB.2.raw
  modified_base (278)..(278): a, c, t, g, unknown or other
  modified_base (347)..(347): a, c, t, g, unknown or other
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccggcaagtcaggacattagaactgacttaggttggtatcagcagaaatccgggaaancccctaagctcctgatctgtgctgcatccaactttacaaaggtcgggtccccatcaaggttcagcggcnggtgatctggcacgagtactttcactctcaccatcagcagcctgcagcctgaacgtatttcgactaactttattacctgtactacaatatttaacaacttacccgtcggtacgtttcgggacccgaagggggaaccctaaaggggttaacggaaaacgttaaccgaaaaacgtaaacgttggtacggtcgtacggacctaactacg

SEQ ID NO: 371218 - DNA, 540 bp, Homo sapiens
  misc_feature: GZ8MTXP02HQLV1.15.67.G01.1.454.CMB.2.raw
  modified_base (498)..(498): a, c, t, g, unknown or other
  modified_base (519)..(519): a, c, t, g, unknown or other
  modified_base (534)..(534): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccaggcccggggggggtccctggagactctcctgtgcagtctctggattcacccttagaagttatggatgacctgggtccgccaggctccgaggggaaggggctggagtgggtggccaaacataaaacaaagacggaagtcaagaaaacctatgtggactctgtgacggccgattcaccatctccagagacaacgccaaagattcactgtatttgacaaatgaaacagcctaggagagggcgaaggacacggccgtgtattagtgtgccgngaggatgatagacgactctanaagtgcaggtggtangattcg

SEQ ID NO: 371219 - DNA, 550 bp, Homo sapiens
  misc_feature: GZ8MTXP02H8CIO.15.67.G01.1.454.CMB.2.raw
  modified_base (344)..(344): a, c, t, g, unknown or other
  modified_base (413)..(413): a, c, t, g, unknown or other
  modified_base (524)..(524): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtcctgagactctcctgtgcagtctctggattcacccttagaagttattggatgacctgggtccgccaggctccaggggaaggggctggagtgggtggccaaanataaaacaaagacggaaagtcaagaaaaaccatgtggactctgtgacggccgaattccaccatctccanacgacaacgccaaagaatcactgtatttgacaaatgaaacagcctagacgaggcgaggacaacgggccgtagtatttatgtgccgtagagatgaataggtacgacttcaanaagtagacagggtgtataggtattgg

SEQ ID NO: 371220 - DNA, 529 bp, Homo sapiens
  misc_feature: GZ8MTXP02FKAEB.15.67.G01.1.454.CMB.2.raw
  modified_base (278)..(278): a, c, t, g, unknown or other
  modified_base (344)..(344): a, c, t, g, unknown or other
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccggggcaagtcaggacattagactgacttaggttggtatcagcagaaatccggaaancccctaagctcctgatctgtgctgcatccactttacaaagtggggtccccatcaagttcagcggcngtgatctgcacagatttcactctcacatcagcagcctgcacgcctgaagtatttcgactaaacttattactgtactacaaagtattaactaacttacccgtcggtacgttcggaccgaaggggacccgtaagggtacggaaaagtaccgaaaacgaaacgtggtacgaccgtacgccacctaacg

SEQ ID NO: 371221 - DNA, 530 bp, Homo sapiens
  misc_feature: GZ8MTXP02H3XTJ.15.67.G01.1.454.CMB.2.raw
  modified_base (339)..(339): a, c, t, g, unknown or other
  modified_base (407)..(407): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggatcacccttagaagttattggatgacctgggtccgcaggctccaggggaaggggctggagtgggtggccaanataaaacaaagacggaaagtcaagaaaaacctatgtggactctgtgacggccgattcaccatctccanagacaacgccaagaaatcactgtatttgcaaatagaacagcctgagaggcgaggacacggctgtattattgtgcgcgagatgatagtagactactacaagtagacgaggtaggtagtagtatg

SEQ ID NO: 371222 - DNA, 532 bp, Homo sapiens
  misc_feature: GZ8MTXP02I4Z6P.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagagttattggatgacctgggtccgccaggctccaggggaaggggctggagtgggtggccaacataaacaaagaacggaagtcaagaaaaacctatgtggactctgtgacggccgattcaccatctccagagacaacgaccaaagaattcactgtaatttgacaaatgaaacagcctgagaggcgaggacacggccgtgtattattgtgcgcgtagatgatacgtagactctacaagtagcaggtgagtgagtg

SEQ ID NO: 371223 - DNA, 551 bp, Homo sapiens
  misc_feature: GZ8MTXP02HPC55.15.67.G01.1.454.CMB.2.raw
  modified_base (410)..(410): a, c, t, g, unknown or other
  modified_base (451)..(451): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccaggcccggggggggtccctgagactctcctgtgcagtctctggattcacccttagaagttattggatgacctggtccgccaggctccgaggggaaggggctggagtgggtggccaaacataaaacaaagacggaagtcaagaaaaacctatagtggactctgtgacggccgatcaccatcncagagacaacgcaaagatcactgtatttgacaaatgaaacngacctgagaggcgaaggacacggcgtagtattattgtgcggacgagagtagtagtagtacgtactactacgtaagtagacgtaggtaggtagtagtagtg

SEQ ID NO: 371224 - DNA, 532 bp, Homo sapiens
  misc_feature: GZ8MTXP02IQEJX.15.67.G01.1.454.CMB.2.raw
  modified_base (343)..(343): a, c, t, g, unknown or other
  modified_base (410)..(410): a, c, t, g, unknown or other
  modified_base (491)..(491): a, c, t, g, unknown or other
  modified_base (509)..(509): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttgggtccaggccgggggggtccctgagactctcctgtgcagtctctggattcacccttagagttatggatgacctgggtccgccaggctccgaggggaaggggctggagtgggtggccaaanataaacaaagacggaagtcaagaaaaacctatgtggactctgtgacggcgattcaccatctccaganacaacgccaagaattcactgtatttgacaaatgaaacagcctagagaggcgagacacggcgtgtattatgtgcgcgagtangatacgtagactcctaanaagtagacgaggtgtatgacttg

SEQ ID NO: 371225 - DNA, 534 bp, Homo sapiens
  misc_feature: GZ8MTXP02JRBDY.15.67.G01.1.454.CMB.2.raw
  modified_base (387)..(387): a, c, t, g, unknown or other
  modified_base (414)..(414): a, c, t, g, unknown or other
  modified_base (450)..(450): a, c, t, g, unknown or other
  modified_base (487)..(487): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctgagactctcctgtgcagtctctggattcacccttagagttattggatgacctgggtccgccaggctccaggggaaggggcgtggagtgggtggccaacataaaacaaagacggaagtcaagaaaaacctatagtggactcngtgacggccgattcaccatctccaganacaacgcaagaatcactgtatttgacaaatgaaacngcctgagaggcgaggacacggcgtgtattatgtgcgngagatgaatagtaacgactctaacaagtagcgagggtgtagtgattg

SEQ ID NO: 371226 - DNA, 531 bp, Homo sapiens
  misc_feature: GZ8MTXP02F0BOO.15.67.G01.1.454.CMB.2.raw
  modified_base (452)..(452): a, c, t, g, unknown or other
  modified_base (506)..(506): a, c, t, g, unknown or other
  modified_base (510)..(510): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaaggggctggagtgggtggccaaacataaaacaaagacggaagtcagaaaaaacctatgtggactctgtgacggccgattcaccatctccagagacaaacgccaaagaattcactgtatttgcaaaatgaacancctgagaggcgaggacacggcgtgtattatgtgcgcgagatgaatacgtagacnctanaagtagcgtaggtgtatgatg

SEQ ID NO: 371227 - DNA, 559 bp, Homo sapiens
  misc_feature: GZ8MTXP02IPQ23.15.67.G01.1.454.CMB.2.raw
  modified_base (505)..(505): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctgggagtggggtggccaaacataaacaaagacggaagtacaagaaaaacctatgtaggactctgtgaccgggccgattccaccatctccagagacaacgaccaaagaattcacttgtaatttgacaaaatgaaacacgacctggagaggacggaaggacgacggcgtgtaatgttagngcgcgagatggaatagtagacctatacaagtacgacgaggtagtaagtgagttg

SEQ ID NO: 371228 - DNA, 544 bp, Homo sapiens
  misc_feature: GZ8MTXP02HGIDG.15.67.G01.1.454.CMB.2.raw
  modified_base (384)..(384): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggattcacccttagaagttatggatgacctgggtccgccaggctccaggggaaggggctggagtgggtggccaaacataaaacaaagacggaagtcagaaaaacctatgtggactntgtagacggccgattcacatctccagagaacacgaccaagaatacactatattgacaaatagtaacagacctgagaggacggaggacgacggccgtagtagttattgtgcgcgagagtgatagtacgactctacaagtagacgtaggtaggtatgtattg

SEQ ID NO: 371229 - DNA, 540 bp, Homo sapiens
  misc_feature: GZ8MTXP02HZPUI.15.67.G01.1.454.CMB.2.raw
  modified_base (416)..(416): a, c, t, g, unknown or other
  modified_base (421)..(421): a, c, t, g, unknown or other
  modified_base (494)..(494): a, c, t, g, unknown or other
  modified_base (517)..(517): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacttggtggagtcgtgggggaggcgttggtccgagggcccgggggggtccctggacgactctcctgtgcagtctctggattccacccttagaagttatggatgacctgggtccgcaggctccgaggggaagggctggagtgggtggaccaaacaataaaacaaagaacggaagtacaaagaaaaacctatgtaggactctgtagacgcgatcacatcncaganacaacgccaagatcactgtatttagacaatagaacagcctagagagcgagacaacggcgtagtatattgagcngagatagatagtacgactactanaagtagacaggtgtatgtatcgg

SEQ ID NO: 371230 - DNA, 537 bp, Homo sapiens
  misc_feature: GZ8MTXP02JOEW3.15.67.G01.1.454.CMB.2.raw
  modified_base (418)..(418): a, c, t, g, unknown or other
  modified_base (515)..(515): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctggagactctcctgtgcagtctctggattcacccttagaagttattggatgacctgggtccgccaggctccgaggggaaggggctgggagtggggtggccaacataaaacaaagacggaagtcaagaaaaacctatgtggactctgtgacggccgattccaccatctccaganacaacgcaagaattcactgtatttgacaaatgaaacagcctagagaggcgaggacacggccgtgtattatgtgcgcgagatagatagacgactcacngtacgcgtaggtgtatcgattg

SEQ ID NO: 371231 - DNA, 556 bp, Homo sapiens
  misc_feature: GZ8MTXP02GD6RI.15.67.G01.1.454.CMB.2.raw
  modified_base (418)..(418): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgccaggctccgaggggaggggctgggagtgggtggccaaacataaaacgaaagacggaagtacaagaaaaacctatgtaggactctgtacgacggccgattcaccatctccaganacaacgacaaagatcactgtatttgacaaatgaaacagacctagaggacggacggaagaccgacggtcgtagtattatgtgcgacgagatagatagtacgacttactacgaagtagacgtagggtgtagtagtagttg

SEQ ID NO: 371232 - DNA, 537 bp, Homo sapiens
  misc_feature: GZ8MTXP02JHCTI.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggattcacccttagaagttattggatgacctgggtccgccaggctccaggggaaggggctggagtggggtggccaacataaacaaagacggaagtcaagaaaaacctatgtagactctgtgacggccgattcaccatctaccagacgacaacgaccaagaattcactgtatttgacaaatgaacagcctagagaggcgagacgacggcgtgtattattgtgcgcgagagtgatagtagactctacgaagtacgcagggtgtatgagttg

SEQ ID NO: 371233 - DNA, 543 bp, Homo sapiens
  misc_feature: GZ8MTXP02G6FQP.15.67.G01.1.454.CMB.2.raw
  modified_base (376)..(376): a, c, t, g, unknown or other
  modified_base (379)..(379): a, c, t, g, unknown or other
  modified_base (413)..(413): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccgaggggaaggggctgggagtggggtggccaacataaacaaagacggaagtcaagaaaaacctntgnggactctgtgacggccgattcaccatctccaganacaacgcaagaattcactgtatttgacaaatgaaacagacctgagaggacggaggacacggccgtagtattattgtgcgcgagatgaatagtacgactctaacaaggtagcgtaggtggtatcgattcgg

SEQ ID NO: 371234 - DNA, 557 bp, Homo sapiens
  misc_feature: GZ8MTXP02I8HD3.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggattcacccttagagttatggatgacctgggtccgcaggctccaggggaaggggctggagtgggtggccaaacgataaaacaaagacggaagtacaagaaaaacctatgtggactctgtgacggccgattcaccatctccagacacaacgccaaagaattcactgtatttagacaaaatgaaacagccgtagagaggacgaggtacgacggaccgtagtattattgtgacgtcggagatgaatagtacgacgtactaacgaagtacgacgtaggtagtatgacgttgg

SEQ ID NO: 371235 - DNA, 598 bp, Homo sapiens
  misc_feature: GZ8MTXP02I0BXU.15.67.G01.1.454.CMB.2.raw
  modified_base (575)..(575): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgaccgtgggtccgccaggctccgaggggaaggggcgtgggaggtggggtggaccaaacaataaaacgaaaaggaacggaaagtacgaaaggaaaaaacctagtagtaggaactctaggtaggaaccgggccgaattccaaccatcctaccaagaacgaaccaaacgacccaaaagaattacacttagtaatttagacaaaatagaaacagacctaggagagggacgaaggaccgacggccgtgtattagttgtgcgacgagatggaatacgtagactctaanaagtacgcgaggtgtagtgatcg

SEQ ID NO: 371236 - DNA, 526 bp, Homo sapiens
  misc_feature: GZ8MTXP02ICBBS.15.67.G01.1.454.CMB.2.raw
  modified_base (403)..(403): a, c, t, g, unknown or other
  modified_base (445)..(445): a, c, t, g, unknown or other
  modified_base (482)..(482): a, c, t, g, unknown or other
  modified_base (485)..(485): a, c, t, g, unknown or other
  modified_base (502)..(502): a, c, t, g, unknown or other
  modified_base (510)..(510): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagctctcctgtgcagtctctggattcacccttagaagttattggatgacctgggtccgccaggctccgaggggaaggggctgggagtggggtggccaacataaacaaagacggaagtacaagaaaacctatgtgactctgtgacggccattcaccatcncagagacaacgccaagaatcactgtatttgacaaatgaaacngcctagagaggcgaggacacggctgtattatgtgcgnganatgaatagtagaccttnacaagtancgaggtgtactgatcg

SEQ ID NO: 371237 - DNA, 528 bp, Homo sapiens
  misc_feature: GZ8MTXP02IXHLM.15.67.G01.1.454.CMB.2.raw
  modified_base (303)..(303): a, c, t, g, unknown or other
  modified_base (370)..(370): a, c, t, g, unknown or other
  modified_base (507)..(507): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggggttttccttgttgttattttagaaggtgtccagtgtgaggtgcacttggtggagtctgggggaggcttggtccaggccgggggggtccctgagactctcctgtgcagtctctggattcacccttagagttattggatgacctgggtcnccaggctccaggggagggctggagtgggtggccaacataaacaaagacggaagtcaagaaaaacctntgtggactctgtgacggccgattcaccatctcagagacaacgcaaagaattcactgtatttgacaaatgaaacagcctagagaggcgagacgacggccgtgtattattgtgcgcgagatgatacgtagactctaacngtagctaggtggtatgacttg

SEQ ID NO: 371238 - DNA, 555 bp, Homo sapiens
  misc_feature: GZ8MTXP02I5REJ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctggagactctcctgtgcagtctctggattcacccttagagttatggatgacctgggtccgccaggctccgaggggaaggggctgggagtggggtggccaaacataaaacaaagacggaagtcaagaaaaacctatgtggactctgtgacggccgattccaccatctccagagacaacgccaaagaattcactgtatttgcaaaatgaaacagcctagagagggacgaggacacggaccgtggtaacttagttcgtgccgcggagatggaatacggtagacgtctaacaagttagcaggtggtatggacttgg

SEQ ID NO: 371239 - DNA, 611 bp, Homo sapiens
  misc_feature: GZ8MTXP02GH0ZM.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctggtccgccaggctccaggggaaggggcgtggaggtggggtggaccaaacaataaaacgaaagaacggaagtacgaaagaaaaacctatgtaggaactcgtgtacgaccgggcctagttccaccactctaccgaagaacgaaccaaaccgacccaaagtaaactttaccacttagttaatttcgaacaaagtagaaacagcctaggaagacgggacgaacggaacgaccggccgttagtaagtttgttgtcgccggacgagtagtgaagtagtacgacttactaacaagttagacgtaggtgtagtgtacgttg

SEQ ID NO: 371240 - DNA, 540 bp, Homo sapiens
  misc_feature: GZ8MTXP02FVQCF.15.67.G01.1.454.CMB.2.raw
  modified_base (420)..(420): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctgggagtggggtggccaaacataaacgaaagacggaagtacaagaaaaacctgtgtaggactctgtagacggccgattcaccatctaccaganacaacgcaaagatcactgtattgacaaatgaaacagcctgagagagagacacggcgtgtattagtgtgcgtgagatgaatacgtagactctagaagtacgacgtaggtgtatagactttg

SEQ ID NO: 371241 - DNA, 535 bp, Homo sapiens
  misc_feature: GZ8MTXP02IMWDM.15.67.G01.1.454.CMB.2.raw
  modified_base (346)..(346): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcaccccttagaagttattggatgacctgggtccgccaggctccgaggggaaggggcgtggagtgggtggccaanataaacaaagacggaagtacagaaaaacctatagtggaactctgtgacggccgattcaccatctccagagacaacgcaagaatcactgtattgacaatagaacagcctagagaggacgaggacgacggcgtgtattatgtgcgcgagatgatagtacgactcacaagtagcgaggtagtagtgtattgg

SEQ ID NO: 371242 - DNA, 547 bp, Homo sapiens
  misc_feature: GZ8MTXP02GL2PV.15.67.G01.1.454.CMB.2.raw
  modified_base (504)..(504): a, c, t, g, unknown or other
  modified_base (508)..(508): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggcccgggggggtccctgagactctcctgtgcagtctctggattcacccttagaagttattggatgacctgggtccgccaggctccgaggggaaggggctggagtggggtggccaacataaaacgaaagacggaagtacaagaaaaacctatgtaggactctgtgacgggccgattccacatctaccagagacaacgccaaagacttcactgtatttgactaaatgaaacagcctaggagaggcgaggacgacggccgtgtattagtgtgcgngagntgatagagactctacgaagtacgacgaggtgtatgattg

SEQ ID NO: 371243 - DNA, 527 bp, Homo sapiens
  misc_feature: GZ8MTXP02HUUZ1.15.67.G01.1.454.CMB.2.raw
  modified_base (343)..(343): a, c, t, g, unknown or other
  modified_base (507)..(507): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtcctgagactctcctgtgcagtctctggattcacccttagaagttattggatgacctgggtccgccaggctccaggggaaggggctggagtggggtggccaanataaaacaaaagacggaagtcaagaaaaacctatgtggactctgtgacggcgattcaccatctccagagacaaacgccaagaattcactgtatttgcaaatgaaacagcctgagaggacgaggacacggcgtgtattatgtgcgcgagatgatacgagactcanaagtagcaggtgtatgattg

SEQ ID NO: 371244 - DNA, 541 bp, Homo sapiens
  misc_feature: GZ8MTXP02J3KBF.15.67.G01.1.454.CMB.2.raw
  modified_base (380)..(380): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttttagaaggtgtccagtgtgaggtgcacttggtggagtctgggggaggcttggtccagccggggggtccctgagactctcctgtgcagtctctggattcacccttagaagttattgggatgacctggggtccgccaggctcccaggggaagggggctgggagtggggtggccaaacataaaacaaagacggaagtcagaaaaaacctntgtggactctgtgacggccgattccaccatctccagagacaaacgccaagaattcactgttatttgcaaatgaacagcctgagagggcgaggacacggccgtgtattattggtgcggcgagatgatagtagactctacaagtagcaggtggtattggattg

SEQ ID NO: 371245 - DNA, 525 bp, Homo sapiens
  misc_feature: GZ8MTXP02JZ8CZ.15.67.G01.1.454.CMB.2.raw
  modified_base (435)..(435): a, c, t, g, unknown or other
  modified_base (505)..(505): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccgggggggtccctgagactctcctgtgcagtctctggattcacccttagaagttattggatgacctgggtccgcaggctccaggggagggctggagtgggtggccaacataaacaaagacggaagtcaagaaaaacctatgtggactctgtgaccggcattcacatctcagagacacgccaagatcactgtatttgacaaatnaacagccgtagagaggacgaggacacgggccgtgtattagttgtgcgcgagatgatagacgactctaacngtagcgaggtagtatgattg

SEQ ID NO: 371246 - DNA, 635 bp, Homo sapiens
  misc_feature: GZ8MTXP02HEYES.15.67.G01.1.454.CMB.2.raw
  modified_base (322)..(322): a, c, t, g, unknown or other
  modified_base (339)..(339): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttcgtgtaggtatttagaagtgtcagtgtgaggtgcacttggtggagtcgtgggggagcttggtccaggccgggggggtcctgagactctcctgtgcagtctctggattcacccttagaagttattggatgactggtccgccagctccagggaaggggcgtggggnggtgggtggacaacaanaaacgaaagaacgaagtaacgaaagaaaacgtaagtagtagtactcgtagtacggacggaccgtactaccacctactactaccacgacgaacgaaccgaaccgaaacgtaacttactacgttacgttagttacgtaactaaacgtaacgtaaacgaacgtacgtacggaggacgggacggaacggaacggaccggtaccggtacgttacgttagttacgtcgtcggtacggagtagtagtaagtaacgtacgtacgtacgtacgtaacgtacgtacgtaggtaggtagtagtagtg

SEQ ID NO: 371247 - DNA, 584 bp, Homo sapiens
  misc_feature: GZ8MTXP02G9RSV.15.67.G01.1.454.CMB.2.raw
  modified_base (303)..(303): a, c, t, g, unknown or other
  modified_base (343)..(343): a, c, t, g, unknown or other
  modified_base (409)..(409): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagagttattggatgacctgggtccnccaggctccgaggggaagggctggagtgggtggaccaaanataaaacgaaagacgaagtacaagaaaaacctatgtaggactcgtgtgacggccgattcaccatcnccagacgacaacgcaagatcactgtatttgacaaatgaaacagacctgacgaggcggaacggaccgacgggtcccgtaggtaatttagttggtagccggtacgagtagtaggaaattaaggtacgtaacctcgttaaacaaggttacgacgtagggttaggtaatggtacttagg

SEQ ID NO: 371248 - DNA, 570 bp, Homo sapiens
  misc_feature: GZ8MTXP02IXSCE.15.67.G01.1.454.CMB.2.raw
  modified_base (516)..(516): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggattcacccttagaagttatggatgacctaggtccgccaggctccgaggggaaggggctgggaggtggggtcggaccaaacaagtaaaacgaaaggaacggaagtacgaaagaaaaacctatgtaggactcgtggtagacgggccgaattccaccatcctaccagagaaccaaacgaccaaagaattcactgtatttgacaaatgaaacagcctagagaggcggagacgcggcgtgtatatgtgcgngagagtgaactaggtacactctaagaagtacgacgtagggtagtagtagtatcg

SEQ ID NO: 371249 - DNA, 539 bp, Homo sapiens
  misc_feature: GZ8MTXP02GJAU9.15.67.G01.1.454.CMB.2.raw
  modified_base (534)..(534): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactgaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaaggggctgggagtggggtggccaaacataaaacaaaagacggaagtcaagaaaaacctatgtgactctgtgacgccgattcacatctccagagacaacgccaaagaatcactgtatttgacaaaatgaaacagacctagagagggacggaaggaccgacggccgtgtattatgtgcgcgagatgatagtagactctaacaagtagcgaggtgtangattg

SEQ ID NO: 371250 - DNA, 530 bp, Homo sapiens
  misc_feature: GZ8MTXP02GHXBO.15.67.G01.1.454.CMB.2.raw
  modified_base (487)..(487): a, c, t, g, unknown or other
  modified_base (509)..(509): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttatggatgactgggtccgccaggctccaggggaaggggctggagtggggtggccaaacataaaacaaagacggaagtcaagaaaaaacctatgtaggactctgtgacggccgattcaccatctccagagacaaacgcaaagaattcactgtatttgacaaatgaaacagacctgagagcgaggacacggcgtgtatatgtgcgngagatgatacgtagactctaanaagtagcaggtggtatgattg

SEQ ID NO: 371251 - DNA, 546 bp, Homo sapiens
  misc_feature: GZ8MTXP02FYC8M.15.67.G01.1.454.CMB.2.raw
  modified_base (522)..(522): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccgggggggtccctgagactctcctgtgcagtctctggattcacccttagaagttattggatgacctgggtccgccaggctccgaggggaaggggctgggagtggggtggccaaacataaacaaagacggaagtcaagaaaaacctatgtaggactctgtgacggccgattcaccatctccagagacaacgcaaagaattcactgtatttgacaaaatgaaacagcctagagaggacgaggacacgggccgtagtattagtgtgcgcgagatggaataggtagactctaanaagtagctagggtgtagtcgattg

SEQ ID NO: 371252 - DNA, 555 bp, Homo sapiens
  misc_feature: GZ8MTXP02G3DCS.15.67.G01.1.454.CMB.2.raw
  modified_base (420)..(420): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccaggggaaggggctggagtggggtggccaacataaacaaagacggaagtacaagaaaaacctatagtaggactcgtgtagaccgggccgattcaccatcctccaganacaaacgccaaagaattcactgtatttgacaaatgaaacagacctgagaggcggaaggacgacgggccgtagtattagttgtagcggtacgagatgatagtagactctacgaagtagcgtaggtgtatggattgg

SEQ ID NO: 371253 - DNA, 544 bp, Homo sapiens
  misc_feature: GZ8MTXP02JVYRA.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggcccgggggggtccctgagactctcctgtgcagtctctggattcacccttagaagttattggatgacctgggtccgccaggctccgaggggaaggggctggagtgggtggccaacataaacaaagacggaagtcaagaaaaaccctatgtggactctgtgacggccgattcaccatctccagagacaacgcaaagaattcactgtatttgacaaatgaaacagcctgagaggcggaaggacacgggccgtaggtattagttgtgcgcgagatgatagtacgactcaacaagtagcgagggtgtatgatttgg

SEQ ID NO: 371254 - DNA, 544 bp, Homo sapiens
  misc_feature: GZ8MTXP02JSH5Z.15.67.G01.1.454.CMB.2.raw
  modified_base (408)..(408): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggggctgagctggggttttccttgttgttattttagaaggtgtccagtgtgaggtgcacttggtggagtctgggggaggcttggtccagccggggggtccctgagactctcctgtgcagtctctggattcacccttagaagttattggatgacctgggtccgccaggctccaggggaaggggctggagtggggtggccaacataaaacaaagacggaagtcaagaaaaacctatgtggaactctgtgacgggccgattcaccatcnccagagacaacgccaagaattcatgtatttgcaaaatagaacagacctagagaggacggaggacgaacggccggtggtattattagtgcgcgaggatgatagtagactactacaagagacaggtggtagtaggatg

SEQ ID NO: 371255 - DNA, 558 bp, Homo sapiens
  misc_feature: GZ8MTXP02H2ZUY.15.67.G01.1.454.CMB.2.raw
  modified_base (417)..(417): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttatggatgacctgggtccgcaggctccaggggaaggggctggaggtggggtggccaaacgataaaacaaaagaacggaaagtacaagaaaaaacctatagtggactctatgacgggccgaattccaccatccnccaagagaacaaacgaccaaagaattcacttgtatttgacaaatgaaacagcctagagaggcgaggacgacggccgtgtattatgtgcggcgagatagatacgtacgactacgtacaagtagacgtaggtagtagtgtatg

SEQ ID NO: 371256 - DNA, 539 bp, Homo sapiens
  misc_feature: GZ8MTXP02H3BZS.15.67.G01.1.454.CMB.2.raw
  modified_base (344)..(344): a, c, t, g, unknown or other
  modified_base (465)..(465): a, c, t, g, unknown or other
  modified_base (513)..(513): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggggctgagctgggttttccttgttgttattttagaaggtgtccagtgtgaggtgcacttggtggagtcgtgggggaggcttgggtccaggccgggggggtccctggagactctcctgtgcagtctctggattcacccttagaagttatggatgacctgggtccgcaggctccaggggaagggctgggagtgggtggccaanataaaacaaagaacggaagtacaagaaaaacctatgtaggactctgtgacggccgattccaccatctccaagagacaacgccaaagaatcactgtatttgacaatgaacagctagagaggngagacacggcctagattagttgtgcgcgagatagatagtagactctanaagtagacgtaggtggtactagtatg

SEQ ID NO: 371257 - DNA, 530 bp, Homo sapiens
  misc_feature: GZ8MTXP02I32UD.15.67.G01.1.454.CMB.2.raw
  modified_base (517)..(517): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttattggatgacctgggtccgccaggctccaggggaaggggctgggagtggggtggccaacataaacaaagacggaagtacagaaaaacctatgtgactctgtgacggccgattcaccatctccagagacaacgccaaagattcactgtatttgacaaatgaaacagcctgagaggcgagacgacggccgtgtattattgtgcgcgagatgaatagtagaactctacaagtagnaggtgtatgattg

SEQ ID NO: 371258 - DNA, 550 bp, Homo sapiens
  misc_feature: GZ8MTXP02FW0FR.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctggagtggggtggccaaacataaaacaaagacggaaagtcaagaaaaaacctatgtaggactctgtagacggccgattcaccatctccagagacaacgccaaagaattcactgtatttgacaaaatgaaacagacctagagacggacggaggaccacgggccgtagtaattagttgtgcgcgagatgatagtagactctaacaagtagacaggtgtatgattg

SEQ ID NO: 371259 - DNA, 581 bp, Homo sapiens
  misc_feature: GZ8MTXP02F6AGG.15.67.G01.1.454.CMB.2.raw
  modified_base (537)..(537): a, c, t, g, unknown or other
  modified_base (554)..(554): a, c, t, g, unknown or other
  modified_base (565)..(565): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccgagggcccgggggggtccctggagactctcctgtgcagtctctggattcacccttagaagttattggatcgacctgggtccgccaggctccgaggggagggctggaggtgggtggaccaaacaataaaacgaaagacggaagtacaaagaaaaacctatgtaggactcgtgtacggaccggccgtattccaacctatcctaccaagagacaaacccgaccaaagaattcaacttgttaatttagactaaaatgaaacacgcctaggagaggacgaggacgacggtacgtgtattagtgtcgcgcgtanatagatagtacgtactntacgaagtagngtaggtgtatgtattg

SEQ ID NO: 371260 - DNA, 548 bp, Homo sapiens
  misc_feature: GZ8MTXP02F07LE.15.67.G01.1.454.CMB.2.raw
  modified_base (429)..(429): a, c, t, g, unknown or other
  modified_base (437)..(437): a, c, t, g, unknown or other
  modified_base (446)..(446): a, c, t, g, unknown or other
  modified_base (452)..(452): a, c, t, g, unknown or other
  modified_base (457)..(457): a, c, t, g, unknown or other
  modified_base (459)..(459): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttttagaaggtgtccagtgtgaggtgcacttggtggagtctggggggaggcttggtccagccgggggggtccctgagactctcctgtgcagtctctggattcacccttagaagttattggatgacctgggtccgccaggctccaggggaaggggctggagtggggtggccaaacataaaacaaaagacggaagtcagaaaaaacctatagtggactctgtgacggccgattcaccatctccagagacaaacgccaaanaatacacngtattgtanaaatanaacancngagagacgagacgacgcgtgtatatgtgcgacgagatagagtaagtagtactactaacaagtaacgacgacggtaggtagtagtagtag

SEQ ID NO: 371261 - DNA, 573 bp, Homo sapiens
  misc_feature: GZ8MTXP02HVABJ.15.67.G01.1.454.CMB.2.raw
  modified_base (350)..(350): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtcccgccaggctccgaggggaggggctgggaggtggggtggaccaaanaataaacaaagacggaagtcaaagaaaaacctatgtaggactctgtagaccggcgtattcaccctatcctccagacgaacaacgacaaagattcactgtatttagactaaatgaaacagcctagacggagggacggaggaccgacgggccgttagtagtttagtgtggccgagagatagaagttaggtacactctagaagtagacgtaggtgtatgtactttg

SEQ ID NO: 371262 - DNA, 529 bp, Homo sapiens
  misc_feature: GZ8MTXP02JHXLI.15.67.G01.1.454.CMB.2.raw
  modified_base (375)..(375): a, c, t, g, unknown or other
  modified_base (385)..(385): a, c, t, g, unknown or other
  modified_base (511)..(511): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaaggggctggagtgggtggccaaacataaaacaaagacgaagtcaagaaaaacctanagtggactcngtgacggccgattcaccatctcagagacaaacgccaaagattcactgtatttgacaaaatgaaacagcctagagaggacgagacacggcgtgtattatgtgcgcgagatgatagtacgactctaangtagcgaggtgtatgatg

SEQ ID NO: 371263 - DNA, 543 bp, Homo sapiens
  misc_feature: GZ8MTXP02FZ2RI.15.67.G01.1.454.CMB.2.raw
  modified_base (518)..(518): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaaggggctggagtggggtggccaaacataaaacaaaagacggaagtacaagaaaaacctatgtggactctgtgacgggccattcaccatctccagagacaacgccaaagaattcactgtatttgacaaaatgaaacagacctagagaggacggaaggaccacgggccgtgtaattatgtgcgcgagatgatagtagactntacaagtagacaggtgtatgattcg

SEQ ID NO: 371264 - DNA, 556 bp, Homo sapiens
  misc_feature: GZ8MTXP02IRCRX.15.67.G01.1.454.CMB.2.raw
  modified_base (533)..(533): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggcccgggggggtccctgagactctcctgtgcagtctctggattcacccttagagttattggatgacctgggtccgccaggctccgaggggaaggggctgggagtgggtggccaaacataaaacaaaggacggaagtcaagaaaaacctatgtggactctagtcgacggccgattcaccatctccagagacaacgaccaagaattcaactgtatttgacaaatgaaacagcctaggagagggacgaaggaccgacggccggtagtaattagttgtgcgtcgagatggataaggtagtactctanaagtagacagggtgtatcggatg

SEQ ID NO: 371265 - DNA, 530 bp, Homo sapiens
  misc_feature: GZ8MTXP02I1IJ7.15.67.G01.1.454.CMB.2.raw
  modified_base (505)..(505): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggattcacccttagaagttattggatgacctgggtccgccaggctccaggggaggggctggagtggggtggccaacataaaacaaagacggaagtcaagaaaaacctatgtggactctgtgacggccattcaccatctcagagacaacgccaaagaattcactgtatttgacaaatgaaacagcctgagaggcgaggacacggcgtgtattatgtgcgcgagatgatagtacgactntacaagtagacgaggtgtatgattg

SEQ ID NO: 371266 - DNA, 540 bp, Homo sapiens
  misc_feature: GZ8MTXP02GBIFI.15.67.G01.1.454.CMB.2.raw
  modified_base (517)..(517): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctggagactctcctgtgcagtctctggattcacccttagaaattattggatgacctgggtccgccaggctccaggggaaggggctggagtggggtggccaaacataaaacaaagacggaaagtcaagaaaaaacctatgtaggactctgtgacgggccgattcaccatctccagagacaaacgccaaagaattcactgtatttgacaaatgaaacagcctgagaggcgagacacggcgtgtattatgtgcgcgagatgatagtagactctaanaagtagcgaggtggtatgattcg

SEQ ID NO: 371267 - DNA, 671 bp, Homo sapiens
  misc_feature: GZ8MTXP02JO09G.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggattcacccttagagttattggatgacctgggtccgccaggctccgaggggaagggcgtggaggtggggtggccaaacaagtaaacaaaggaacggaaagtacgaaagaaaaacctagtaggtacgacttcgtggtacggaccgggtccgtacttaccacctactcctaccgaagaacgaaccaaacccgaccaaagtaacttacaacgttagttaagtttacgaactaaaatacgaaacgacgaccgtaggaaggacgggacggaaggaccgaccgggtaccggttagtaacgtttagttgggtcgacggacggaaaggtgttaggaaacgttaaggtaacgtaaccttaccgtaacgtaaggttaaggacggtagggggttagtagttaggtacgtttgg

SEQ ID NO: 371268 - DNA, 673 bp, Homo sapiens
  misc_feature: GZ8MTXP02I9ANP.15.67.G01.1.454.CMB.2.raw
  modified_base (637)..(637): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtcagtgtgaggtgcacttggtggagtcgtgggggaggcttggtccgaggcccgggggggtccctggagactctcctgtgcagtctctggattccacccttagaagttatggatgacctgggtccgccaggctccgaggggaaggggctgggaggtgggtcggaccaaagaataaaacgaaaggacggaaagtacgaaagaaaaacctataggtaggaacttcgtaggttaggaaccggggcccgtaattaccgaacccattccctaccgaaagaacgaaaccaaaccggacccaaaaaggaacttttccaaacgtttaggttaaattttcggaacctaaaaagttcgaaaaccgacgtacccgttagggaaggacgggacggaaggggaaccacggggtaccgtaggttattagttggtaggccgtacggagtataggaagttagtacgtacctntaacgaagttagacgtagggtaggtatgagtttacg

SEQ ID NO: 371269 - DNA, 565 bp, Homo sapiens
  misc_feature: GZ8MTXP02JA4HV.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtcccgccaggctccgaggggaaggggctgggagtgggtggccaaacataaaacaaaggacggaagtacaagaaaaacctatagtaggactctagtagacgggccgattccaaccatcctaccaagaacgacaaaccgaccaaagaattacacttagtatttgacaaatgaaacagcctagagaggcgaagacgacggcgtgtattagttgtgcgcgagatagatagtacgactactacgaagtagacgtaggtgtatgacttgg

SEQ ID NO: 371270 - DNA, 542 bp, Homo sapiens
  misc_feature: GZ8MTXP02GN6MP.15.67.G01.1.454.CMB.2.raw
  modified_base (375)..(375): a, c, t, g, unknown or other
  modified_base (405)..(405): a, c, t, g, unknown or other
  modified_base (411)..(411): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccaggggaaggggctgggagtggggtgccaacataaacaaagacgaagtacaagaaaaacctntgtggactctgtgacggccgattcacatcnccaganacaacgcaagaattcactgtatttgacaaatgaaacagcctggagaggacggaggaccacgggccgtagtattagttgtgcgacgagatgatagtacgactactacaagtagcgtaggtgtatggactttg

SEQ ID NO: 371271 - DNA, 549 bp, Homo sapiens
  misc_feature: GZ8MTXP02H2ATW.15.67.G01.1.454.CMB.2.raw
  modified_base (412)..(412): a, c, t, g, unknown or other
tcagtctacgtagccacgaccggtgctcgatttagagtatacatattgggtttgaggtctcagagaggagcccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctgggagtgggtggccaaacataaaacaaaggacggaagtacaagaaaaacctatgtggactctgtgacggcgattccaccatcncagacgacaacgccaagaatcactgtatttgacaaatgaaacagcctagagaggcgagacacgaccgtgtattagtgagcgtcgagatgaatagttacgacttacacgtaagtacgacgagggttagtactgtattg

SEQ ID NO: 371272 - DNA, 531 bp, Homo sapiens
  misc_feature: GZ8MTXP02JSSKM.15.67.G01.1.454.CMB.2.raw
  modified_base (510)..(510): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttttagaaggtgtccagtgtgaggtgcacttggtggagtctgggggaggcttggtccagccgggggggtccctgagactctcctgtgcagtctctggattcacccttagaagttattggatgacctgggtccgccaggctccaggggaaggggctggagtgggtggccaaacataaacaaagacggaagtcaagaaaaaacctatagtggactctgtgacggccgattcaccatctccagagacaacgccaagaattcactgtatttgcaaatgaaacagcctgagaggcgaggacgacggcgtgtattagttgtgcgcgagatggatagtagactcanaagtagcaggtgtactggatg

SEQ ID NO: 371273 - DNA, 529 bp, Homo sapiens
  misc_feature: GZ8MTXP02HR42T.15.67.G01.1.454.CMB.2.raw
  modified_base (444)..(444): a, c, t, g, unknown or other
  modified_base (504)..(504): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggagggctgggagtgggtggccaacataaacaaagacgaagtcaagaaaaacctatgtggactctgtgacgggccattcaccatctccagagacaacgtccaagaattcactgtattgacaatgaacngcctgagaggacgaggacacggccgtgtattagtgtgcgcgagatgatacgagactacanaagtagcgtaggtgtagtgtagtcg

SEQ ID NO: 371274 - DNA, 538 bp, Homo sapiens
  misc_feature: GZ8MTXP02GOA2X.15.67.G01.1.454.CMB.2.raw
  modified_base (344)..(344): a, c, t, g, unknown or other
  modified_base (453)..(453): a, c, t, g, unknown or other
  modified_base (511)..(511): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggggttttccttgttgttattttagaaggtgtccagtgtgaggtgcacttggtggagtctgggggaggcttggtccaggccgggggggtccctgaggactctcctgtgcagtctctggattcacccttagaagttattggatgacctgggtccgcaggctccaggggaggggctggagtggggtggccaaanataaaacaaagacggaaagtcaagaaaaacctatgtggactctgtagacggccgattcaccatctccagagacaacgccaaagaatcactgtattgacaaaatgaaacngacctgagaggcgagacacggcgtagtattatgtgcgtcgagatgataacgtagactntacaagtagcgtaggtgtatggattcg

SEQ ID NO: 371275 - DNA, 544 bp, Homo sapiens
  misc_feature: GZ8MTXP02IR7M5.15.67.G01.1.454.CMB.2.raw
  modified_base (445)..(445): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagttattggatgacctgggtccgccaggctccaggggaaggggctggagtgggtggccaaacataaacaaagacggaagtacagaaaaacctatgtggactctgtgacggccgattcaccatctccagagacacgccaagaattcactgtatttgacaaatnaaacagcctgagagggcgaaggacacgggccgtgtattattggtgcggcgagtatgatacgtacgtactactagaagtagacgtaggtggtactgattg

SEQ ID NO: 371276 - DNA, 528 bp, Homo sapiens
  misc_feature: GZ8MTXP02F6AFE.15.67.G01.1.454.CMB.2.raw
  modified_base (376)..(376): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccgggggggtccctgagactctcctgtgcagtctctggattcacccttagaagttattggatgacctgggtccgccaggctccgaggggaagggctggagtgggtggccaacataaacgaaagacggaagtcaagaaaaacctangtgactctgtgacggcgatcaccatctccagagacaacgcaaagatcactgtattgacaaatgaacagcctgagaggcgaggacgacggcgtgtattagtgtgcgacgagatgatagtacgactctaacgaagtagcgaggtggtatgtatg

SEQ ID NO: 371277 - DNA, 544 bp, Homo sapiens
  misc_feature: GZ8MTXP02JNJSQ.15.67.G01.1.454.CMB.2.raw
  modified_base (420)..(420): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggcttggtccgaggcccgggggggtccctggagactctcctgtgcagtctctggattcacccttagaagttattggatgacctgggtccgccaggctccgaggggaaggggctggaggtgggtggccaacataaaacaaagacggaagtcaagaaaaacctatgtggactctagtgacggccgattcaccatctaccaganacaaacgccaaagaattcactgtatttgacaaatgaaacagcctgagaggcgagacacggccgtagtattatgtgcgcgagatgatagtagactactagaagtagcgtagggtgtatgatttcg

SEQ ID NO: 371278 - DNA, 759 bp, Homo sapiens
  misc_feature: GZ8MTXP02FQLGD.15.67.G01.1.454.CMB.2.raw
  modified_base (261)..(261): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcngtctcgtggtactcctacctagtaagttagttggatcgaccgtcgggtcccgccgacggcctaccggaagggggaacggggtcgtaggggagggtggggtcggacccaaaacgaaataaaaacgaaaaggaaaccgggaaagtaacgaaaaacggtaaaaaacccttagtaggtacgggtaccttcgtaggtaacggaccggggccgtaacttaccaaccctacttaccctaccgaagaaacgaaaccgaaacccggaccaaaagtaacttaccaacgttagtttaatttacgaaactaaaagtacgaaaacgacgtaccgtagggaagggacgggaacgggaacggaacccgaccggggtaccggttaggtttaaatttaggttggtcggaccggacggtaaggtaagtaggtaaagttaaacgtaacggtaacctttaccgaaacgaaggttaacggacggtaacgggggttaggtaaagtgggttaactttaggg

SEQ ID NO: 371279 - DNA, 543 bp, Homo sapiens
  misc_feature: GZ8MTXP02HNWAX.15.67.G01.1.454.CMB.2.raw
  modified_base (346)..(346): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaggggctgggagtggggtggccaaanataaacaaagacggaagtcaagaaaaacctatgtaggactctgtgacgggccgattccaccatctccagagacaacgccaagaattcactgtatttgacaaatgaacagcctagagaggacgaggacacggcgtgtattatgtgcgcgagatgatacgtagactacacgaagtacgacgtaggtaggtactgtattg

SEQ ID NO: 371280 - DNA, 588 bp, Homo sapiens
  misc_feature: GZ8MTXP02JYTXD.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccggggggtccctgagactctcctgtgcagtctctggattcacccttagagttattggatgaccgtgggtaaaccgccgaggctccgaggggaaggggcgtgggaggtggggtggaccgaacaataaaacgaaaggaacggaaagtacaaagaaaacctagtagtaggactcgtgtaggacggccgacttaccaccactctccagacgacaacgaccaagaacttcactgttatttagactaaatagaaacagaccgtagaggaggacggaggacgacgggccgtagtagtttagttagtgcgcgagatagagtagtacgactactacgtaagtagacgtaggtaggtagtgtatg

SEQ ID NO: 371281 - DNA, 553 bp, Homo sapiens
  misc_feature: GZ8MTXP02FT0NZ.15.67.G01.1.454.CMB.2.raw
  modified_base (342)..(342): a, c, t, g, unknown or other
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggtggtatcagcagaaatccgggaaagcccctaaagctcctgatctgtgctgcatccacttacaaagtgggtccccatcaagttcagcgcngtgatcgtgcacagatttcactctcaccatcagcagcctgacagcctagaaagtactttcgactaaacttattactgtactaacaaagtattaaactaacttaccccgtacggtaccgtttccgggaccgaagggggaaacccaaaggggttaacgaaaacgttaacgaaaaccgtaacgttaggtacggacgtacggacctaacgtaacg

SEQ ID NO: 371282 - DNA, 534 bp, Homo sapiens
  misc_feature: GZ8MTXP02IRCLY.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggggttttccttgttgttattttagaaggtgtccagtgtgaggtgcacttggtggagtctggggggaggcttggtccaggcccgggggggtccctgagactctcctgtgcagtctctggattcacccttagaagttattggatgacctgggtccgccaggctccaggggaaggggctggagtgggtggccaacataaacaaagacggaagtacagaaaaacctatgtggactctgtgacggcgattcaccatctcagagacaacgccaagaacttcactgtatttgacaaatagaaacagcctgagaggcgaggacacggccgtgtattattgtgcgcgagatgatagtagactctacaagtagcgtaggtggtatgattcg

SEQ ID NO: 371283 - DNA, 533 bp, Homo sapiens
  misc_feature: GZ8MTXP02I5ZTI.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccaggggaaggggctgggagtggggtggccaacataaacaaagacggaagtcagaaaaacctatgtggactctgtgacggccgattcaccatctccagagacaacgccaaagaattcactgtatttgacaaaatgaaacagcctgagaggcgaaggacacggccgtgtattattgtgcgcgagatgatagtagactctacaagtagcaggtggtatggattg

SEQ ID NO: 371284 - DNA, 547 bp, Homo sapiens
  misc_feature: GZ8MTXP02IL2PY.15.67.G01.1.454.CMB.2.raw
  modified_base (261)..(261): a, c, t, g, unknown or other
  modified_base (302)..(302): a, c, t, g, unknown or other
  modified_base (457)..(457): a, c, t, g, unknown or other
  modified_base (497)..(497): a, c, t, g, unknown or other
tcagtctacgtagccacgaccggtgctcgatttagagtatacatattgggtttgaggtctcagagaggagcccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctctgtgcngtctctggattcaccctagaagttatggatgacctggtccnccaggctcaggggagggctggagtgggtggccaaacataaaacaaagaacggaaagtacaaggaaaaaaccctagtgtaggaactcgtagtgacgggccgattcaccatctccagagacaaccgacaagaattcactgtattgactaaatgaaanagcctagagaggcgaagacgacggcgtgtattatgtgcgngagatgaatacgtagaacctctaacgaagtagcgtaggtgtagtgattgg

SEQ ID NO: 371285 - DNA, 538 bp, Homo sapiens
  misc_feature: GZ8MTXP02F7264.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaaggggctggagtgggtggccaacataaacaaagacggaagtcaagaaaaacctatgtggactctgtgacgggccgattcaccatctccagagacaaacgcaaagaattacactgtattgcaaaatgaaacagcctgagaggcgaggacacggcgtgtattatgtgcgcgagagtgataagtagactctaacgaagtagacgtaggtggtataggattgg

SEQ ID NO: 371286 - DNA, 690 bp, Homo sapiens
  misc_feature: GZ8MTXP02I29GH.15.67.G01.1.454.CMB.2.raw
  modified_base (568)..(568): a, c, t, g, unknown or other
  modified_base (623)..(623): a, c, t, g, unknown or other
  modified_base (628)..(628): a, c, t, g, unknown or other
  modified_base (668)..(668): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccggggggtccctgagactctcctgtgcgagtctcgtggtacttcctaaccgttagtaagttagttggatcgaccgtcgggtcccgccgaggcctaccggaagggggaacgggcgtagggaggtggggtcgggacccaaaacgtaaagtaaaaacgaaaacgggaaacgggtaaacgtaccgaaaaagtaaaaaacccgttagtagggtacggaaccttcgttaggttaacggaccggggccctaatttacccaaccctattccaccgaaggaaaccgaacaaacccggaccaaaagtaacttcaacttagttaatttgaactaaaatcgaaaacncgtaccgtaggaggaggccgggaacgaccgaccgggtcgtagttaaattgtttgngacgnggaagtagtgaagtaacgttagacttacgtagaaggtacnggtaaggtggtatggtatttcg

SEQ ID NO: 371287 - DNA, 546 bp, Homo sapiens
  misc_feature: GZ8MTXP02GNSER.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctggagtgggtggccaaacgataaaacgaaaagacggaaagtacaagaaaaaaccctatgtaggactctgtagacgggccgattcaccatctcagagacaacgccaaagatcactgtattgacaaatgaaacagcctgaggagcgaagacgtacggccgtagtattatgtagcgcgagatgatagtagactctaacgaagtacgcgaggtgtaatgatcg

SEQ ID NO: 371288 - DNA, 566 bp, Homo sapiens
  misc_feature: GZ8MTXP02I962M.15.67.G01.1.454.CMB.2.raw
  modified_base (304)..(304): a, c, t, g, unknown or other
  modified_base (378)..(378): a, c, t, g, unknown or other
  modified_base (504)..(504): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagaagttattggatgacctgggtccnccaggctccgaggggaaggggctgggagtggggtggaccaacataaacaaagacggaagtacaagaaaaacctntagtggactcgtgtgaccgggcgattccaccatcaccagacgacaacgccaaagacttcacttagttactttagacaaagtgaaacagacctagagagggcgaaggacacggcgtagtatagttgngcgacgagagagatacgtacgtactacgtagaagtagtacggtaggtagtagtagtagttcg

SEQ ID NO: 371289 - DNA, 537 bp, Homo sapiens
  misc_feature: GZ8MTXP02IWLAO.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctggggtccgccaggctccaggggaaggggctggagtgggtggccaacataaacaaagacggaagtacaagaaaaacctatgtgactctgtgacggccgattccaccatctcagagacaacgcaagaattcactgtatttgacaaatgaaacagcctgagaggcggaggacacgggccgtgtacttagttgtgcgtcgagatgaatagtacgactctaacgaagtagcgaggtgtatgattg

SEQ ID NO: 371290 - DNA, 545 bp, Homo sapiens
  misc_feature: GZ8MTXP02JHB2Y.15.67.G01.1.454.CMB.2.raw
  modified_base (377)..(377): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggattcacccttagaagttattggatgacctgggtccgccaggctccaggggaaggggctggagtgggtggccaaacataaaacaaagacggaagtcaagaaaaacctntgtggactctgtgacgggccgattcaccatctccagagacaacgccaaagaattcactgtatttgcaaaatgaaacagcctgagaggcgaaggacacgggccgtgtattatgtagcggcgagatgaatacgacgactctaacgaagtacgactagggtgtatgtactg

SEQ ID NO: 371291 - DNA, 536 bp, Homo sapiens
  misc_feature: GZ8MTXP02I6Z0Q.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggggttttccttgttgttattttagaaggtgtccagtgtgaggtgcacttggtggagtctgggggaggcttggtccaggccgggggggtccctgagactctcctgtgcagtctctggattcacccttagagttattggatgacctgggtccgccaggctccaggggaaggggctgggagtggggtggccaacataaaacaaagacggaagtacaagaaaaacctatagtggactctgtgacgggccgattcaccatctccagagacaacgccaaagaattcactgtatttgacaaatgaaacagcctagagaggcgaggacacggccgtgtattatgtgcgtcgagatgatagtagactctacaagtagctaggtgtatgattg

SEQ ID NO: 371292 - DNA, 573 bp, Homo sapiens
  misc_feature: GZ8MTXP02I7FRK.15.67.G01.1.454.CMB.2.raw
  modified_base (507)..(507): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttcctgtgttatttagaaggtgtccagtgtgaggtgcacttggtggagtctggggggaggcttgggtccaggccggggggggtccctgagactctcctgtgcagtctctggattcacccttagaagttattggatgacctgggtccgccaggctccgaggggaaggggcgtgggaggtggggtgggccaaacataaaacaaaggacggaagtcaagaaaaacctatgtaggactctgtagacgggccgattccaccatctccagagacaacgacaagaatcactgtatttgacaaatgaaacagacctagagaggacggagaaccgacggccgtggttaattagtttgggngacggacgagagtagtagtagtacgtactacgtacgtaagtacgacgtaggtagtagtagtagtcg

SEQ ID NO: 371293 - DNA, 555 bp, Homo sapiens
  misc_feature: GZ8MTXP02J0MJG.15.67.G01.1.454.CMB.2.raw
  modified_base (501)..(501): a, c, t, g, unknown or other
  modified_base (507)..(507): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccgaggctccgaggggaaggggctgggaggtgggtggccaaacataaaacgaaagaacggaaagtcaaagaaaaacctatagtggactctgtgacggccgattcaccatctaccagagacaacgaccaaagaatcactgtatttgacaaatgaaacagtcctagagagcggagacgacgggcctgtatagtgtgcgngagagngaataggtacgactactacaagtacgacagggttagtagtcggatttg

SEQ ID NO: 371294 - DNA, 537 bp, Homo sapiens
  misc_feature: GZ8MTXP02GA1FZ.15.67.G01.1.454.CMB.2.raw
  modified_base (429)..(429): a, c, t, g, unknown or other
  modified_base (435)..(435): a, c, t, g, unknown or other
  modified_base (439)..(439): a, c, t, g, unknown or other
  modified_base (442)..(442): a, c, t, g, unknown or other
  modified_base (444)..(444): a, c, t, g, unknown or other
  modified_base (446)..(446): a, c, t, g, unknown or other
  modified_base (448)..(448): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttctgtagttatttagaagtgtccagtgtgaggtgcacttggtggagtctgggggagcttggtccagccgggggggtccctgagactctcctgtgcagtctctggattcaccccttagaagttattggatgacctgggtccgccaggctccagggaaggggcgtggagtggggtggcgaacataaacaaaagaacggaagtacagaaaaacctaatagtggactctgtgacggccgattcaccatctccagagacaacgaccaagaatacacngtattntaanaanananancagagaggacgagacgacgcgtgtatagtgtgcgcgagatagagtagtacgtactactacgtaagtagacgaggtaggtagtagtagtg

SEQ ID NO: 371295 - DNA, 544 bp, Homo sapiens
  misc_feature: GZ8MTXP02IF3OF.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggcttggtccaggccgggggggtccctgagactctcctgtgcagtctctggattcacccttagaagttattggatgacctgggtccgccaggctccaggggaagggctgggagtgggtggccaaacataaaacaaagacggaagtacaagaaaaacctatgtggactctgtgacgggccgattccaccatctccagagacaacgccaaagaacttcactgtatttgacaaatgaaacagcctgagaggcgaggacacggcgtgtattatgtcgcgcgagatgatacgtagactctacgaagtaacggcgtaggtgtactgagtcg

SEQ ID NO: 371296 - DNA, 572 bp, Homo sapiens
  misc_feature: GZ8MTXP02GX5LE.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctgggaggtggggtggccaaacaataaaacgaaaaggaacggaaagtacaaagaaaaaccctatagtggaactcgtgtagacgggccgattccaccatctccagacgacaacgccaagaattcactgtatttgacaaatgaaacagaccctaggaagagggacggaggaaccgacgggaccgtagtattagttgtgcgacgagatagatagtacgactctaacgaagtagcgaggtgtactgattg

SEQ ID NO: 371297 - DNA, 539 bp, Homo sapiens
  misc_feature: GZ8MTXP02JYEHC.15.67.G01.1.454.CMB.2.raw
  modified_base (346)..(346): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccaggccgggggggtccctgagactctcctgtgcagtctctggattcacccttagaagttattggatgacctgggtccgccaggctccgaggggaaggggctgggagtgggtggccaanataaacaaagacggaagtcaagaaaaacctatgtggactctgtgacggcgattcaccatctccagagacaacgccaagaatcactgtatttgacaaatgaaacagcctggagagggcgaggacacggccgtgtattatgtgcgcgagatgatagtacgactctaacaagtacgacgagggtggtatggattcg

SEQ ID NO: 371298 - DNA, 524 bp, Homo sapiens
  misc_feature: GZ8MTXP02G5T1V.15.67.G01.1.454.CMB.2.raw
  modified_base (404)..(404): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccaggggaaggggctgggagtgggtggccaacataaaacaaagacggaagtcaagaaaaacctatgtggactctgtgacggcgattcaccatcncagagacaacgccaagattcactgtatttgacaaatgaacagcctgagaggcgagacacggcgtgtattatgtgcgcgagatgatagtagactctacaagtagacgaggtggtatggatg

SEQ ID NO: 371299 - DNA, 587 bp, Homo sapiens
  misc_feature: GZ8MTXP02JKGIC.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctggaggtgggtggaccaacataaaacaaagacggaagtacaagaaaaacctatgtagactcgtagtgaccgggccgattccgaccatcctacccgagaacgaacgaaaccgacccaaagaacttcaactgtaatttgacaaatcgaaacacgaccgtggagagggacggaacggaccgaaccgggccgttagtattagttgtgcgcgagagtgagtagtacgactactacgaagtacgacgtagggtgtagtcgtattgg

SEQ ID NO: 371300 - DNA, 537 bp, Homo sapiens
  misc_feature: GZ8MTXP02F1UU2.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccgaggggaaggggctggagtggggtggccaacataaacgaaagacggaagtcaagaaaaacctatgtaggactctgtgacggccgattcaccatctccagagacaacgccaaagatcactgtatttgacaaatgaaacagcctgagaggacgaggacacggcgtgtattatgtgcgcgagatgatagtacgtacgctacaagtacgcgtagggtgtagtgagttg

SEQ ID NO: 371301 - DNA, 540 bp, Homo sapiens
  misc_feature: GZ8MTXP02JPZLD.15.67.G01.1.454.CMB.2.raw
  modified_base (419)..(419): a, c, t, g, unknown or other
  modified_base (453)..(453): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctgagactctcctgtgcagtctctggattcacccttagaagttatggatgacctgggtccgccaggctccgagggaaggggctggaggtggggtggccaacataaacaaagacggaagtacaagaaaaacctatagtaggactcgtagtgacggccgattcaccatctccaganacaacgcaagattcactgtattgacaatgaaacngcctgagaggcgaggacgacggacgtagtattatggtgcgtcgagagtgatagtacgactcaacaagtagacgtaggtgtatagatg

SEQ ID NO: 371302 - DNA, 548 bp, Homo sapiens
  misc_feature: GZ8MTXP02HO7NS.15.67.G01.1.454.CMB.2.raw
  modified_base (500)..(500): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccgaggggaaggggctgggagtggggtggccaacaataaacaaaagacggaaagtacaagaaaaacctatagtgactctgtgacgggcgattcaccatctccagagacaacgcaaagattcactgtatttgacaaatgaaacagcctagacgaggcgaggacgacggccgtagtattatgtgcgcgagntagagtacgtagactactacgaaggtagcgtaggtaggtatggattcg

SEQ ID NO: 371303 - DNA, 558 bp, Homo sapiens
  misc_feature: GZ8MTXP02I3VCV.15.67.G01.1.454.CMB.2.raw
  modified_base (344)..(344): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccgaggggaaggggctggagtgggtggccaaanataaaacaaagaacggaagtacaaggaaaaacctatgtgactctgtgacggccgattcaccatctaccagagacaacgccaaagaattcacttgtatttgacaaatgaaacagcctgagaggcgaaggacgacggccgtagtaacttagttacgtgccggacgaggatggataggtacacgtctaacaaggtagcgagggtgtagtggactttg

SEQ ID NO: 371304 - DNA, 552 bp, Homo sapiens
  misc_feature: GZ8MTXP02ILCCR.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctggagtggggtggccaaacataaaacaaagacggaagtacaagaaaaacctatgtggactctgtgacgggcattccaccatctaccagagacaaacgccaaagaattacactagtatttagacaaatagaaacagacctagacgaggacgaacggacgacggaccgtgtattagtgtgcgcgagatgagtagtacgactctacaagtagcgaggtgtatagattg

SEQ ID NO: 371305 - DNA, 636 bp, Homo sapiens
  misc_feature: GZ8MTXP02HBBPX.15.67.G01.1.454.CMB.2.raw
  modified_base (288)..(288): a, c, t, g, unknown or other
  modified_base (514)..(514): a, c, t, g, unknown or other
  modified_base (541)..(541): a, c, t, g, unknown or other
  modified_base (574)..(574): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggcccggggggtccctggagactctcctgtgcagtctctggattcacccgttagaagttntggatcgaccgtggtccgcgtaggctccgagggacgggtctagggagtcggtcggaccaacgtaagtaaaccgaaaggtacggtaagtacgaagtaaaaccctgtagtacggaccttcgtacggtacgaccggtccgtacttaccgacctacgtcgtaccgagacgtaccaaaccgtcccgaaagtacgttccgtaacgtgttacttgacctaaagtcgtaaaccngtacctaggagacggacgtaggaaccncgggtctagtacttgttcgcgacgacggacgtntacggacttacggtacgtaccgtacgtacgaagtacgacgtacggtcgactcggtaactcgg

SEQ ID NO: 371306 - DNA, 567 bp, Homo sapiens
  misc_feature: GZ8MTXP02JMQWK.15.67.G01.1.454.CMB.2.raw
  modified_base (312)..(312): a, c, t, g, unknown or other
  modified_base (392)..(392): a, c, t, g, unknown or other
  modified_base (402)..(402): a, c, t, g, unknown or other
  modified_base (522)..(522): a, c, t, g, unknown or other
  modified_base (526)..(526): a, c, t, g, unknown or other
  modified_base (539)..(539): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggaggtcgtggggggaggcttgggtccgagggcccgggggggtccctggagactctcctgtgcagtctctggattcacccttagaagttattggatgacctgggtccnccaggctccgaggggaaggggctgggaggtggggtggccaacaataaacgaaaaggacggaaagtacaagaaaaaccctntagtgacctntgtgacggcgatcaccatctcagagacaacgccaaagattacactagtatttagacaaatacgaaacagacctaggacggagggcggaaggacgaacgggccgtaggtattagtgtgcgngagntgatagacgactnacgaagtagcgtagggtgatgatttacg

SEQ ID NO: 371307 - DNA, 572 bp, Homo sapiens
  misc_feature: GZ8MTXP02IMEKV.15.67.G01.1.454.CMB.2.raw
  modified_base (225)..(225): a, c, t, g, unknown or other
  modified_base (278)..(278): a, c, t, g, unknown or other
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccggnaagtcaggacattagaactgacttaggtgtatcagcaagaaatccgggaaacncccctaagcctcctgatctgtgctgcatccatttacaaagtcggtaccccatcaaggttcagcgcaggtgatcgtgccagtagtactttcactctacaccatccgagccagccgtgacacgtacctagtaaacgtactttacgaccttaaactttacttacgttgtactaacgtaaattactttaaacgtaactttaccccgtacggtaccggtttacggaccgtaaacggggaaccgtaagggtaacgaaactaaccgaaaacgtacgtacggtacgacgtcgacctactacg

SEQ ID NO: 371308 - DNA, 543 bp, Homo sapiens
  misc_feature: GZ8MTXP02F58TO.15.67.G01.1.454.CMB.2.raw
  modified_base (417)..(417): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccgaggggaaggggctgggagtggggtggccaaacataaacaaaagacggaagtacaagaaaaacctatagtggactctgtgacggccgattcaccatctacaganacaaacgccaaagaattcactgtatttagacaaatgaaacagacctagagaggcgaggacgacggccgtagtattatgtgcgcgagatgatagtagactctaacaagtagcgaggtgtaatgattg

SEQ ID NO: 371309 - DNA, 532 bp, Homo sapiens
  misc_feature: GZ8MTXP02F2P4L.15.67.G01.1.454.CMB.2.raw
  modified_base (490)..(490): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaaggggctgggagtggggtggccaaacataaaacaaagacggaaagtcaagaaaaacctatgtaggactctgtgacgggccgattcaccatctccagagacaacgccaaagattcactgtattgcaaaatgaaacagcctgagaggcgagacacggcgtgtatagtgtgcgngagatgatagtagactctaacaagtagcaggtggtatcgatg

SEQ ID NO: 371310 - DNA, 568 bp, Homo sapiens
  misc_feature: GZ8MTXP02HALNP.15.67.G01.1.454.CMB.2.raw
  modified_base (300)..(300): a, c, t, g, unknown or other
  modified_base (389)..(389): a, c, t, g, unknown or other
  modified_base (407)..(407): a, c, t, g, unknown or other
  modified_base (443)..(443): a, c, t, g, unknown or other
  modified_base (446)..(446): a, c, t, g, unknown or other
  modified_base (448)..(448): a, c, t, g, unknown or other
  modified_base (451)..(451): a, c, t, g, unknown or other
  modified_base (453)..(453): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtcagtgtgaggtgcattggtggagtcgtgggggaggcttggtccaggccggggggtccctgaggactctcctgtgcagtctctggattcaccttagaagttatggatgacctggtccnccaggctccgagggaagggctggagtgggtggaccaaacgaataaaaacgaaaagaacggaagtacaaagaaaaaactatgtaggactntgagacggcatcacatcncagagacaaacgaccaaagaatcatgtatttagaanaananaananacagagaggacgagacgacgcgtagtattagtagtgcgacgagagtagtaagtaacgtaacgtaacgtaacgtaacgtaagtaacggtaacgtacggtaggtagtagtagttacg

SEQ ID NO: 371311 - DNA, 549 bp, Homo sapiens
  misc_feature: GZ8MTXP02HVGLL.15.67.G01.1.454.CMB.2.raw
  modified_base (342)..(342): a, c, t, g, unknown or other
  modified_base (462)..(462): a, c, t, g, unknown or other
  modified_base (497)..(497): a, c, t, g, unknown or other
  modified_base (501)..(501): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtccagtgtgaggtgcacttggtggagtcgtgggggaggcttggtccaggccggggggtccctgagactctcctgtgcagtctctggattcacccttagaagttatggatgacctgggtccgccaggctccgaggggaggggctggaggtgggtggaccaanaataaaacaaagaacggaagtacaagaaaaacctagtgtaggacttctggtagaccggggcattccacccatcctccagagacaacgccaaagaattcactgttattgacaaatcgaaanagcctggagaggcgaggacacggcgtgtattatgngcgngagatggattacgagacttacagaagtagcgtaggtgtatggtattcg

SEQ ID NO: 371312 - DNA, 529 bp, Homo sapiens
  misc_feature: GZ8MTXP02JUZB5.15.67.G01.1.454.CMB.2.raw
  modified_base (413)..(413): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggattcacccttagaagttatggatgacctgggtccgccaggctccaggggaaggggctggagtggggtggccaacataaaacaaagacggaagtcaagaaaaacctatgtggactctgtgacggccgattcaccatctccaganacaacgccaagattcactgtatttgacaaatgaaacagcctgagaggcgaggacacggccgtgtattatgtgcgtcgagatgatagtagactctacaagtagcaggtgtatgattg

SEQ ID NO: 371313 - DNA, 535 bp, Homo sapiens
  misc_feature: GZ8MTXP02GSS1I.15.67.G01.1.454.CMB.2.raw
  modified_base (305)..(305): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccnccaggctccaggggaaggggctgggagtgggtggccaacataaacaaagacggaagtcaagaaaaacctatgtggactctgtgacggccgattcaccatctcagagacaacgccaaagaattcactgtatttgacaaaatgaaacagacctgagaggacgaggacacggcgtgtattatgtgcgcgagatagatacgtagactctaacaagtagcaggtggatggattcg

SEQ ID NO: 371314 - DNA, 582 bp, Homo sapiens
  misc_feature: GZ8MTXP02F4MZK.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggagggctggagtgggtggccaacataaaacaaagacggaagtacaagaaaaacctatgtaggaactctagtacgaacgggccgaagttccacccatcctaccaagaacgaaccaaaccgaccaaaagaacttacactgtaatttgacaaaatgaaacagacctagagaggacggaaggaccgacggccggtgttaattagttagtggccgcggagtagtgaataggtacgactcaacaagtagacgagggtgtatggatttgg

SEQ ID NO: 371315 - DNA, 604 bp, Homo sapiens
  misc_feature: GZ8MTXP02J40CH.15.67.G01.1.454.CMB.2.raw
  modified_base (344)..(344): a, c, t, g, unknown or other
  modified_base (471)..(471): a, c, t, g, unknown or other
tcagtctacgtagccacgaccggtgctcgatttagagtatacatattgggtttgaggtctcagagaggagccttagccctggactccaaggcctttccacttggtgatcagcactgagcacagagactcaccatggagttggggctgagcttgggtttttccttgttgttattttagaaggtgtccagtgtgaggtgctacgttggtggagtcgtgggggagcttgggccgagggcccggggggtccctgacgactctcctgtgcagtctctggattcaccttagaagttattggatcgaccgtggccgcaggctccgaggggaggctggagtggagaccaaanaataaacgaagacgaaagtcaaagaaaaccctgtgtaggactcgtaggtacgaccggcctaaacttccacctatcctaccagaacaaaccaacgtacccaaagtaaacttccacgttgttaatttanaaacctaaaagaacgaacgacgacgagagaggacggacgacgacggtacgtagttagttagtagtagacgacgagagtagtaagtacgtacgactacgtaacgtaagtacgacgtacggtagtagtagtagtg

SEQ ID NO: 371316 - DNA, 537 bp, Homo sapiens
  misc_feature: GZ8MTXP02GMELJ.15.67.G01.1.454.CMB.2.raw
  modified_base (444)..(444): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccgggggggtccctgagactctcctgtgcagtctctggattcacccttagagttattggatgacctgggtccgccaggctccaggggaagggctggagtgggtggccaacataaacaaagacggaagtcaagaaaaacctatgtgactctgtgacggccgattcaccatctccagagacaacgccaaagattcactgtattgcaaatgaaacngcctgagaggcgaggacacggccgtgtaattatgtgcgtcgagatacggaataggtaacgactctaacgaagtagactaggtggatgtacttg

SEQ ID NO: 371317 - DNA, 546 bp, Homo sapiens
  misc_feature: GZ8MTXP02H286O.15.67.G01.1.454.CMB.2.raw
  modified_base (344)..(344): a, c, t, g, unknown or other
  modified_base (414)..(414): a, c, t, g, unknown or other
tcagtctacgtagccacgaccggtgctcgatttagagtatacatattgggtttgaggtctcagagaggagccttagccctggactccaaggccttttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggattcacccttagaagttatggatgacctgggtccgcaggctccaggggaaggggctggagtgggtggccaaanataaaacaaagaacgaagtacaagaaaaacctatagtggactctgtagacgggccgaattccaccattcnccagagacaacgccaaagaatcactgtattgacaaatgaacagctgagaggcgaggacacggccgtgtattattgtgcgcgagatagagtaacgtagactactacaagtagacgaggtgtaagtgtaagttg

SEQ ID NO: 371318 - DNA, 584 bp, Homo sapiens
  misc_feature: GZ8MTXP02F61AJ.15.67.G01.1.454.CMB.2.raw
  modified_base (302)..(302): a, c, t, g, unknown or other
  modified_base (337)..(337): a, c, t, g, unknown or other
  modified_base (574)..(574): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccgggggggtccctgagactctcctgtgcagtctctggattcacccttagagttatggatgacctggtccnccaggctcaggggagggctggagtgggtggccaanaataaacaaaggacggaaagtacaaagaaaaacctataggtaggactctaggtaggaccgggcccgaattccgaccatcctaccagagacaaaccgccaaagaattcactagtattgacaaatgaaacacgcctagaggaggacggaaggaccgacgggtacgtagttaattagtgtggccgacggagtagtcgtaatagtacgaacttctaacgaagtacgacgtagggtagttangtaagtttcg

SEQ ID NO: 371319 - DNA, 538 bp, Homo sapiens
  misc_feature: GZ8MTXP02FXRX1.15.67.G01.1.454.CMB.2.raw
  modified_base (300)..(300): a, c, t, g, unknown or other
  modified_base (404)..(404): a, c, t, g, unknown or other
  modified_base (409)..(409): a, c, t, g, unknown or other
  modified_base (422)..(422): a, c, t, g, unknown or other
  modified_base (528)..(528): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagagttatggatgacctggccnccaggctcgaggggagggctggagtgggtggaccaaacgataaacgaaagaacggaagtacaagaaaaacctgtgaggactcgtgtagacggccatcaccatcncaganacaacgcaagatnactgtattagacaaatgaacagcctagagaggacgagacgacggcgtgtattagtgtgacgcgagatgaatagtacgtactctagaagtacgacgtaggtaggtanaggtatttcg

SEQ ID NO: 371320 - DNA, 542 bp, Homo sapiens
  misc_feature: GZ8MTXP02GHAU7.15.67.G01.1.454.CMB.2.raw
  modified_base (416)..(416): a, c, t, g, unknown or other
  modified_base (422)..(422): a, c, t, g, unknown or other
  modified_base (520)..(520): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagaagttattggatgacctgggtccgccaggctccgaggggaaggggctgggaggtggggtggaccaaacgaataaaacgaaaaggacggaaagtacaagaaaaacctatgtaggactctgtgacggcatcaccatcnccaganacaacgccaagattcactgtatttgacaaatgaaacagcctagagaggacgaggacacggccgtagtattagtgtgcgcgagatgatagagactctanaagtagctaggtgtatgattcg

SEQ ID NO: 371321 - DNA, 573 bp, Homo sapiens
  misc_feature: GZ8MTXP02F5OU5.15.67.G01.1.454.CMB.2.raw
  modified_base (308)..(308): a, c, t, g, unknown or other
  modified_base (391)..(391): a, c, t, g, unknown or other
  modified_base (424)..(424): a, c, t, g, unknown or other
  modified_base (427)..(427): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttatttagaaggtgtccagtgtgaggtgcacgttggtggagtcgtgggggaggcttgggtccgagggccgggggggtccctggagactctcctgtgcagtctctggattcacccttagaagttattggatgacctgggtccnccaggctccgaggggaaggggctgggaggtgggtggaccaaacaataaaacgaaaagaacggaaagtacaaagaaaaaacctntagtaggactctgtagacggccattcaccatcncanagacaacgaccaaagaatcactgttattagacaaaatgaaacagacctagaagagggacggaaggaaccgacggccgtagtattagtgtgcggacgagatgattaagtacgactctaacaaggtagacgagggtgtagtgactttg

SEQ ID NO: 371322 - DNA, 536 bp, Homo sapiens
  misc_feature: GZ8MTXP02F2V5W.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagagttattggatgacctggtccgccaggctccaggggaagggctggagtgggtggccaaacataaacaaagacggaagtacaagaaaaacctatgtaggactctgtagacgggccgattcaccatctaccagagacaacgccaaagaacttcactgttaatttgacaaaatgaaacagcctagagaggacgagacgacggcgtagtatatgtgcgcgagatgatagagactcaacaagtagcgaggtgtatgattcg

SEQ ID NO: 371323 - DNA, 597 bp, Homo sapiens
  misc_feature: GZ8MTXP02H9BFJ.15.67.G01.1.454.CMB.2.raw
  modified_base (554)..(554): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtcctgagactctcctgtgcagtctctggattcacccttagaagttattggatgacctgggtccgccaggctccgaggggagggctgggaggtgggtggaccaaagaataaaacgaaagaacggaaagtacaaagaaaaacctatgtaggacttcgtaggtagaccgggccgtaattccaaccatcctaccagaacgacaaaccgaccaaagaaacttcctaacgttgttaattttagaactaaataagaaacaacgacctaggagagggacggaggacgaacggaccgtaggtattagttgtgcgacgagagngatagtagactactaacaagtagacgaggtagtagtagtagtg

SEQ ID NO: 371324 - DNA, 555 bp, Homo sapiens
  misc_feature: GZ8MTXP02JA6O2.15.67.G01.1.454.CMB.2.raw
  modified_base (454)..(454): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccgaggggaaggggctgggaggtggggtggccaaacataaacaaagacggaagtcaagaaaaacctatgtggactctgtgacggcgattcaccatctccagacgacaacgccaaagaattcactgtatttgacaaatgaaacngacctggagagggcgaaggacacgggccgtagtattagttgcgcgcgagatgataggtacgactctaacgaagtagacgtagggttgtaagtggtaattcg

SEQ ID NO: 371325 - DNA, 539 bp, Homo sapiens
  misc_feature: GZ8MTXP02IVVKA.15.67.G01.1.454.CMB.2.raw
  modified_base (416)..(416): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtccagtgtgaggtgcacttggtggagtcgtgggggaggcttggtccaggccggggggtccctgagactctcctgtgcagtctctggattcacccttagaagttattggatgacctgggtccgccaggctccgaggggaaggggctgggagtggggtggccaaacataaaacaaagacggaagtcaagaaaaacctatgtaggactctgtgacgggccgattcaccatctccaganacaacgccaaagaattcaacttgtatttgacaaatgaaacagcctgagaggcgaaggacacggcgtgtattatgtgcgcgagatgaatagtagaactcacaagtagactagggtgtatgattg

SEQ ID NO: 371326 - DNA, 560 bp, Homo sapiens
  misc_feature: GZ8MTXP02IIJHQ.15.67.G01.1.454.CMB.2.raw
  modified_base (437)..(437): a, c, t, g, unknown or other
  modified_base (487)..(487): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggctttggtccgaggccgggggggtccctgagactctcctgtgcagtctctggattcacccttagaagttattggatgacctgggtccgccaggctccgaggggaaggggctgggagtggggtggcccaaacataaaacaaaggaccggaaagtacaagaaaaaacctatggtaggaactctggtacgaacggggccgatttccgaccatctccaganacaacgaccaagaattcactgtattgacaaatgaaacagacctgagaggngagacgaggctgtattatgtgcgagagatgaatagtacgacttcacgaagtagctagggtagtagtgaattcg

SEQ ID NO: 371327 - DNA, 550 bp, Homo sapiens
  misc_feature: GZ8MTXP02IV6CH.15.67.G01.1.454.CMB.2.raw
  modified_base (499)..(499): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggcccggggggggtccctggagactctcctgtgcagtctctggattcacccttagagttattggatgacctgggtccgccgaggctccgaggggaaggggctgggagtgggtggccaacataaaacaaagacggaagtacaagaaaaacctatgtggactcgtgtgacggccgattccaccatctccagacgacaacgccaaagaacttcactgtatttgacaaatgaaacagcctagagaggacgagacgacggcgtagtattatgngtcgcgagatgatagtacgactctacgaagtacgcgtaggtgtatgattag

SEQ ID NO: 371328 - DNA, 549 bp, Homo sapiens
  misc_feature: GZ8MTXP02IBOC7.15.67.G01.1.454.CMB.2.raw
  modified_base (345)..(345): a, c, t, g, unknown or other
  modified_base (455)..(455): a, c, t, g, unknown or other
  modified_base (497)..(497): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcctgttgttattttagaaggtgtccagtgtgaggtgcacttgggtggagtctggggggaggcttgggtccaggccggggggggtccctgagactctcctgtgcagtctctggattcacccttagaagttatggatgacctgggtccgcaggctccgaggggaaggggctgggagtgggtggccaanataaaacaaagacggaaagtcaagaaaaacctatgtggactctgtgacggccgattccaccatctccagacgacaacgccaaagaatcactgtatttgacaaatgaaacngcctgagaggcgagacacggcgtgtattatcgtgcgcgaagntagatagtacgacttactacgaagtagacgtaggggtaggtatggtaattgg

SEQ ID NO: 371329 - DNA, 555 bp, Homo sapiens
  misc_feature: GZ8MTXP02H8U1Z.15.67.G01.1.454.CMB.2.raw
  modified_base (344)..(344): a, c, t, g, unknown or other
  modified_base (516)..(516): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttatggatgacctgggtccgccaggctccgaggggaaggggctggagtggggtggccaaanataaaacaaagacggaaagtcaagaaaaaacctatagtggactctggtcgacggccgattcacccatctacagacgacaaacgacccaagaaatctactagtatttagactaaatagaaacagacctagagagggccggaaggaccacggcgtagtattatgtgcgtcgagnagtatagagactcacaagtagacaggtaggtatgtatcg

SEQ ID NO: 371330 - DNA, 547 bp, Homo sapiens
  misc_feature: GZ8MTXP02II5XK.15.67.G01.1.454.CMB.2.raw
  modified_base (410)..(410): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtcccaggccgggggggtccctgagactctcctgtgcagtctctggattcacccttagagttatggatgacctgggtccgccaggctccgaggggaaggggctgggaggtgggtggccaaacataaaacaaagacggaagtacaagaaaacctatgtggactctgtgacgggccgattcaccatcnccagagacaacgacaagaattcactgttattgacaaaatgaaacagacctggagaggcgaaggacacggccgtgtattattgtgcgacgagatgaataggtagaacttctaacaagtagcgtaggtagtatgattcg

SEQ ID NO: 371331 - DNA, 529 bp, Homo sapiens
  misc_feature: GZ8MTXP02GDLWJ.15.67.G01.1.454.CMB.2.raw
  modified_base (407)..(407): a, c, t, g, unknown or other
  modified_base (484)..(484): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccgaggggaaggggctgggagtggggtggccaacataaacaaagacggaaagtacaagaaaaacctatgtggactctgtgacggcattcaccatcncagagacaacgcaaagatcactgtattgacaaatgaaacagcctagagaggcgagacacggccgtgtattatgtgcncgagatgatagtagactctaacaagtagacaggtgtatggattcg

SEQ ID NO: 371332 - DNA, 609 bp, Homo sapiens
  misc_feature: GZ8MTXP02IFNCE.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggcttggtccaggccgggggggtccctgagctctcctgtgcagtctctggattcaccttagagttatggatgacctggtcgccagcgtccagggagggcgtggaggtgggtggcaacaataaacaaagaacggagtacaagaaaactaaatgtgactctgtgacggccgatcctaccactctcacagacaaccgaccaagaaattactactagttattagtacaaatagtaacaacgtccgagtaggagggacgggaacggtaccgaacgggtcccggttaggttaagttttaagttaggttgggacccgacgggtaagagtagtaaagtaaccgtttaagacgttacctaacgaaggtaagacgtagggtaggttagttagacgtttgg

SEQ ID NO: 371333 - DNA, 639 bp, Homo sapiens
  misc_feature: GZ8MTXP02IB7ZI.15.67.G01.1.454.CMB.2.raw
  modified_base (262)..(262): a, c, t, g, unknown or other
  modified_base (342)..(342): a, c, t, g, unknown or other
  modified_base (370)..(370): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcttgttgttattttagaaggtgtccagtgtgaggtgcacttgggtggagtcgtgggggaggcttggtccgaggccgggggggtccctgagactctcctgtgcngtctctggattcaccttagaagttatggatgaccgtgggtccgcaggctccgaggggagggctgggagtggtggaccaanataaaacaagacgaagtcaagaaaactntagtgactctgtacgacggccgtattccaccatccacagacgacaacgcaagaaactcaacttgttaatttgaactaaagtacgaaactagacctaggaagaggggaccgggaagggaccgaacggggtcccggttaggttaaacgttttaagttacgggttggtacccgggtacggaaggtaagtttaggaaacggttaaagtacggacctttacgaaacgtaaggttaccggacggtaaggggttaggtaacgtaggtacgtttagg

SEQ ID NO: 371334 - DNA, 533 bp, Homo sapiens
  misc_feature: GZ8MTXP02GN2RP.15.67.G01.1.454.CMB.2.raw
  modified_base (375)..(375): a, c, t, g, unknown or other
  modified_base (481)..(481): a, c, t, g, unknown or other
  modified_base (488)..(488): a, c, t, g, unknown or other
  modified_base (510)..(510): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagagttattggatgacctgggtccgccaggctccgaggggaaggggctggagtggggtggccaacataaaacaaagacggaagtcaagaaaaacctntgtggactctgtgacggccgattcaccatctccagagacaacgccaaagaattcactgtatttgacaaatgaaacagcctgagaggcgaggacaggccgtgtattntgtgcgngagatgatagtagactctaacngtagcgtaggtaggtatggtatg

SEQ ID NO: 371335 - DNA, 537 bp, Homo sapiens
  misc_feature: GZ8MTXP02IZD6G.15.67.G01.1.454.CMB.2.raw
  modified_base (346)..(346): a, c, t, g, unknown or other
  modified_base (385)..(385): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagttattggatgacctgggtccgccaggctccaggggaaggggctggagtggggtggccaaanataaacaaagacggaagtcaagaaaaacctatgtgactntgtgacggcgattcaccatctccagagacaacgccaaagattcactgtatttgacaaatgaaacagcctgaagagggcgaaggacacggcgtgtattattgtgcgtcgagatgatagtacgactctacaagtacgacgaggtgtatgacttg

SEQ ID NO: 371336 - DNA, 530 bp, Homo sapiens
  misc_feature: GZ8MTXP02GJ4OX.15.67.G01.1.454.CMB.2.raw
  modified_base (484)..(484): a, c, t, g, unknown or other
  modified_base (488)..(488): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttattggatgacctgggtccgcaggctccaggggaagggctgggagtgggtggccaaacataaaacaaagacggaagtacaagaaaaacctatgtggactctgtgacgggcgattcaccatctccagagacaacgccaagaatcactgtatttgacaaatgaacagcctgagagcgagacgaggcgtgtattagtgtgcgngagntagatagtacgactctaacaagtagcgtagggtgtatgattg

SEQ ID NO: 371337 - DNA, 555 bp, Homo sapiens
  misc_feature: GZ8MTXP02IB9R1.15.67.G01.1.454.CMB.2.raw
  modified_base (336)..(336): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcaccttagaagttatggatgactggtccgcaggctccgaggggagggctggagtgggtgccaanataaaacaaagacggaagttaaagaaaaactagtagtagactcgtgtagaacggccgtaattcacctatcctccagacgaacaaacgaccaaagtaactcactgttaattgacaaatgaaacagctaggacgaggcgaggacacggcgtagtatttatgtgcgcgagatggaattagacgtactactacgagtaagcgaggtggtatgtacttgttacg

SEQ ID NO: 371338 - DNA, 550 bp, Homo sapiens
  misc_feature: GZ8MTXP02GMA8L.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaaggggctggagtggggtggccaaacataaaacaaaagacggaaagtcaaggaaaaaaccctatagtaggaactctgtgaaccggggccgaattcacccatctaccagagacaaacgccaaagaattcactgtatttgacaaatgaaacagcctagagaggcgagacgacggccgtgtattattgtgcgcgagatgatacgtagactctacaagtagcgaggtgtatgattg

SEQ ID NO: 371339 - DNA, 553 bp, Homo sapiens
  misc_feature: GZ8MTXP02JBTGC.15.67.G01.1.454.CMB.2.raw
  modified_base (510)..(510): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttatggatgacctgggtccgccaggctccgaggggaaggggctgggagtggggtggccaaacataaaacaaagacggaagtacaagaaaaacctatagtggaactcgtgtagacgggccgattccaccatctaccagacgacaacgaccaagaattcactgtatttgacaaatgaaacagcctagagacggacggaggacacggcgtagtattatgtgcgcgagagngataggtacacgtactaacgaagtagcgaaggtgtatgattgg

SEQ ID NO: 371340 - DNA, 671 bp, Homo sapiens
  misc_feature: GZ8MTXP02H8A8J.15.67.G01.1.454.CMB.2.raw
  modified_base (636)..(636): a, c, t, g, unknown or other
tcagtctacgtagccacgaccggtgctcgatttagagtatacatattgggtttgaggtctcagagaggagccttagccccggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagaagttattggatgacctgggtccgccgaggcctccgaggggaaggggtcgtggggagtggggtcggacccaaagaataaaacaaaaggacggaaagtacaaagaaaaaactagtgtaggactcgtggtaggaaacggccagtttcaacctatcctaccaagaacgaaaccaaaccgacccaaagtaaacttcaacgttagttaatttacgactaaaaatttaaacaacgtaccttaggaaaggacgggacggaacgggaccgaaccgggtcccgttaggtttaatttagttcgggttggccggacgaaggtactaggtaaagttacggtaaagaccttaccgtaactaaggtacgngtaagggttggtatggtaacttggttacttttagg

SEQ ID NO: 371341 - DNA, 538 bp, Homo sapiens
  misc_feature: GZ8MTXP02HNKCD.15.67.G01.1.454.CMB.2.raw
  modified_base (303)..(303): a, c, t, g, unknown or other
  modified_base (377)..(377): a, c, t, g, unknown or other
  modified_base (449)..(449): a, c, t, g, unknown or other
  modified_base (483)..(483): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttatggatgacctgggtccnccaggctccgaggggaaggggctggagtggggtggccaaacataaaacaaagacggaagtcaagaaaaacctangtggactctgtgacggccgattcaccatctcagagacaacgccaagaattcactgtattgacaaatgaaacngcctgagaggcgagacacggctagtattattggngcgcgagatagaatacgtacgactacacgaagtagacgtagggtgtatgtagtcg

SEQ ID NO: 371342 - DNA, 667 bp, Homo sapiens
  misc_feature: GZ8MTXP02GH6G6.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcgtggtttctgttgttatttagaaggtgtcagtgtgagtgcacgttggtggagtcgtgggggaggcgttggtccgagggccggggggtccctggagactctcctgtgcagtctctggattcaccttagaagttattggatgaccgtgggtcccgccgaggctaccgaggggaacggggctgggaggtggggtcggaccaaaacgaagtaaaacaaaaggaccggaaagtaccgaaagaaaaaacctgtagtaggaacttcgtaggtacgaaccgggacctattaccaaccattcctaccgaagaacgaaccaaaccgacccaaaagtaacttactaacctggttaatttacgaactaaaaagtaacgaaacgaacgacgtaggaaggacgggacgggaacggaacggaccggtacggttacgttaagtttagttaggtacgacggtacgagtagtagtaagtaacgtaacgtacgtacgtaacgtaagtacgtacggtaggtaggtagtacgtagttg

SEQ ID NO: 371343 - DNA, 549 bp, Homo sapiens
  misc_feature: GZ8MTXP02JSM83.15.67.G01.1.454.CMB.2.raw
  modified_base (381)..(381): a, c, t, g, unknown or other
  modified_base (417)..(417): a, c, t, g, unknown or other
  modified_base (453)..(453): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccagggcccgggggggtccctggagactctcctgtgcagtctctggattcacccttagaagttattggatgacctgggtccgccaggctccgaggggaaggggctggaggtgggtggccaacataaaacaaagacggaagtcaagaaaaacctntgtaggactctgtgacggcgattccacatctcaganacaacgcaagattcactgtatttgctaaatgaaacncgcctagagaggcggagacgacgggccgtagtatttatgtgcggtacgagatggactaggtacgactctacgaagtacgcgtaggtgtatcgtatg

SEQ ID NO: 371344 - DNA, 533 bp, Homo sapiens
  misc_feature: GZ8MTXP02I38P5.15.67.G01.1.454.CMB.2.raw
  modified_base (376)..(376): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtcccaggcccgggggggtccctgagactctcctgtgcagtctctggattcacccttagaagttatggatgacctgggtccgccagactccgaggggaaggggctggagtgggtggccaacataaacaaagacgaagtcaagaaaaacctntgtgactctgtgacggccgattcaccatctccagagacaacgccaaagattcactgtatttgacaaatgaaacagcctagagaggcgaggacacggccgtgtattagttgtgcgcgagatgatacgtagactctacaagtgacagggtgtatgattg

SEQ ID NO: 371345 - DNA, 542 bp, Homo sapiens
  misc_feature: GZ8MTXP02F4R6P.15.67.G01.1.454.CMB.2.raw
  modified_base (515)..(515): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccaggggaaggggctggagtggggtggccaaacataaaacgaaagacggaagtacaagaaaaacctatagtaggactctgtgacggccgattcaccatctccagagacaaacgccaaagattcactgtatttgacaaaatgaaacagcctgagaggcgagacacggccgtgtatattgtagcgcgagatgaatacgtagactntacgaagtagacgaggtgtatgatttg

SEQ ID NO: 371346 - DNA, 539 bp, Homo sapiens
  misc_feature: GZ8MTXP02FVI6J.15.67.G01.1.454.CMB.2.raw
  modified_base (491)..(491): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccaggggaagggctggagtgggtggccaaacataaaacaaagacggaagtacaagaaaaacctatgtaggactctgtgacggccgattcacccatctccagagacaacgcaaagaattcactgtatttgactaaatgaaacagcctagagaggacgagacacggctgtattatgtgcgngagatgatagtacgactcgtaacaagtacgcgaggtggtatggattcg

SEQ ID NO: 371347 - DNA, 540 bp, Homo sapiens
  misc_feature: GZ8MTXP02IMMIE.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtcccgccaggctccgaggggaaggggctggagtgggtggccaaacataaacaaaagacggaagtacaagaaaaacctatgtggactctgtgacggccgattcaccatctccagagacaacgccaagaatcactgtatttgacaaatgaaacagcctgagaggcgagacacggccgtagtattagttagtgcgcgagagtgaatagtagactctaacaagtagacgtaggtagtatgatg

SEQ ID NO: 371348 - DNA, 579 bp, Homo sapiens
  misc_feature: GZ8MTXP02G8ZO4.15.67.G01.1.454.CMB.2.raw
  modified_base (304)..(304): a, c, t, g, unknown or other
  modified_base (410)..(410): a, c, t, g, unknown or other
  modified_base (464)..(464): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcctgttgttattttagaaggtgtccagtgtgaggtgcacttggtggagtcgtggggggaggcttggtccaggccgggggggtccctggagactctcctgtgcagtctctggattcacccttagaagttatggatgacctggtccncaggctccgaggggagggctggagtgggtggccaaacaataaaacgaaagaacggaatacaagaaaaacctatgtggactctagtagacggccgaatccaccatcnccagacgacaacgaccaagaattcactgtatttagacaaatagaaacagtaccngaagagggacggaaggaaccgacggccggtagttattaagttgtgaccggcgaagagtagtaagtacggtaagactacgtacgaagtacgacgtagggtaggtagtagatttcgg

SEQ ID NO: 371349 - DNA, 535 bp, Homo sapiens
  misc_feature: GZ8MTXP02GWPNB.15.67.G01.1.454.CMB.2.raw
  modified_base (305)..(305): a, c, t, g, unknown or other
  modified_base (344)..(344): a, c, t, g, unknown or other
  modified_base (373)..(373): a, c, t, g, unknown or other
  modified_base (402)..(402): a, c, t, g, unknown or other
  modified_base (441)..(441): a, c, t, g, unknown or other
  modified_base (476)..(476): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccnccaggctccgaggggagggctgggagtgggtggccaaanataaacaaagacggaatcaagaaaacctngtggactctagtgacgcgattcaccatcncagagacaacgcaagatcactgtattgacaaatgaaacngacctgagaggcgagacgacggcgtgtattagtgngcgcgtagatggataggtacgactctaacgaagtagacgtaggtaggtatcggatttag

SEQ ID NO: 371350 - DNA, 533 bp, Homo sapiens
  misc_feature: GZ8MTXP02GOL07.15.67.G01.1.454.CMB.2.raw
  modified_base (410)..(410): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaagggctggagtgggtgccaacataaacaaagacggaagtcaagaaaaacctatgtggactctgtagacggcgattcaccatctccaganacaacgcaaagattcactgtattgacaaatgaaacagcctagagaggcgagacacggccgtgtattagtgtgcgacgagatgatacgtagactactacaagtagcgtaggtggtaatggattg

SEQ ID NO: 371351 - DNA, 703 bp, Homo sapiens
  misc_feature: GZ8MTXP02FVWV8.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacgttggtggagtcgtgggggaggcgttgggtccagggcccgggggggtccctggacgactctcctgtgcagtctcgtggtattcaccttagaagttattggatgacctgggtccgccaggctccgaggggaagggctgggagtgggtggaccaaacaataaacgaaaggacggaagtacaaagaaaaacctagtggtggacttcgtagtacggaccgggccgtaattaccaaccctattacctacccaaggaaacgaaccgaaaccgcccaaaaggtaaacttccaacttggttaattttaggactaaaatcggaaaacacgacctagggaacggacgggaccgggaagggaacccgtaacggggtacccggtttagttttaaacgtttaaggtttggtacgggacggaaccggtaaggtaagttaggtaaaccgttaaagggttaaccgtacttacgtaaacgtaaggttaaggacgttaaggggtaggtaatcgggaatttcgg

SEQ ID NO: 371352 - DNA, 553 bp, Homo sapiens
  misc_feature: GZ8MTXP02JO39R.15.67.G01.1.454.CMB.2.raw
  modified_base (347)..(347): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcacccttagagttattggatgacctgggtccgccaggctccgaggggaaggggctggaggtgggtggccaaanataaaacaaaggacggaagtacaagaaaaacctagtagtaggactcgtgtgacggcgattcaccatctcagagacaacgacaagaattcactgtactttgacaaatagaaacagcctagagaggacggaggacgacggccgtagtattagttgtagcgcgagatagatagtacgactctaacgaagtagcgaggtgtagtgatttg

SEQ ID NO: 371353 - DNA, 532 bp, Homo sapiens
  misc_feature: GZ8MTXP02IQY0J.15.67.G01.1.454.CMB.2.raw
  modified_base (372)..(372): a, c, t, g, unknown or other
  modified_base (381)..(381): a, c, t, g, unknown or other
  modified_base (409)..(409): a, c, t, g, unknown or other
  modified_base (489)..(489): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttattggatgacctgggtccgccaggctccaggggaaggggctgggagtgggtggccaacataaacaaagacggaagtcaagaaaactntgtggactntgtgacgggccattcaccatctccaganacaacgccaaagaattcactgtatttgacaaatgaaacagcctagagacggcgaggacacggccgtgtattattgtgcgngagatgaatagtagactctacaagtagactaggtgtatgattg

SEQ ID NO: 371354 - DNA, 585 bp, Homo sapiens
  misc_feature: GZ8MTXP02G0IV2.15.67.G01.1.454.CMB.2.raw
  modified_base (370)..(370): a, c, t, g, unknown or other
tcagtctacgtagccacgaccggtgctcgatttagagtatacatattgggtttggggggtccctgagactctcctgtgcagtctctggattcacccttagaagttattggatgacctgggtccgccaggctccagggaaggggctggagtgggtggccaacataaacaaagacggaagtcagaaaaactatgtggactctgtgaacggccgattcaccatctccagagacaacgccaaagaattcactgtatttgcaaatgaacagcctgagaggcgaggacacggccgtgtattatgtgcgcgagatgatagtagactctacagtagcagggtgtatgatgtcttttgatatggtggggccaagggacnggtgtcaccgtcacttcagccctaccaccgaacgggcccagtccggtcccttcccccgtcggcccgccctcgcctccgaggacgccacccgtccgagacgcaaccgacggccggcccgtggggccgttcggaccgtcgggtaccgaaacggtacttaccgttccgaccttacgtacgaccgtggaacggccggcgtcgggacgaacggcgacaag

SEQ ID NO: 371355 - DNA, 586 bp, Homo sapiens
  misc_feature: GZ8MTXP02IAVCF.15.67.G01.1.454.CMB.2.raw
  modified_base (536)..(536): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcttgttgttattttagaaggtgtccagtgtgaggtgcacttggtggagtctgggggaggcttggtccaggccggggggtccctggagactctcctgtgcagtctctggattcacccttagaagttatggatgaccgtggtcccgccaggctccgaggggaaggggctgggaggtggggtggaccaaacgaataaaacgaaaaggaacgggaaagtacaaagaaaaaccctagtagtaggactctggtacgaacggccgaaattccaccattcaccagagaacaacgacaaagaattcactgtatttagacaaatagaaacagcctagagagggcggaaggacgaacggccgtagtattagttggtgacgtcggaagntagattagtaagaccttacacaaggtgacgtagggtaggtatgtacttgg

SEQ ID NO: 371356 - DNA, 530 bp, Homo sapiens
  misc_feature: GZ8MTXP02JUWBQ.15.67.G01.1.454.CMB.2.raw
  modified_base (339)..(339): a, c, t, g, unknown or other
  modified_base (380)..(380): a, c, t, g, unknown or other
  modified_base (396)..(396): a, c, t, g, unknown or other
  modified_base (399)..(399): a, c, t, g, unknown or other
  modified_base (487)..(487): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttatggatgacctgggtccgcaggctccgaggggagggctggagtgggtggccaanataaacaaagacggaagtcaagaaaaacctatgtggactcngtgacggcgattcacntcncagacgacacaccaagatcactgtattgacaatgaaacagcctagagaggcggaaggacgaccggtcgtagtattagtgtgcgcgagntagactagtacgactctacaagtagacgtaggtgtatgattcg

SEQ ID NO: 371357 - DNA, 552 bp, Homo sapiens
  misc_feature: GZ8MTXP02HNLGW.15.67.G01.1.454.CMB.2.raw
  modified_base (508)..(508): a, c, t, g, unknown or other
  modified_base (529)..(529): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctggagactctcctgtgcagtctctggattcacccttagaagttatggatgacctggtccgccaggatccgaggggagggctggagtgggtggccaaacataaaacaaaggaacggaagtacaaagaaaaaacctatgtggactcgtagtgaccggccgattcaccatctaccagacacaaacgaccaaagaattcactgtatttgacaaatgaaacagcctggaagagggacggaaggacgacggccgtagtattatgtgcgngagatgatacgtagactctanaagtagcgaggtgtatgaattcg

SEQ ID NO: 371358 - DNA, 533 bp, Homo sapiens
  misc_feature: GZ8MTXP02JZVMM.15.67.G01.1.454.CMB.2.raw
  modified_base (348)..(348): a, c, t, g, unknown or other
  modified_base (386)..(386): a, c, t, g, unknown or other
  modified_base (493)..(493): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctggagactctcctgtgcagtctctggattcacccttagaagttattggatgacctgggtccgccaggctccgaggggaaggggctggagtggggtggccaaanataaacaaagacgaagtcaagaaaaacctatgtgactngtgacggcgatcaccatctccagagacaacgccaaagaattcactgtatttgacaaatgaaacagcctgagaggcgagacacggcgtagtattagtgtgcgcgaganggaataggtacactctaacgaagtagcagggtgtatgatg

SEQ ID NO: 371359 - DNA, 525 bp, Homo sapiens
  misc_feature: GZ8MTXP02HZ0X6.15.67.G01.1.454.CMB.2.raw
  modified_base (481)..(482): a, c, t, g, unknown or other
  modified_base (505)..(505): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaaggggctgggagtggggtggccaaacataaacaaagacggaagtcagaaaaacctatgtggactctgtgacggccattcaccatctcagagacaacgccaagaatcactgtatttgacaaatgaaacagcctagagaggcgaggacacggcgtgtattatgnngcgagatgatagtagactcctanaagtagacaggtgtatgatg

SEQ ID NO: 371360 - DNA, 554 bp, Homo sapiens
  misc_feature: GZ8MTXP02GBCG1.15.67.G01.1.454.CMB.2.raw
  modified_base (310)..(310): a, c, t, g, unknown or other
  modified_base (347)..(347): a, c, t, g, unknown or other
  modified_base (380)..(380): a, c, t, g, unknown or other
  modified_base (409)..(409): a, c, t, g, unknown or other
  modified_base (412)..(412): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccagggcccgggggggtccctggagactctcctgtgcagtctctggattcacccttagaagttattggatgacctgggtccnccaggctccgaggggagggctggagtgggtggccaanataaacgaaagacggaagtacaagaaaaacctntagtggactctgtgaccggcgattcaccntcncagagacaacgcaaagatcactgtatttgacaaatgaaacagccgtagaggaggcggaaggacgacggcgtgtattatgtgcgacgagatgatagtacgactctaacgaagtacggacgtagggtaggtactggtatttcgg

SEQ ID NO: 371361 - DNA, 552 bp, Homo sapiens
  misc_feature: GZ8MTXP02JWUTN.15.67.G01.1.454.CMB.2.raw
  modified_base (375)..(375): a, c, t, g, unknown or other
  modified_base (402)..(402): a, c, t, g, unknown or other
  modified_base (405)..(405): a, c, t, g, unknown or other
  modified_base (410)..(410): a, c, t, g, unknown or other
  modified_base (459)..(459): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggattcacccttagaagttatggatgacctgggtccgccaggctccgaggggaagggctgggagtgggtggccaacataaacaaagacgaagtcaaagaaaaacctntgtggactctgtgacggcgattcaccntcncaganacaacgccaagacttcactagtatttgacaaatcgaaactagcctgagnggacggaggacgaccggcgtagtattagttgtagcgtacgagagtgagtagtacgacttcgaacgaagtacgacgtagggtgtatggacttgg

SEQ ID NO: 371362 - DNA, 561 bp, Homo sapiens
  misc_feature: GZ8MTXP02HCFYZ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggattttccttgttgttattttagaaggtgtcagtgtgaggtgcacttggtggagtctgggggaggcttgggtccaggccgggggggtccctgagactctcctgtgcagtctctggattcacccttagaagttatggatgacctgggtccgccaggctccgagggaaggggctggagtgggtggaccaaacgataaaacaaaagacggaaagtcaaagaaaaaactatgtggactctggtgaaacggccgaattcaccatctaccagagacaaacgccaaagaattcaactgtaatttgacaaatagaacagacagagaggagaggacgacggaccgtgtagttagttagtgcgacgagagagagtagtacgtaatacctaacgagtagacgtaggtaggtagtagtag

SEQ ID NO: 371363 - DNA, 803 bp, Homo sapiens
  misc_feature: GZ8MTXP02I3Q0H.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagaagttatggatgacctgggccgccaggctccgaggggaagggcgtggaggtggggtggccaaacataaaacaaaaggacggaaagtacgaaagaaaaacctataggtggaacttctaggtagaaccggggccgtaatttcccgaacctactacttacccaaggaacgaaaccgaaaccgaccccgaaaaggtaaactttacccgaaactttacggtttaaagtttttacggaaaccctaaaaagttacggtaaaaaccaacggtacccctttaagggaacgggaaacggggaccggggaaaacgggggaaacccggaaaccccgggggttaccccgggtttaacgggtttaaacgtttttaacggtttaggggtttacggggcccggttaaccgggaaagggtaaacgttacgggtaaaaggtttaaaggtaaacgggttaaacccttaccttaaaaccggtaaggttaacggtaaccgggtaacgggggttaagggttacgtttacggggtaacttttcggg

SEQ ID NO: 371364 - DNA, 539 bp, Homo sapiens
  misc_feature: GZ8MTXP02F0XJQ.15.67.G01.1.454.CMB.2.raw
  modified_base (339)..(339): a, c, t, g, unknown or other
  modified_base (371)..(371): a, c, t, g, unknown or other
  modified_base (486)..(486): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcaccttagagttatggatgactggtccgccaggctccgaggggaggggctggagtgggtggccaanataaacaaagacggaagtacaagaaaaacctntgtaggactctgtgacggccgattcaccatctccagagacaacgccaaagaattcactgttatttgacaaaatgaaacagcctagagaggcgaggacacggcgtgtattatgtgngtacgagatggaatacgtagactctaacgaagtaagcgaggtgtatgagtttg

SEQ ID NO: 371365 - DNA, 556 bp, Homo sapiens
  misc_feature: GZ8MTXP02IQ85L.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctgagactctcctgtgcagtctctggattcacccttagaagttattggatgacctgggtccgccaggctccgaggggaaggggctggagtgggtggccaaacataaaacaaagacggaagtacaagaaaaaccctatgtaggactcgtggtagaaccgggccgaattccaccatctccaagacgacaacgccaaagaattcactgtatttgacaaatgaaacagcctagagaggcgaggacacggccgtgtattagttagtgcgcgagatgaatagtacgactctaacgaagtagcgtaggtagtatgattg

SEQ ID NO: 371366 - DNA, 754 bp, Homo sapiens
  misc_feature: GZ8MTXP02G7GNK.15.67.G01.1.454.CMB.2.raw
  modified_base (376)..(376): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccaggcccgggggggtccctgagactctcctgtgcagtctctggattcacccttagaagttattggatgacctggtccgcaggctccgaggggaggggctggagtgggtggccaacataaaacaaagacggaagtacaagaaaaacctntagtggactcgtgtaggaccgggccgtaattccgaacctattcctacccgaaggaacgaaccaaaccggacccaaaaggtaaactttaccgaacttacggttaaatttttacggaaccgtaaaattacggtaaaacctaacgggacccgttagggaaagggacgggaaccgggaacggggtaaaccgaaccgggggtaccccggttaggggttaaacttttaagtttcgggttagggtaccggtaccgggaaaggtaagtttagggaaacgttaagggttaaacgggtaaacccgttacccttaaaacgtaacgggttaaaggaaccggttaaacgggggttagggtttaaacgttacgggttaaacgttttaccggg

SEQ ID NO: 371367 - DNA, 708 bp, Homo sapiens
  misc_feature: GZ8MTXP02HCXWK.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccgaggctccgaggggaaggggctgggagtgggtggccaaacaataaacaaaggacggaagtacaaagaaaaaccctagtgtaggactcgtagtaggaccgggcccgtattccgaccactcctacccgaagacgaaccaaaccggacccaaaggtaaactttaccaacttaggttaattttagaacctaaaagttcgaaaaccgacgacccgttaggaaaggacggggaccggaaagggaacccgaacggggtcccggttaggttaaacgtttaagttggtacggacccggacggtaaggtaattaggtaaagttaaacggttaacggtaaaccttaccgttaaaaccgaaggtttaaaccgggacggttaacggggttaggtaagttacggtaacgtttagg

SEQ ID NO: 371368 - DNA, 567 bp, Homo sapiens
  misc_feature: GZ8MTXP02HR6EI.15.67.G01.1.454.CMB.2.raw
  modified_base (304)..(304): a, c, t, g, unknown or other
  modified_base (371)..(371): a, c, t, g, unknown or other
tcagtctacgtagccacgaccggtgctcgatttagagtatacatattgggtttggggggtccctgagactctcctgtgcagtctctggattcacccttagaagttattggatgacctgggtccgccaggctccagggaaggggctggagtgggtggccaacataaacaaagacggaagtcaagaaaaactatgtggactctgtgaacggccgattcaccatctccagagacaacgccaagaattcactgtatttgcaaatgaacagcctgagaggcgaggacacggccgtgtattattgtgcgngagatgatagagactctacagtagcaggtggtatgtatttcttttgatatgtggggaccaagggacngtggtcacgtcacttcacgcctccaccaaggcccatccggtccttcccccgtggcccgccctgcctccgaggacgccaccgtcccgagacgcacgacgtccggccccgtgggctcgacccgtgggacaaacgggcttaccgttccgccttaacggtacgaccgtgaggccgggcgtcggacgaaaggcgacaagtg

SEQ ID NO: 371369 - DNA, 528 bp, Homo sapiens
  misc_feature: GZ8MTXP02JC9DB.15.67.G01.1.454.CMB.2.raw
  modified_base (369)..(369): a, c, t, g, unknown or other
tcagtctacgtagccacgaccggtgctcgatttagagtatacatattgggtttggggtctcagagaggagccttagccctggactccaaggcctttccacttggtgatcagcactgagcacagaggactcaccatggagttggggctgagctgggtttccttgttgttatttagaaggtgtccagtgtgaggtgcacttggtggagtctgggggaggcttggtccaggccggggggtccctgagactctcctgtgcagtctctggattcacccttagaagttattggatgacctgggtccgccaggctccgagggaaggggctggagtgggtggccaacataaacaaagacggaagtcaagaaaaactntagtggactctgtgaacggccgattcaccatctccagagacaacgccaaagaatcactgtattgacaaatgaacagcctgagagcggagacgacggccgtagtattatgtgcgcgagatgatagtacgactactacagtaagcaggtggtatgatgttg

SEQ ID NO: 371370 - DNA, 624 bp, Homo sapiens
  misc_feature: GZ8MTXP02JZQS3.15.67.G01.1.454.CMB.2.raw
  modified_base (596)..(596): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccgaggcccgggggggtccctgagactctcctgtgcagtctctggattcacccttagaagttattggatgacctgggtcccgccaggctccgaggggaaggggctgggagtggggtggaccaacaataaaacaaaagaccggaaagtacaaagaaaaaccctagtagtacgggaactcgtggtaggaaccgggcccgaattccaccaatccctaccaacggagaaccaaaccgacccaaaaggaactttacactgtattttagacaaatagaaacagcctagaggaggacggaaggaccacggggacccgtaggttaattagttagttggacgtacggtaggatggaaataggtacgtactaccgtaanaagttacgcgtagggtgtatacgtattg

SEQ ID NO: 371371 - DNA, 562 bp, Homo sapiens
  misc_feature: GZ8MTXP02FYKGI.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggctttggtccgaggccggggggtccctgagactctcctgtgcagtctctggattcacccttagaagttattggatgacctgggtccgccgaggctccgaggggaaggggctggagtggggtggaccaaacaataaaacgaaagacggaagtacaagaaaaacctatgtaggactctgtgacggccgattcaccatctccagagacaacgacaaagattcactgtatttgacaaatgaaacagcctagagaggacggaggaccgacggccgtagttattagttgtagcggacgagtatagaagtaggtacactctaacaaggtagagaggttggtaatgatttg

SEQ ID NO: 371372 - DNA, 564 bp, Homo sapiens
  misc_feature: GZ8MTXP02GEPNR.15.67.G01.1.454.CMB.2.raw
  modified_base (536)..(536): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcaccttagagttattggatgacctgggtccgccaggctccgaggggaaggggctgggaggtggggtggaccaacaataaaacgaaaggaacggaagtacaaagaaaaacctatagtggactcgtggtagaccgggccgattccaccatctccaagagacaacgccaaagaacttcactgtatttgacaaatgaacagcctgagaggacgaggacgacggccgtagtattattgtcgcgacgagatgagtagtacgactacgtanaagtacgacgtagggtagtatgtagttg

SEQ ID NO: 371373 - DNA, 564 bp, Homo sapiens
  misc_feature: GZ8MTXP02HCJ6N.15.67.G01.1.454.CMB.2.raw
  modified_base (376)..(376): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccgaggggaaggggctgggagtgggtggccaacataaacaaagacggaagtacaagaaaaacctntagtggactctgtagacggccgattccaccatctccagagacaacgaccaaagaacttcacttagtatttagactaaatagaaacagacctggagaggcgaaggacgacgggaccgtgtattagttgtagcgtacgagatgaatagtacgactactaacaagtacgcgtaggtaggtagtagtattgg

SEQ ID NO: 371374 - DNA, 536 bp, Homo sapiens
  misc_feature: GZ8MTXP02F6SGA.15.67.G01.1.454.CMB.2.raw
  modified_base (507)..(507): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtcccaggccgggggggtccctggagactctcctgtgcagtctctggattcacccttagaagttattggatgacctgggtccgccaggctccaggggaaggggctggagtgggtggccaacataaaacaaagacggaagtcaagaaaaacctatgtggactctgtgacggccgattcaccatctccagagacaacgccaaagaattcactgtaattgacaaatgaacagcctgagagcggagacgacggccgtgtattatgtgcgcgagatgatagtagactntacgaagttagcgaggtgtagtgtacttg

SEQ ID NO: 371375 - DNA, 578 bp, Homo sapiens
  misc_feature: GZ8MTXP02JDZAN.15.67.G01.1.454.CMB.2.raw
  modified_base (460)..(460): a, c, t, g, unknown or other
  modified_base (516)..(516): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccaggggaagggctggagtgggtggccaacataaacaaagacggaagtacaagaaaaaccctatgtaggactctagtgacggccgaattcacctatctccgagacaacaaccgaccaaagacttacacgtagttatttagactaaaangtaaacagacctaggacgaagggacggaaggaccgacgggccgtagtattagttgngcgacgtagatagaatacggtacacttcaacgtaagtagcgtaagggtgtaagtgactttgg

SEQ ID NO: 371376 - DNA, 534 bp, Homo sapiens
  misc_feature: GZ8MTXP02IXCWP.15.67.G01.1.454.CMB.2.raw
  modified_base (512)..(512): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagagttatggatgacctgggtccgccaggctccgaggggaaggggctggagtggggtggccaaacataaacaaagacggaagtacaagaaaaacctatgtggactctgtgacggccgatcaccatctccagagacaacgccaagaattcactgtatttgacaaatgaaacagcctagagaggcgaggacacggcgtgtattagttgtgcgcgagatgaatacgtagactcanaagtagcgtaggtgtatgattg

SEQ ID NO: 371377 - DNA, 550 bp, Homo sapiens
  misc_feature: GZ8MTXP02H5T6E.15.67.G01.1.454.CMB.2.raw
  modified_base (304)..(304): a, c, t, g, unknown or other
  modified_base (464)..(464): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcaccttagaagttatggatgacctggggtccnccaggctccgaggggaaggggctgggaggtgggtggccaaacataaaacaaagacggaaagtcaagaaaaacctatagtggactcgtgtagaccgggccgtaattccaccatctaccagagacaacgccaaagaactcactgtatttgacaaatgaaacngacctagagaggcgaggacgacggcgtgtattagtgtgcgcgagatcgatagtacgactctacaagtagacgaggtgtatgacttg

SEQ ID NO: 371378 - DNA, 699 bp, Homo sapiens
  misc_feature: GZ8MTXP02JAV65.15.67.G01.1.454.CMB.2.raw
  modified_base (263)..(263): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggttttccttgttgttatttagaaggtgtccagtgtgaggtgcacttggtggagtcgtgggggaggcttgggtccaggcccggggggtccctggagactctcctgtgcgngtctcgtggtacttcctaacccgttaagaagtttagttggatacgtccgtcgggtccccgccgaggcctaccggaagggggaacgggtcgtagggaggtggggtcggaccaaaacgaaagtaaaaacgaaacggaaacggaaacgtacgaaaaagtaaaaaacccttagttaggtacggtaaccttcgttaggacggaacccggggtccgtaactttccaaacccctattcccctacgaagaaccgaaaccgaaaccgacccaaaagtaacttacccgacttagtttaattcgaaacttaaaagacgaaacgacgtacgtaggagggacggacggaacggtaccgacggtcgttagttagttgtgcgacgagagtagagtaacgttacgtacgtactacgtaagtaaggtacgacggtaggtagtagtcgttatcg

SEQ ID NO: 371379 - DNA, 618 bp, Homo sapiens
  misc_feature: GZ8MTXP02G9J5I.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgaggcccgggggggtccctggagactctcctgtgcagtctctggattcacccttagaagttattggatgacctgggtcccgccaggctccgaggggaaggggctggaggtggggtggccaaacaataaaacgaaagacggaaagtacaaagaaaaacctagtagtaggaacttctaggtaggaaccgggcccgaaattccaaaccctatcctaccaagagaaccaaaccgaccaaagaattcaactgtatttgaacaaatagaaacagacctagagaggacggaaggacacgggccgtagtattagttgtcgcgtacgagtataggtaattaaggtacgaacgtcgtaaacgaagttaaggacgtaagggtggtagtaggtaactttgg

SEQ ID NO: 371380 - DNA, 564 bp, Homo sapiens
  misc_feature: GZ8MTXP02GOSAL.15.67.G01.1.454.CMB.2.raw
  modified_base (403)..(403): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttctgtgtatttagaaggtgtcagtgtgaggtgcacttggtggagtcgtggggggaggcttgggtccaggccgggggggtccctgagactctcctgtgcagtctctggattcacccttagaagttatggatgacctgggtccgccaggctccgaggggagggctgggagtgggtggtcaacataaaacaaagacggaagtcaagaaaaacctatgtaggactcgtgtgacgggccattccaccatcnccaagagacaaacgccaaagaattacacttagtatttgactaaaatgaaacagcctagagaagggcggaagacgacggcgtgtaatttgtggtgcggacgagtatgtagtaacggttaacgacttactaagtaagtagacgtacggtaggtagtagtagtg

SEQ ID NO: 371381 - DNA, 551 bp, Homo sapiens
  misc_feature: GZ8MTXP02HWIE0.15.67.G01.1.454.CMB.2.raw
  modified_base (343)..(343): a, c, t, g, unknown or other
  modified_base (413)..(413): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctggggtccgcaggctccgaggggagggctggagtgggtggccaaanataaaacaaagacggaagtcaaagaaaaacctatgtaggactcgtgtgacgggcattcaccatctcaganacaacgccaaagaacttcactgtatttgacaaatgaaacagcctaggagaggcgaacggacacgggcgtagtattagtgtgcgtacgagatacgatagtacgactctaacgaagtagacgtagggtagtatcgtattg

SEQ ID NO: 371382 - DNA, 567 bp, Homo sapiens
  misc_feature: GZ8MTXP02JYM9J.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgccaggctccgaggggaaggggcgtggaggtggggtggccaaacataaacaaagacggaagtacaagaaaaacctagtagtaggactcgtgtagaccgggccgaattccaccactctacccagacgacaaacgacccaaagaacttcacttgtatttgactaaatagaacagcctagagagggacggaaggacgacgggccgtgtattagttgtgcgcgagatggaatagtagactactacaagtagacgaggtggtatgattg

SEQ ID NO: 371383 - DNA, 538 bp, Homo sapiens
  misc_feature: GZ8MTXP02FP0DF.15.67.G01.1.454.CMB.2.raw
  modified_base (516)..(516): a, c, t, g, unknown or other
  modified_base (522)..(522): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttgggtccaggccgggggggtccctgagactctcctgtgcagtctctggattcacccttagaagttattggatgacctgggtccgccaggctccgaggggaaggggctgggagtgggtggccaacataaacaaagacggaagtacaagaaaaacctatgtggaactctgtgacgggccgattcaccatctccagagacaacgccaaagaattcactgtatttgcaaaatgaaacagacctgagagggcgaaggacacggccgtgtattatgtgcgcgagatgatagacgactctanaagtancgaggtggtatgatcg

SEQ ID NO: 371384 - DNA, 557 bp, Homo sapiens
  misc_feature: GZ8MTXP02JZCSV.15.67.G01.1.454.CMB.2.raw
  modified_base (456)..(456): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttattggatgacctgggtccgcaggctccgaggggaagggcgtggaggtggggtggccaacataaaacaaaggacggaatcaagaaaaacctgtgtggactctgtagacggccgattccacatctccagacgacaacgaccaaagattcattcgtatttgactaaatgaaacngcctagagaggacgagacgacggtcgtagtattagtgtgcgtacggagagtggtataggtacgactaccgttaagaagtagacgaggtggtactgatttgg

SEQ ID NO: 371385 - DNA, 543 bp, Homo sapiens
  misc_feature: GZ8MTXP02HDVOJ.15.67.G01.1.454.CMB.2.raw
  modified_base (413)..(413): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctggagtggggtggccaacataaacaaagacggaagtacaagaaaaacctatgtggactctgtgacggcgattcaccatctccaganacaacgcaagatcactgtatttgacaaatgaaacagacctagagaggcggaggacgacggccgtagtattagtgtgcgcgagatgatagtagactctacgaagtacgacgtagggtaggtatggtattgg

SEQ ID NO: 371386 - DNA, 545 bp, Homo sapiens
  misc_feature: GZ8MTXP02JI76H.15.67.G01.1.454.CMB.2.raw
  modified_base (378)..(378): a, c, t, g, unknown or other
  modified_base (409)..(409): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggtctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgcaggctccgaggggaaggggctggaggtgggtggccaaacaataaaacaaagacggaagtacaagaaaaacctntgtagactctgtgacggccgattcaccatcncagagacaacgcaagattcatgtatttgacaaatgaaacagcctgaacgaggacgaggactacgggccgtagtattagtgtgcgcgagatggaataggacgtaactctaagaagtagcagggtgtatggatttcgg

SEQ ID NO: 371387 - DNA, 559 bp, Homo sapiens
  misc_feature: GZ8MTXP02IE792.15.67.G01.1.454.CMB.2.raw
  modified_base (344)..(344): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggcttggtccaggcccgggggggtccctgagactctcctgtgcagtctctggattcacccttagagttatggatgacctgggtccgcaggctccgaggggaaggggctgggagtgggtggccaanataaaacaaagacggaagtcaagaaaaacctatgtggactcgtgtagacgggcgattcaccatctccagacgacaacgaccaaagaattcactgtatttgacaaatgaaacacgcctaggagacgggcgaaggacgacggccgtgttacttatgtgcgtacgagatagatagtacgacttcaacgaagttagacgtaggtaggtactggattcgg

SEQ ID NO: 371388 - DNA, 536 bp, Homo sapiens
  misc_feature: GZ8MTXP02FZS79.15.67.G01.1.454.CMB.2.raw
  modified_base (416)..(416): a, c, t, g, unknown or other
  modified_base (492)..(492): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctggagtgggtggccaaacataaacaaagacggaaagtacaagaaaaacctatgtggactctgtgacgggccgattcaccatctccaganacaacgccaaagaattcactgtatttgacaaatgaaacagacctgagaggcgaggacacggcgtgtatatgtgcgngagatgatagtagactctacaagtagacgaggtgtaatgattcg

SEQ ID NO: 371389 - DNA, 538 bp, Homo sapiens
  misc_feature: GZ8MTXP02JCKKM.15.67.G01.1.454.CMB.2.raw
  modified_base (516)..(516): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttgggtccaggccgggggggtccctgagactctcctgtgcagtctctggattcacccttagaagttattggatgacctgggtccgccaggctccgaggggaaggggctgggagtggggtggccaaacataaaacaaagacggaagtacaagaaaaacctatgtgactctgtgacggccgattcaccatctcagagacaacgccaaagaattcactgtattgacaaatgaaacagcctgagaggcgaggacacggcgtgtattagtgtgcgtacgaggatggattagacgactctanaagtagcgaggtgtatgattcg

SEQ ID NO: 371390 - DNA, 559 bp, Homo sapiens
  misc_feature: GZ8MTXP02FTLP5.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctggaggtgggtggccaaatataaacaaaagacggaagtacaagaaaaacctatagtaggactcgtagtagacgggccgattcaccatctccagagacaacgcaaagatcactgtatttgacaaatgaaacagacctagagaggcggaaggaccgacggccgtagtattattagtgcgacggagatgataagtacgactctaacgaagtagacgtaaggtggtatggtacttg

SEQ ID NO: 371391 - DNA, 564 bp, Homo sapiens
  misc_feature: GZ8MTXP02INZZ1.15.67.G01.1.454.CMB.2.raw
  modified_base (389)..(389): a, c, t, g, unknown or other
  modified_base (481)..(481): a, c, t, g, unknown or other
  modified_base (507)..(507): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtacacttggtggagtcgtgggggaggcttgggtccaggcccgggggggtccctgagactctctgtgcagtctctggattcacccttagaagttattggatgacctgggtcccgcgaggctccgaggggaggggctggagtggggtggaccaacaataaaacgaaagacggaagtacaaagaaaactatgtgactcngtagaacggccgattccaaccatcctaccagacgacaacgaccaaagaacttcactagttatttagactaaatagaacagcctagaggaggngacggacacggccgtagtattattgngacgcgagagtagatagtacgactactacagtaagcgaggtgtagtgtagtgttacg

SEQ ID NO: 371392 - DNA, 543 bp, Homo sapiens
  misc_feature: GZ8MTXP02JVY1X.15.67.G01.1.454.CMB.2.raw
  modified_base (375)..(375): a, c, t, g, unknown or other
  modified_base (517)..(517): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccgggggggtccctgagactctcctgtgcagtctctggattcacccttagaagttattggatgacctgggtccgcaggctccaggggaaggggctggagtgggtggccaacataaaacaaagacggaaagtcaagaaaaacctntagtggactctgtgacgggccgattccaccatctaccagagacaacgccaaagaattcactgtatttgacaaatgaaacagcctgagaggcgaggactacggccgtgtatatgtgcgcgagatggaatagtagactctaaanaagtagacgaggtagtagtagtagtg

SEQ ID NO: 371393 - DNA, 551 bp, Homo sapiens
  misc_feature: GZ8MTXP02HIT5Y.15.67.G01.1.454.CMB.2.raw
  modified_base (424)..(424): a, c, t, g, unknown or other
  modified_base (465)..(465): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctggagactctcctgtgcagtctctggattcacccttagaagttattggatgacctgggtccgccaggctccgaggggagggctggagtgggtggccaacataaaacaaagacggaaagtcaaagaaaaaccctagtgtaggactctgtgaccgggccgattccaccatctaccagaanacaaacgaccaaagaattcactgtatttgacaaatgaaacngcctagagagggcgagacgacggcgtgtattatgtgcgcgagatagatagtacgactctaacaagtagacgtaggtgtatgtattg

SEQ ID NO: 371394 - DNA, 546 bp, Homo sapiens
  misc_feature: GZ8MTXP02HFTGE.15.67.G01.1.454.CMB.2.raw
  modified_base (303)..(303): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttatggatgacctgggtccnccaggctccaggggagggctggagtggggtgccaacataaacaaagacggaagtacaagaaaaacctatgtggactctgtgacggccgattcaccatctaccagagacaacgaccaaagaattcacttgtatttgacaaatgaaacagcctggagaggcggaaggaccgacggccgtgtattattggtgcgtcgagatgaatagtagactctaacaaggtagacgtagggtggtatgacttgg

SEQ ID NO: 371395 - DNA, 554 bp, Homo sapiens
  misc_feature: GZ8MTXP02JHQRV.15.67.G01.1.454.CMB.2.raw
  modified_base (377)..(377): a, c, t, g, unknown or other
  modified_base (386)..(386): a, c, t, g, unknown or other
  modified_base (449)..(449): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctggagtgggtggccaaacataaacaaagacggaagtacaagaaaaacctntgtgactcngtgacggcgatcaccatctaccagaacgacaaacgccaagaacttcactgtatttagacaaangaaacagcctgacgaggcgaaggacgaacggcgtgtattagttgtgcgacgagatcgatagtacgactctaacgaagtaacgcgaagggttggtaatgtagttgg

SEQ ID NO: 371396 - DNA, 545 bp, Homo sapiens
  misc_feature: GZ8MTXP02HS748.15.67.G01.1.454.CMB.2.raw
  modified_base (345)..(345): a, c, t, g, unknown or other
  modified_base (456)..(456): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgccaggctccgaggggaaggggctgggagtgggtggccaaanataaaacaaagaacggaagtcaaagaaaaacctatagtggactctgtgacggccgattcaccatctccagacacaacgccaaagaattcactgtatttgacaaatgaaacngcctgagaggcgagacgacggcgtgtattatgtgcgcgagatgatagtacgactactacaaggtagacgtagggtgtactgaatttcgg

SEQ ID NO: 371397 - DNA, 548 bp, Homo sapiens
  misc_feature: GZ8MTXP02JK83U.15.67.G01.1.454.CMB.2.raw
  modified_base (370)..(370): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttatggatgacctgggtccgcaggctccaggggaaggggctggagtgggtgccaacataaaacaaagacgaagtcaagaaaaacctntagtgactctgtgacggccgattcaccatctccagacgacaacgacaaagattacactgtatttagacaaatagaacagacctagagaggacggacggacgacggaccgtagtagtagttagtgcgcgagatagagtagtagactactaagaagtagacgaggtaggtagtagtagtg

SEQ ID NO: 371398 - DNA, 548 bp, Homo sapiens
  misc_feature: GZ8MTXP02G4ARF.15.67.G01.1.454.CMB.2.raw
  modified_base (418)..(418): a, c, t, g, unknown or other
  modified_base (525)..(525): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccgaggccggggggtccctgagactctcctgtgcagtctctggattcacccttagaagttatggatgacctgggtccgcaggctccgaggggaaggggctggagtgggtggccaaacgataaaacgaaagaacggaagtacaagaaaaacctatagtaggactcgtgtagacggcgattcaccatctccaganacaacgcaagaatcactagtatttgactaaatgaaacagcctagagaggcggaaggaccgacggccgtagtattattgtgccgagagatagatacgtagacttcaanaagtacgactaggtgtatgattg

SEQ ID NO: 371399 - DNA, 590 bp, Homo sapiens
  misc_feature: GZ8MTXP02JV8FO.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattccacccttagaagttatggatgacctgggtccgccaggctccgaggggaaggggctgggaggtggggtggaccaacgaataaaacgaaaggacggaagtacaagaaaaaccctgtgtaggactcgtgtgacggccgattccaccatctccagacgacaacgaccaaagaacttcactagtatttagactaaatgaaacagccgtagaaggaggcggaaggaccgaccggaccgttagtagttattggtgcggacgagagtagtaataaggtacgactactacgaaggtacgacgtaggggtggtaagtggagtttgg

SEQ ID NO: 371400 - DNA, 538 bp, Homo sapiens
  misc_feature: GZ8MTXP02HMRQ5.15.67.G01.1.454.CMB.2.raw
  modified_base (416)..(416): a, c, t, g, unknown or other
  modified_base (516)..(516): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctgggagtggggtggccaaacataaacaaagacggaagtacaagaaaaacctatgtggactctgtgacggccgattcaccatctccaganacaacgcaagattcactgtatttgcaaatgaaacagcctagagaggacggaggtacacggcgtgtattatgtgcgcgtagatgatacgtagacttactanaagtagacagggtgatggattg

SEQ ID NO: 371401 - DNA, 546 bp, Homo sapiens
  misc_feature: GZ8MTXP02G0A44.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctgagactctcctgtgcagtctctggattcacccttagaagttattggatgacctgggtccgccaggctccgaggggaaggggctggaggtgggtggccaaacgaataaacaaaggacggaaagtacaagaaaaaccctatgtaggactctgtgaccggcgattcaccatctcagagacaacgccaagaatcactgtatttgacaaatgaaacagcctgagaggcgaggaccacggcgtagtattatgtagcgtcgagatggataggtacgactctaacaagtagacgaggtggtatgattg

SEQ ID NO: 371402 - DNA, 544 bp, Homo sapiens
  misc_feature: GZ8MTXP02IZ5HH.15.67.G01.1.454.CMB.2.raw
  modified_base (378)..(378): a, c, t, g, unknown or other
  modified_base (499)..(499): a, c, t, g, unknown or other
  modified_base (522)..(522): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgccaggctccgaggggaagggctggagtgggtgccaacataaaacgaaagaacggaagtacaaagaaaaaccctntagtaggactcgtaggtcgacgggccgattccaccatctaccagacacaacgacccaagaattcactgtatttgacaaatgaaacagcctagagaggcgagacgcggctgtatagtgtgcngagagtagatagtacgactacanaagtagctaggtgtatgatttg

SEQ ID NO: 371403 - DNA, 562 bp, Homo sapiens
  misc_feature: GZ8MTXP02JZLL4.15.67.G01.1.454.CMB.2.raw
  modified_base (386)..(386): a, c, t, g, unknown or other
  modified_base (391)..(391): a, c, t, g, unknown or other
  modified_base (393)..(393): a, c, t, g, unknown or other
  modified_base (408)..(408): a, c, t, g, unknown or other
  modified_base (509)..(509): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccgagccgggggggtccctgagactctcctgtgcagtctctggattcacccttagaagttattggatgacctggggtccgccaggctccgaggggaaggggctgggagtggggtggccaaacataaaacaaagacggaaagtcaagaaaaaccctatgnggacncncgtgacggcgattcncatctaccagagaccaacgacccaagaattcactgtattgacaaatagaacagcctgacgagggcggaaggcacggcgtagtatagttgtagcgcgaagtnacgtatacgaacgtactaccgtaacgaagtagcgaggttaggtatagtagaag

SEQ ID NO: 371404 - DNA, 542 bp, Homo sapiens
  misc_feature: GZ8MTXP02FUNMO.15.67.G01.1.454.CMB.2.raw
  modified_base (381)..(381): a, c, t, g, unknown or other
  modified_base (392)..(392): a, c, t, g, unknown or other
  modified_base (412)..(412): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaaggggctggagtggggtggccaaacataaaacaaaagacggaaagtacaagaaaaaacctntgtaggactcngtgacggccattcaccatcnccagagacaacgcaaagaattcactgtatttgacaaaatgaaacagcctagagaggcgagacacggcgtgtattatgtgcgacgagatagagtagtagactactacaagtagacgaggtaggtagtgatg

SEQ ID NO: 371405 - DNA, 552 bp, Homo sapiens
  misc_feature: GZ8MTXP02J1JNG.15.67.G01.1.454.CMB.2.raw
  modified_base (345)..(345): a, c, t, g, unknown or other
  modified_base (377)..(377): a, c, t, g, unknown or other
  modified_base (544)..(544): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccaggcccgggggggtccctggagactctcctgtgcagtctctggattcacccttagaagttatggatgacctgggtccgccaggctccaggggaagggctggagtggggtggccaanataaacaaagacggaaagtcaagaaaaacctntgtaggactctgtgacggccgattcacatctaccagagacaacgccaaagattcactgtatttgactaaatgaaacagcctaggagagggacgagggtacacgggccgtagtattattgtagcgtcgagatggaatgtacgactctaacgaagtagcgaggtaggtntagatttg

SEQ ID NO: 371406 - DNA, 571 bp, Homo sapiens
  misc_feature: GZ8MTXP02I31H8.15.67.G01.1.454.CMB.2.raw
  modified_base (375)..(375): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccggggggtccctggagactctctgtgcagtctctggattcacccttagaagttattggatgacctgggtcccgccaggctccaggggaaggggctggagtgggtggccaacataaacaaagacggaagtcaagaaaaacctntagtggactctgtagacgggccgattcaccatctccagagacaacgccaagaacttcactgtactttgacaaatgaaacagcctagagagggcgaaggacgacggcgtagttattaagttgtgtcgacggagatgaattaggtacgaacttctaacgaaggttaagacgtaggggtaggtagttaggaacttttgg

SEQ ID NO: 371407 - DNA, 578 bp, Homo sapiens
  misc_feature: GZ8MTXP02HOT0C.15.67.G01.1.454.CMB.2.raw
  modified_base (346)..(346): a, c, t, g, unknown or other
  modified_base (394)..(394): a, c, t, g, unknown or other
  modified_base (418)..(418): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggattcacccttagaagttatggatgacctgggtccgccaggctccgaggggaagggctgggagtggggtggccaaanaataaaacgaaagacggaagtcaaagaaaaacctagtgtggactctgngacggcgattcaccatctacaganacaacgaccaagaattcactgtatttagactaaatagaaacagaccgtagaacggaggcggaaggacgacgggccgtagttattaagttgtagcgcgagtatacgataaggtacgacttacaacgtaagtacgacgtagggtagttaagtgttacgttgg

SEQ ID NO: 371408 - DNA, 540 bp, Homo sapiens
  misc_feature: GZ8MTXP02HOMH6.15.67.G01.1.454.CMB.2.raw
  modified_base (341)..(341): a, c, t, g, unknown or other
  modified_base (415)..(415): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgcaggctccaggggaggggctggagtggggtggccaanataaaacaaaagacggaaagtcaagaaaaacctatagtggactctgtgacgggccgattccaccatctccaganacaacgccaaagaattcactgtatttgcaaatgaaacagcctagagaggcgaggacacgggcgtgtattatgtgcgcgagatgaatagtacgactactacgaagtaagcgtaggtggtatgtatg

SEQ ID NO: 371409 - DNA, 553 bp, Homo sapiens
  misc_feature: GZ8MTXP02IDC41.15.67.G01.1.454.CMB.2.raw
  modified_base (364)..(364): a, c, t, g, unknown or other
  modified_base (383)..(383): a, c, t, g, unknown or other
  modified_base (426)..(426): a, c, t, g, unknown or other
tcagtctacgtagccacgaccggtgctcgatttagagtatacatattgggtttgggggtccctgagactctcctgtgcagtctctggattcacccttagaagttattggatgacctgggtccgccaggctccagggaaggggctggagtgggtggccaacataaacaaagacggaagtcagaaaactatgtggactctgtgaacggccgattcaccatctccagagacaacgccaagaattcactgtatttgcaaatgaacagcctgagaggcgaggacacggccgtgtattatgtgcgcgagatgatagtagactctacagtagcaggtgatgatgcttttgatagtgtggggccaagggacngtggtcaccgtcacttcancctccacaggcccatcgcttccccctgcgccctgctccaggcncacctcgagagcacgagcgccctgggcctgccgtggtacaaacgggtctacgttcccgacgttaaccgtacgaccgttggaacggcccggggtacgttcggggaccaaacggggcccgacggtaacg

SEQ ID NO: 371410 - DNA, 552 bp, Homo sapiens
  misc_feature: GZ8MTXP02JEOYD.15.67.G01.1.454.CMB.2.raw
  modified_base (377)..(377): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccggggggggtccctggagactctcctgtgcagtctctggattcacccttagagttattggatgacctgggtccgccaggctccgaggggaaggggctggagtgggtggccaaacataaacaaagacggaagtcaagaaaaacctntagtggactctgtgacggccgattcacccatctccagacgacaaacgccaaagattcactgttaatttgactaaatgaaacagcctaggagaggcggaggacgacggccgtagtattagttgtagcgcgagatgatagttacgactcaacgaagtacgcgtaggtgtatgacttg

SEQ ID NO: 371411 - DNA, 571 bp, Homo sapiens
  misc_feature: GZ8MTXP02H49YC.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagaagttattggatgacctgggtccgccaggctccgaggggaaggggctgggaggtgggtggaccaaacaataaaacgaaaaggaacggaaagtacaaagaaaaaacctagtagtaggactctgtagacgggccgtattccaccatctccagacaacaacgaccaaagaatcactgtatttagactaaatagaacagcctagagaggcgaggacacggcgtgtattatgtgcgcgagagtgaagtagtacgacttacaacgtaagtagacgtagggtagttacgtgtaattgg

SEQ ID NO: 371412 - DNA, 620 bp, Homo sapiens
  misc_feature: GZ8MTXP02HCEMG.15.67.G01.1.454.CMB.2.raw
  modified_base (417)..(417): a, c, t, g, unknown or other
  modified_base (444)..(444): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttgggtggaggtcggtggggggaggtcgttgggtccgagggcccgggggggtccctggagacctcctcctgtgcagtctctggattccacccttagaagttattggatgaccgtggtccgccaggctccgaggggaaggggctgggaggtggggtcggaccaaacgaaataaaacgaaaaggaacggaaagtacgaaagaaaaacctatgtagactntgtgacggcgattcaccatctacaganacaacgaccaaagaattcacttagtatttagacaaaatgaaacacgacctaggagagggacggaaggacgaccgggaccgtgtatttagttggtgccggaggagtatagaagtaggtacgtaccgttactaaacgaaggttagacggtaggggttagtaagttcggtaagtttcgg

SEQ ID NO: 371413 - DNA, 532 bp, Homo sapiens
  misc_feature: GZ8MTXP02FH4M0.15.67.G01.1.454.CMB.2.raw
  modified_base (511)..(511): a, c, t, g, unknown or other
  modified_base (522)..(522): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccaggggaaggggctgggagtggggtggccaaacataaaacaaaagacggaaagtcaagaaaaacctatgtggactctgtgacggccgattcaccatctccagagacaacgccaaagattcactgtatttgcaaatgaacagcctgagaggcgaggacacggccgtgtattatgtgcgcgagatgatagtacgactctanaagtagcgagnggtatgtatg

SEQ ID NO: 371414 - DNA, 550 bp, Homo sapiens
  misc_feature: GZ8MTXP02I9KBV.15.67.G01.1.454.CMB.2.raw
  modified_base (519)..(519): a, c, t, g, unknown or other
  modified_base (532)..(532): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttatggatgacctggtccgccaggctccgaggggaaggggctggagtggggtggccaaacgataaacaaagacggaaagtacaagaaaaacctatgtaggactctgtgacggcgattcaccatctccagagacaacgccaaagaattcactgtatttgactaaatgaaacagcctagacgagggacgaggacgacggtccgtagtattattgtgcgacgagatgaatagtagactntacgaagtacggnaggtaggatggtattagg

SEQ ID NO: 371415 - DNA, 662 bp, Homo sapiens
  misc_feature: GZ8MTXP02GDDO4.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgcaggctccgaggggaaggggctgggagtgggtgaccaacataaaacgaaagacggaaagtacaaagaaaaaacctagtagtaggaactcgtaggtaggaaccgggcccgtaaatttccaacccaattccctacccgaagaacgaaaccaaaccggacccaaaagtaaacttaccaaccttagttaattttacgactaaaagtacgaaaaccaggacccgtaggaggaacgggacgggaaacggaccgacgggtcccgttagttaacgtttaagttggtacggcggtcggaaggtataggtaactagtacgtacgttactaacgaagtacggacgtagggtaggtataggtactttgg

SEQ ID NO: 371416 - DNA, 531 bp, Homo sapiens
  misc_feature: GZ8MTXP02J3AZ6.15.67.G01.1.454.CMB.2.raw
  modified_base (377)..(377): a, c, t, g, unknown or other
  modified_base (508)..(508): a, c, t, g, unknown or other
  modified_base (512)..(512): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctggggtccgccaggctcccgaggggaaggggctgggagtgggtggccaacataaacaaagacggaaagtcagaaaaaacctntgtggactctgtgacggccgattcaccatctccagagacaacgccaagatcactgtatttgacaaatgaacagcctgagaggcgaggacgacggccgtgtagttattgtgcgcgagatgataggtacactntacngtagcaggtggtatgattg

SEQ ID NO: 371417 - DNA, 605 bp, Homo sapiens
  misc_feature: GZ8MTXP02F5S1N.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcttggtccgagggcccgggggggtccctggagactctcctgtgcagtctctggattcacccttagagttattggatgacctggtccgccaggctccaggggaaggggctgggagtggggtggaccaaacaataaaacgaaaaggaacggaaagtacaaagaaaaaacctagtagtaggaactcgtagtacggaccgggccgtaattcacccatcctaccagaagacaaacgccaaagaattcactgtatttgacaaatgaaacagacctaggaagacggacgggaaggaaccgacgggaccgttaggtaatttagttgtggtcggcgtaagagtgaaataggtagactctaacgaagtagacgtaggtggtaactgaagtttg

SEQ ID NO: 371418 - DNA, 542 bp, Homo sapiens
  misc_feature: GZ8MTXP02IYLLX.15.67.G01.1.454.CMB.2.raw
  modified_base (381)..(381): a, c, t, g, unknown or other
  modified_base (390)..(390): a, c, t, g, unknown or other
  modified_base (501)..(501): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggcccgggggggtccctgagactctcctgtgcagtctctggattcacccttagaagttattggatgacctgggtccgccaggctccaggggaaggggctgggagtgggtggccaaacataaaacaaagacggaaagtcaagaaaaacctanagtggactngtgacggcgattcaccatctccagagacaacgccaagaattcactgtactttgacaaatagaacaggcctagagaggacgagacacggccgtgtattagtgtgcgcgagangatagtacgactctacaagtacgacgaggtgtactggattg

SEQ ID NO: 371419 - DNA, 548 bp, Homo sapiens
  misc_feature: GZ8MTXP02HCTAQ.15.67.G01.1.454.CMB.2.raw
  modified_base (406)..(406): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttgggtccaggccgggggggtccctgagactctcctgtgcagtctctggattcacccttagaagttattgggatgacctgggtccgccaggctccaggggaaggggctgggagtgggtggccaacataaacaaagacggaagtacaagaaaaacctatagtgactctgtagacgggccattcaccntactcagagacaacgccaaagaattcactgtatttgacaaatgaaacagacctagaagaggacgaaggacacggaccgtgtattagtgtgcgtcgagatgatagtacgactcaacaagtagacgtaggtaggtatgactttg

SEQ ID NO: 371420 - DNA, 544 bp, Homo sapiens
  misc_feature: GZ8MTXP02HISDM.15.67.G01.1.454.CMB.2.raw
  modified_base (345)..(345): a, c, t, g, unknown or other
  modified_base (522)..(522): a, c, t, g, unknown or other
  modified_base (538)..(538): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaaggggctgggagtggggtggccaaanataaaacaaagacggaagtacaagaaaaacctatagtggactctgtgacggccgattcaccatctaccagagacaacgccaaagaattcactgtatttgacaaatgaaacagacctgagaggcgaaggacgacgggccgtagtattattgtgcgtcgagatgatacgtagactctanaagtagcgaggtgtanggtatg

SEQ ID NO: 371421 - DNA, 532 bp, Homo sapiens
  misc_feature: GZ8MTXP02GNT6V.15.67.G01.1.454.CMB.2.raw
  modified_base (375)..(375): a, c, t, g, unknown or other
  modified_base (507)..(507): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagagttattggatgacctgggtccgccaggctccgaggggaaggggctgggagtggggtggccaacataaacaaagacggaagtacaagaaaaactntagtggactctgtgacggcattcacatctccagagacaacgaccaagaatcactgtattagacaaatgaaacagcctgagaggcggaggacacgggccgtgtattattgtgcgcgagatgatagtacgactntacaagtagcgaggtgtatgattcg

SEQ ID NO: 371422 - DNA, 536 bp, Homo sapiens
  misc_feature: GZ8MTXP02HKCHH.15.67.G01.1.454.CMB.2.raw
  modified_base (410)..(410): a, c, t, g, unknown or other
  modified_base (510)..(510): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcaccctagaagttatggatgacctggtccgccaggctccgaggggaaggggctgggagtggggtggccaaacaataaaacaaagaacgaagtacaagaaaaacctatgtggactctgtgacgcgatcaccatctcaganacaacgacaagaatcactgtatttagacaaatagaaacagacctgagaggcgaaggacgacggcctagtattattgtagcgcgagatagatagtagactntaacgaagtagcgaggtgtatgtatg

SEQ ID NO: 371423 - DNA, 547 bp, Homo sapiens
  misc_feature: GZ8MTXP02G9DU2.15.67.G01.1.454.CMB.2.raw
  modified_base (418)..(418): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagacggtgtccagtgtgaggtgcacttggtggagtcgtgggggaggcttgggtccaggccgggggggtccctgagactctcctgtgcagtctctggattcacccttagaagttatggatgacctgggtccgccaggctccaggggaaggggctggagtggggtggccaaacataaaacaaaagacggaaagtcaagaaaaaacctatagtggactctgtgacggccgattcaccatctccaganacaaacgccaaagaattcactgtatttgacaaatgaaacagcctagagaggcggaagacgaacggccgtagtattattgtgcgcgagatgatagtacgactctacaagtagacgaggtagtatgacttg

SEQ ID NO: 371424 - DNA, 528 bp, Homo sapiens
  misc_feature: GZ8MTXP02FXL0Z.15.67.G01.1.454.CMB.2.raw
  modified_base (328)..(328): a, c, t, g, unknown or other
  modified_base (336)..(336): a, c, t, g, unknown or other
  modified_base (338)..(338): a, c, t, g, unknown or other
  modified_base (354)..(354): a, c, t, g, unknown or other
  modified_base (367)..(367): a, c, t, g, unknown or other
  modified_base (390)..(390): a, c, t, g, unknown or other
  modified_base (395)..(395): a, c, t, g, unknown or other
  modified_base (413)..(413): a, c, t, g, unknown or other
  modified_base (419)..(419): a, c, t, g, unknown or other
  modified_base (421)..(421): a, c, t, g, unknown or other
  modified_base (428)..(428): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttcgtgtaggtatttagaaggtgtcagtgtgaggtgcattggtggagtctgggggaggcttggtccaggccggggggggtccctgagactctcctgtgcagtctctggattcacccttagaagttattggatgacctgggtccgccaggctcaggggaggggctggagtggnggccaaananaaacgaaagagaatanaagaaaactgtgngactgtgagacgcatcaccatcncaganacaacgcaagtatacatntattananaataganagacagagaggagagacgacggacgtagtagttagtgtgcgacgagagtagtagtagtacgtacgtactacgaagtagacgtaggtaggtagtagtagtg

SEQ ID NO: 371425 - DNA, 572 bp, Homo sapiens
  misc_feature: GZ8MTXP02G7469.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctccttgcagtctctggattcacccttagaagttatggatgacctgggtccgccaggctccgagggaggggctggagtgggtgccaacataaaacaaagacggaaagtcaaagaaaaactatagtaggactcgtgtggaaacgggccgattcaacccatcctaccaagacgaacaaacgacccaaagaaacttcaacttagtatttgacaaatgaaacagcctagagaggcgaggacacggccgtagtattagtgtgcgacgagtatggaatagtaagactactaacaaggtaagcgtagggtggtagtgaacgttgtacg

SEQ ID NO: 371426 - DNA, 546 bp, Homo sapiens
  misc_feature: GZ8MTXP02HL3X0.15.67.G01.1.454.CMB.2.raw
  modified_base (412)..(412): a, c, t, g, unknown or other
  modified_base (453)..(453): a, c, t, g, unknown or other
  modified_base (521)..(521): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctggagactctcctgtgcagtctctggattcacccttagaagttattggatgacctgggtccgccaggctccgaggggaggggctggagtgggtggccaacataaaacaaagacggaaagtcaaagaaaaacctatagtggactctgtagacggccgattcaccatcnccagagacaacgccaagatcactgtattgacaaatgaaacngacctgagaggacgagacgaacggtcgtagtattatgtagcgcgagtatagagtacgtagactactanaagtagcgaggtagtagtgtattcg

SEQ ID NO: 371427 - DNA, 652 bp, Homo sapiens
  misc_feature: GZ8MTXP02IA7WH.15.67.G01.1.454.CMB.2.raw
  modified_base (306)..(306): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtggggggaggcttggtccaggccgggggggtccctgagactctcctgtgcagtctctggattcacccttagaagttatggatgacctgggtccncaggctccgaggggagggctgggaggtgggtggaccaagaataaaacgaaaagacggaaagtacaaaggaaaaaaccctagtgtagggaacttcgtgtacggaccgggccgtaaatttccgaaccctaattccacccaagggaaacaaccaaaccggtacccaaaagtaacttccaacgttaggttaattttacgaacctaaaagtacgaaacgaagtcccttaaggaggaacgggacgaagggactaaccgggccgttaggtatttaattggtagaccggcgagagtagtagtaacgtacgtactacgtacgtaacgtacgacgtacggtaggtacgtagtagtg

SEQ ID NO: 371428 - DNA, 554 bp, Homo sapiens
  misc_feature: GZ8MTXP02FV41C.15.67.G01.1.454.CMB.2.raw
  modified_base (419)..(419): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagttattggatgacctgggtccgccaggctccgaggggaaggggctgggagtggggtggccaacataaacaaagacggaagtacaagaaaaacctatagtagactctgtagacgggccgattcaccatctccaganacaacgaccaaagaattcactgtatttgacaaaatgaaacagcctagagaggacggaggacgacggccgtagtattagttgtgcgcgagatgatagtacgactactacgaagtagacgtagggtgtagtgtattg

SEQ ID NO: 371429 - DNA, 710 bp, Homo sapiens
  misc_feature: GZ8MTXP02H40YE.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggttttccttgttgttatttagaaggtgtccagtgtgaggtgcacttggtggagtcgtgggggaggcgttggtccgaggccggggggtccctgagactctcctgtgcagtctctggattcacccttagaagttatggatgacctgggtccgccaggctccgaggggaggggctgggaggtgggtcggaccaaacgaataaaacgaaaaggaacggaaagtacaaagtaaaaaccctagtaggtaggaacttctaggttacggacggggtcccgtaactttcccaaccctaacttcctacccgaaggaacgaaaccaaacccggacccaaaagtaactttacctaaactttacggttaaattttggaaaccctaaaagttacggaaaacctacggtaccccgttaggaagggaacgggacccgggaagggaacccgtaacgggcccggtttaggttaactttaagttggtcgacccggtcgaaaggggtaattacgtaaagtaaggttacgacttaacgtacgtaagtacgacgtaggggtgtaacgtggtactttgg

SEQ ID NO: 371430 - DNA, 536 bp, Homo sapiens
  misc_feature: GZ8MTXP02GF8FF.15.67.G01.1.454.CMB.2.raw
  modified_base (411)..(411): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaaggggctggagtgggtggccaacataaacaaagacggaaagtcaagaaaaacctatgtggactctgtgacggccgattcaccatctccaganacaacgaccaagaattcactgtatttgacaaaatgaaactagcctagagaggacgaggacacggccgtgtattatgtgcgcgagatgatagtagactcgtaacaagtagcaggtgtatggattgg

SEQ ID NO: 371431 - DNA, 540 bp, Homo sapiens
  misc_feature: GZ8MTXP02INMKP.15.67.G01.1.454.CMB.2.raw
  modified_base (302)..(302): a, c, t, g, unknown or other
  modified_base (338)..(338): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagagttatggatgacctgggtccncaggctccgaggggagggctggagtgggtggccaanataaaacaaagacggaagtacaagaaaaacctatgtggactctgtgacgggccgattccaccatcacagagacaacgacaaagaattcactgttatttgacaaatgaaacagcctagagaggacgaaggacacggccgtgtattattggtgcgacgagatagaatagtagacttcaacaagtacgcgagggtgtatgatttg

SEQ ID NO: 371432 - DNA, 535 bp, Homo sapiens
  misc_feature: GZ8MTXP02G1E2L.15.67.G01.1.454.CMB.2.raw
  modified_base (302)..(302): a, c, t, g, unknown or other
  modified_base (370)..(370): a, c, t, g, unknown or other
  modified_base (399)..(399): a, c, t, g, unknown or other
  modified_base (407)..(407): a, c, t, g, unknown or other
  modified_base (444)..(444): a, c, t, g, unknown or other
  modified_base (502)..(502): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccggggggtccctgagactctcctgtgcagtctctggattcacccttagagttattggatgactggtccncaggctccaggggagggctggagtgggtggccaaacataaaacaaagacggaagtcaagaaaaacctnagtggactcgtgtgacggccgattcaccntctcaganacaacgccaagaattcactgtattgacaaatgaaacngcctgagaggcgagacacggcgtgtattagtgtgcgtcgagatagataagtacgactntaacgaagtaacgcgtaggtagtatagtagtcg

SEQ ID NO: 371433 - DNA, 865 bp, Homo sapiens
  misc_feature: GZ8MTXP02H5PR8.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggaggtcgtgggggaggcttggtccaggccggggggtccctgagactctcctgtgcagtctctggattcacccttagaagttatggatgactggtccgcaggctccgaggggaagggcgtgggaggtggggtggaccaacaataaaacgaaaagaacgggaaagtacaaagaaaaaccctagtaggtaggaccttcgttaggtacgaaccgggggcccgtaagtttacccaaccctaacttccctacccccgaaagggaaacccgaaacccgaaaacccggaacccccaaaaagggtaaaaccttttaccccgtaaaccgttttaggttttaaactttttacgggaaaccctaaaaaagtttacggaaaaacccgtaaacgggtacccccgttaaaggggaaaaggggaaacgggggaccggggaaaaccgggggtaaaacccgaaccccgggggggtacccccggttttaaagggggttaaaacttttttaaacggtttggggtttacggggaaccccgggttacggggaaaaagggtaagtttacggtaaaacggtttaaagggttaaaccgggtaaacccttttacgaaaacccgtaagggttaaaccggaccggtaaaagggggtttggttaaacgtttcgggtaaaagttttcgggg

SEQ ID NO: 371434 - DNA, 550 bp, Homo sapiens
  misc_feature: GZ8MTXP02H17UT.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaggggctggagtgggtggccaaacataaaacaaagacgaagtacaagaaaacctatgtggacttcgtgtagacgggccgaattccacctatctaccagacgacaaacgccaaagaattcacttgtatttagacaaatgaaacagcctggagaggcgaggacacggcgtgtattagtggtagcgcgagatgatagtacgactacgacaagtgacgaggttggatggattgg

SEQ ID NO: 371435 - DNA, 538 bp, Homo sapiens
  misc_feature: GZ8MTXP02F7ALO.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaaggggctggagtggggtggccaaacataaaacaaagacggaagtacaagaaaaacctatgtggactctgtgacggccgattcaccatctccagacgacaaacgccaaagaattcactgtatttgacaaatgaaacagcctgagaggcgagacgcggcgtgtattagtgtgcgcgagatgaatagtacgactctaacaagtagcgaggtgtatggattcg

SEQ ID NO: 371436 - DNA, 550 bp, Homo sapiens
  misc_feature: GZ8MTXP02F9X0E.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggattcacccttagagttatggatgacctgggtccgccaggctccgaggggaaggggctgggagtggggtggccaaacaataaacaaaagacggaaagtacaagaaaaacctagtgtaggactctgtagacgggccgattccaccatctccagacgacaacgaccaaagaattcactgtatttgacaaatgaaacagcctagagaggacgagacacggccgtgtattagtagtgcgcgagatgaatagtagactctaagaagtagcgtaggtgtagtgtatg

SEQ ID NO: 371437 - DNA, 549 bp, Homo sapiens
  misc_feature: GZ8MTXP02G0M6W.15.67.G01.1.454.CMB.2.raw
  modified_base (345)..(345): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctggagtgggtggccaaanataaaacgaaagacggaagtacaagaaaaacctatagtaggactctgtgacggccgattcaccatctccagagacaacgccaagaatcactgtatttgacaaatgaaacagacctgagaggacgaaggacgacggcgtagtattagttgtgcgtacgagatagatagtagactactacaagtacgacgaggtagtactgattcg

SEQ ID NO: 371438 - DNA, 701 bp, Homo sapiens
  misc_feature: GZ8MTXP02J1KD7.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccggggggtcctgagactctcctgtgcagtctctggattcacccttagaagttattggatgaccgtgggtcccgccaggcctccgaggggaaggggcgtgggaggtggggtcggacccaaacaataaaacgaaaagaacgggaaagtacaaagaaaaaccctagtagtaggaaccttctaggttacggaacccggggcccgaaatttcccaaccctaacttccctacccgaaggaacgaacccaaacccgacccaaaaggtaaacttcgaacttaggttaattttaggaaccaaaagttacgaaaaccgtaagcccgtaggacgggaagggaccggaaagggaacccgaccggggtacccggttaggttaactttagttggtcggacggtcggaagtataggaaacgttaaggtacggaccttacgtaacgaaggtaacgacgtagggttaggtataggtatttacggg

SEQ ID NO: 371439 - DNA, 567 bp, Homo sapiens
  misc_feature: GZ8MTXP02GEZ51.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcaccctagaagttatggatgacctgggtccgccaggctccgaggggaaggggctgggaggtggggtggccaaacataaaacaaagaacggaagtacaagaaaaactatgtggactcgagtagacggccgattcaccatctccagagacaaacgccaaagaatcactgtattgacaaaatgaaacagacctagaggagacggaggacctacgggccgtagtattattggtgcgacgagagtgaagtacgtagtactcctaacaagtacggcgtaagggtggtataggatttcgg

SEQ ID NO: 371440 - DNA, 543 bp, Homo sapiens
  misc_feature: GZ8MTXP02ICWWG.15.67.G01.1.454.CMB.2.raw
  modified_base (457)..(457): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggcttggtccgaggccgggggggtccctggagactctcctgtgcagtctctggattcacccttagaagttattggatgacctgggtccgccaggctccgaggggaagggctgggagtgggtggccaaacataaaacaaagacggaaagtcaagaaaacctatgtaggactctgtgacggccgattcaccatctcagacgacaacgccaagaattcactgtatttgactaaatgaaacngcctagagaggacgaggacacggcgtgtattatgtgcgcgagatagatagtagactctaacgaagtagacgtaggtagtatgtatg

SEQ ID NO: 371441 - DNA, 545 bp, Homo sapiens
  misc_feature: GZ8MTXP02H9889.15.67.G01.1.454.CMB.2.raw
  modified_base (412)..(412): a, c, t, g, unknown or other
  modified_base (417)..(417): a, c, t, g, unknown or other
  modified_base (451)..(451): a, c, t, g, unknown or other
  modified_base (496)..(496): a, c, t, g, unknown or other
  modified_base (533)..(533): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcttgttgttattttagaaggtgtccagtgtgaggtgcacttggtggagtcgtgggggaggcgttgggtccgaggcccgggggggtccctggagactctcctgtgcagtctcgtggattcacccttagaagttatggatgacctggtccgcaggctccgaggggagggctggagtgggtggaccaagaataaacaaagaacggaagtcgaagaaaaaacctgtagtggactctgtgacgccgtattccacatcncaganacaagcaagatcactgtattagacaatagaaacngcctagagagcgagacgacggcgtagtattatgtgacgtcgagtntagactagtagacttactaacaagtacgacgtagggngtatcgtatttg

SEQ ID NO: 371442 - DNA, 554 bp, Homo sapiens
  misc_feature: GZ8MTXP02JBNYT.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggcccgggggggtccctgagactctcctgtgcagtctctggattcacccttagaagttattggatgacctgggtccgccaggctccaggggaaggggctgggagtggggtggccaacataaaacaaagacggaagtacaagaaaaacctatgtggactctgtagacgggccgattcaccatctccagagacaacgccaagaattcactgtatttgactaaatgaaactagaccgtagagacgggcggaaggaccgacggccgtgtattagttgtgcgcgagatgatagtagactcgtacaagtagcgagggtgtagtgatttgg

SEQ ID NO: 371443 - DNA, 533 bp, Homo sapiens
  misc_feature: GZ8MTXP02HUQQV.15.67.G01.1.454.CMB.2.raw
  modified_base (347)..(347): a, c, t, g, unknown or other
  modified_base (386)..(386): a, c, t, g, unknown or other
  modified_base (413)..(413): a, c, t, g, unknown or other
  modified_base (447)..(447): a, c, t, g, unknown or other
  modified_base (490)..(490): a, c, t, g, unknown or other
  modified_base (500)..(500): a, c, t, g, unknown or other
  modified_base (509)..(509): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggcccgggggggtccctggagactctcctgtgcagtctctggattcacccttagaagttattggatgacctgggtccgccaggctccgaggggaagggctggagtgggtggccaanataaaacaaagacgaagtcaagaaaacctatgtggactntgtgacggcgattcaccatctacaganacaacgcaagatcactgtatttgacaaatgaaanagcctagagaggcgagacgacggcgtgtattatgtgcgcgagnagatacgtanacgtactanaagtagcgtaggtgtatgtattcg

SEQ ID NO: 371444 - DNA, 583 bp, Homo sapiens
  misc_feature: GZ8MTXP02HTG8U.15.67.G01.1.454.CMB.2.raw
  modified_base (304)..(304): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggatcacccttagaagttatggatgacctgggtccncaggctccgaggggaagggcgtggaggtggggtggaccaaacaataaaacaaagaaccggaaagtacaaagaaaaaacctagtagtagggaactcgtaggtaggacggccgattcaacccatctaccagacgacaacgaccaaagaactcacttgtatttagactaaatagaaacagcctaggagaggacggaaggacgacggcgtaggtattattgtagcggcgagagtagagtagtacgtactactacgtaagtagacgtaggtagtagtagtagtg

SEQ ID NO: 371445 - DNA, 607 bp, Homo sapiens
  misc_feature: GZ8MTXP02H8CPW.15.67.G01.1.454.CMB.2.raw
  modified_base (546)..(546): a, c, t, g, unknown or other
tcagtctacgtagccacgaccggtgctcgatttagagtatacatattgggtttgaggtctcagagaggagccttagccctggactccaaggcctttccacttggtgatcaacactgagcacagaggactcaccatggagttggggctgagctgggttttccttgttgttattttagaaggtgtccagtgtgaggtgcacttggtggagtcgtgggggagcttggtccaggccggggggtcctgagactctcctgtgcagtctctggattccacccttagaagttattggatcgaccgtggggtcccgccgaggcctccgaaggggaaggggctggggaggtggggtcggaccaaacaataaaacgaaaggaacggaaagtaccgaaagaaaaaactgtaggtaggaactcgtgtacggaaccgggccgacttccaaccctatcctacccaagaaacgaaccaaacgaccaaagtaaacttcaaccttgttatttgaacaaatgaaacagacctggacggagcgaggacgacgcgtagtatacttgngcgcgagagtgactagtagactacgtacaggtaagcgtaggtaggtatggacttaggtttg

SEQ ID NO: 371446 - DNA, 553 bp, Homo sapiens
  misc_feature: GZ8MTXP02HYQQ8.15.67.G01.1.454.CMB.2.raw
  modified_base (414)..(414): a, c, t, g, unknown or other
  modified_base (420)..(420): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctgagactctcctgtgcagtctctggattcaccctagaagttatggatgacctgggtccgccaggctccgaggggaagggctgggagtggggtggccaacaataaaacaaagaacggaaagtcaaagaaaaacctatgtaggactctgtgacggccgattccaccatcnccaganacaacgaccaagaatcactgtatttgacaatagaaacagcctagagaggcgaaggacgacggcgtagtattattgtgcgtcgagatgaagtagtacgactctaacaagtagacgtagggtggtatggtattgg

SEQ ID NO: 371447 - DNA, 539 bp, Homo sapiens
  misc_feature: GZ8MTXP02FZFM1.15.67.G01.1.454.CMB.2.raw
  modified_base (479)..(479): a, c, t, g, unknown or other
  modified_base (512)..(512): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggtttcctgttgttattttagaaggtgtccagtgtgaggtgcacttggtggagtcgtggggggaggcttgggtcccaggccgggggggtccctgagactctcctgtgcagtctctggattcacccttagaagttatggatgacctgggtccgccaggctccgaggggaaggggctggagtggggtggccaaacgataaaacgaaagacggaagtcaagaaaaaacctatgtggactctaggtgacggcgatcacatctcagagacaacgccaaagaatcactgtatttgacaaatgaaacagcctgagaggcgaggacacggcgngtatagtgtgcgcgagatgatagtacactctanaagtagacgtaggtagtagtgtagtcg

SEQ ID NO: 371448 - DNA, 545 bp, Homo sapiens
  misc_feature: GZ8MTXP02FVZFM.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagagttatggatgacctgggtccgccaggctccgaggggaggggctgggagtggggtggccaacataaacaaagacggaagtcaagaaaaacctatgtaggactctgtagacgggccgattcgaccatctaccagacgacaaccgccaaagaattcactgtatttgacaaatgaaacagcctgagaggcgaggaccacggccgtgtattatgtgcgcgagatagatagtacgactctaacgaagtacgcgaggtaggtatcgagttg

SEQ ID NO: 371449 - DNA, 531 bp, Homo sapiens
  misc_feature: GZ8MTXP02FO9VZ.15.67.G01.1.454.CMB.2.raw
  modified_base (401)..(401): a, c, t, g, unknown or other
  modified_base (507)..(507): a, c, t, g, unknown or other
  modified_base (516)..(516): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaggggctggagtgggtggccaacataaacaaagacgaagtcaagaaaaacctatagtgactctgtgacggccattcaccatcnccagagacaacgcaaagatcactgtattgcaaaatgaaacagcctagagagggacgaggacgacggcgtagtagttatgtgcgcgagatgatacgtagactctaanaagtacganagggtgtatgattcg

SEQ ID NO: 371450 - DNA, 539 bp, Homo sapiens
  misc_feature: GZ8MTXP02I7KUM.15.67.G01.1.454.CMB.2.raw
  modified_base (377)..(377): a, c, t, g, unknown or other
  modified_base (386)..(386): a, c, t, g, unknown or other
  modified_base (492)..(492): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagttattggatgacctgggtccgccaggctccgaggggaaggggctggagtggggtggccaacataaacaaagacggaagtcaagaaaaacctntgtggactntgtgacggccgattcaccatctccagagacaacgccaaagaattcactgtatttgacaaatgaaacagcctagagagggcgaaggacgacggccgtgtattattgngcgcgagatgatagtacgactctacgaagtagcgaggtgtatgattg

SEQ ID NO: 371451 - DNA, 550 bp, Homo sapiens
  misc_feature: GZ8MTXP02IGJXP.15.67.G01.1.454.CMB.2.raw
  modified_base (340)..(340): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttatggatgacctgggtccgccaggctccgaggggaagggctggagtgggtggccaanataaaacaaagacggaagtcaagaaaaacctatgtgactctgtgacgggccgattcaccatctccagagacaacgccaaagaatcactgtatttgacaaatgaaacagcctgagaggcgaggacacggctgtattattgtagcgtacgaggattagatacggtagaacttctaaacgaaggttaagaccgtaggggtgtactagagtttg

SEQ ID NO: 371452 - DNA, 566 bp, Homo sapiens
  misc_feature: GZ8MTXP02HMX9Y.15.67.G01.1.454.CMB.2.raw
  modified_base (419)..(419): a, c, t, g, unknown or other
  modified_base (424)..(424): a, c, t, g, unknown or other
  modified_base (457)..(457): a, c, t, g, unknown or other
  modified_base (477)..(477): a, c, t, g, unknown or other
  modified_base (496)..(496): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttcctgttgttatttagaaggtgtccagtgtgaggtgcacttggtgggagtcgtggggggaggcttgggtccaggcccggggggggtccctgagactctcctgtgcagtctctggattcaccctagaagttatggatgaccgtgggtccgcaggctccgaggggaaggggctgggagtgggtggccaaacaataaaacaaagacggaagtacaaaggaaaaacctagtgtggacttctggtgacgggccaattcaccatcncaganacacgacaagatcactgtattgacaaatcgaanagccgtgagaggcgaggacncggacgtggtatagttggngcgaggagtagtacgtagtacgtacgacttacgtagtaaggtagacggtagggttagtagtagtagttcg

SEQ ID NO: 371453 - DNA, 546 bp, Homo sapiens
  misc_feature: GZ8MTXP02JGYNK.15.67.G01.1.454.CMB.2.raw
  modified_base (379)..(379): a, c, t, g, unknown or other
  modified_base (518)..(518): a, c, t, g, unknown or other
  modified_base (525)..(525): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggattcacccttagagttattggatgacctgggtccgccaggctccgaggggaaggggctgggagtggggtggccaacataaaacaaagacggaagtacaagaaaaacctntgtggactctgtgacggccgattccaccatctccagagacaacgccaagaattcactgtattgacaaatgaaacagcctagagaggcgaggacgacggccgtgtattagtgtgcgtcgagatgaatagtagactctaanaagtaancgtaggtggtactaggtattg

SEQ ID NO: 371454 - DNA, 521 bp, Homo sapiens
  misc_feature: GZ8MTXP02IFEPS.15.67.G01.1.454.CMB.2.raw
  modified_base (338)..(338): a, c, t, g, unknown or other
  modified_base (370)..(370): a, c, t, g, unknown or other
  modified_base (482)..(482): a, c, t, g, unknown or other
  modified_base (487)..(487): a, c, t, g, unknown or other
  modified_base (501)..(501): a, c, t, g, unknown or other
tcagtctacgtagccacgaccggtgctcgatttagagtatacatattgggtttggggcctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggagcttggtccaggccggggggtccctgagactctcctgtgcagtctctggattcacccttagaagttattggatgacctgggtccgccaggctccgagggaggggctggagtggtgccaanataaacaaagacggaaagtcaaagaaaaactntagtggactctgtgaacggcgattcaccatctcagagacacgccaagaatcactgtatttgacaaatgaacagcctagaggaggcgaggacacggcgtgtattattgtgcgngagangatagagactctanagtgcaggtgatgactgtta

SEQ ID NO: 371455 - DNA, 592 bp, Homo sapiens
  misc_feature: GZ8MTXP02HC44E.15.67.G01.1.454.CMB.2.raw
  modified_base (423)..(423): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccgagggcccgggggggtccctgagactctcctgtgcagtctctggattcacccttagaagttatggatgacctgggtccgccaggctccgaggggaagggctggagtgggtggccaaacataaaacaaaagacggaagtacaaagaaaaacctatgtaggactctgtagaccgggccgattcaccatctccaganacaaacgccaaagaatcactgtaatttgactaaatagaaactagacctgaaggaggacggagggaaccgaacgggtcccgtagttaacgttagttggtagccggcggagagttgaagttaacgagtaactcgtaacaaggttacgacgtagggttggaatggtatttcg

SEQ ID NO: 371456 - DNA, 525 bp, Homo sapiens
  misc_feature: GZ8MTXP02GYO4G.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgtgttttccttgttgttattttagaaggtgtccagtgtgaggtgcacttggtggagtctgggggaggcttggtccagccggggggtccctgagactctcctgtgcagtctctggattcacccttagaagttattggatgacctgggtccgccaggctccagggaaggggctggagtgggtggccaacataaacaaagacggaagtcagaaaactatgtggactctgtgaacggccgattcaccatctcccagagacaacgccaagaattcactgtatttgcaaatagaacagcctgagaggcgagacgacggccgtgtattatgtgtcgcgagatagatagtagactctaacgagtagcaggtggtatggtag

SEQ ID NO: 371457 - DNA, 549 bp, Homo sapiens
  misc_feature: GZ8MTXP02G117W.15.67.G01.1.454.CMB.2.raw
  modified_base (341)..(341): a, c, t, g, unknown or other
  modified_base (375)..(375): a, c, t, g, unknown or other
  modified_base (407)..(407): a, c, t, g, unknown or other
  modified_base (445)..(445): a, c, t, g, unknown or other
  modified_base (486)..(486): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggttttcgtgtagtatttagaaggtgtcagtgtgaggtgcacttggtggagtcgtgggggaggcttggtccaggccgggggggtccctgagactctcctgtgcagtctctggattcacccttagaagttattggatgacctgggtccgccaggctccgaggggaaggggctgggagtgggtggccaanataaaacaaagaacggaatacaagaaaaaccctntgtggactcgtgagacgggcattccaccatcncagagacacgcaagatcattgtatttagacaatagaanagaccagagaggacggagacgacggcgtgtattattgtggngacgagagtagtagtagtacgtacgtacgtacgtaagtacgacgtaggtaggtagtagtagtg

SEQ ID NO: 371458 - DNA, 630 bp, Homo sapiens
  misc_feature: GZ8MTXP02HSSSM.15.67.G01.1.454.CMB.2.raw
  modified_base (303)..(303): a, c, t, g, unknown or other
  modified_base (341)..(341): a, c, t, g, unknown or other
  modified_base (382)..(382): a, c, t, g, unknown or other
  modified_base (419)..(419): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggctttggtccaggccgggggggtccctgagactctcctgtgcagtctctggattcaccttagagttatggatgacctgggtccncagactccgaggggaggggctgggagtgggtgaccaanataaaacaaagacggaagtcaaagaaaacctatgtagactntgtgacggccgattcaccatctaccagacgaacaacnccaaagattacacttagttatttgaactaaagtacgaaaacacgtacctggaagagggacgaacgggaccgacgggcccgttaggttaactttaagtttgacggaccgtacggaagtagttggaaaccttaaaggggttaactaccttaaccgttaagaaacggtttagggaccgtaggggtttagggtaaaccgttggttaagtttccgg

SEQ ID NO: 371459 - DNA, 557 bp, Homo sapiens
  misc_feature: GZ8MTXP02IQWOO.15.67.G01.1.454.CMB.2.raw
  modified_base (411)..(411): a, c, t, g, unknown or other
  modified_base (445)..(445): a, c, t, g, unknown or other
  modified_base (447)..(447): a, c, t, g, unknown or other
  modified_base (450)..(450): a, c, t, g, unknown or other
  modified_base (452)..(452): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttcctgtagttatttagaaggtgtccagtgtgaggtgcacttggtggagtcgtggggggaggcttggtcccaggccgggggggtccctgagactctcctgtgcagtctctggattcacccttagaagttattggatgacctgggtccgccaggctccaggggaaggggctggagtgggtggccaaacataaacaaagacggaagtcaagaaaaacctatgtaggactctagtgacggccgaattcacccatcnccagagacaacgccaagaattcaactgtatttananaananacagacagagaggacgagacgacgcgtagtattagttgtgcgacgagagtagtagtacgtacgtactactacgtaagtacgtacgtacggtaggtagtagtagtg

SEQ ID NO: 371460 - DNA, 546 bp, Homo sapiens
  misc_feature: GZ8MTXP02GL2Q2.15.67.G01.1.454.CMB.2.raw
  modified_base (414)..(414): a, c, t, g, unknown or other
  modified_base (417)..(417): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggattcacccttagaagttatggatgacctgggtccgccaggctccgaggggagggctgggagtgggtggaccaaacaataaaacgaaagacggaagtacaaagaaaaacctatgtagactctggtagaccggcattccaccatcncanagacaacgccaagaatcatgttattgacaaatgaaacagcctaggagaggacggagaccgacggcgtgtaattattgtgcgagtagatagtatagtagactcgacaagtagcgtaggtgtatagattgg

SEQ ID NO: 371461 - DNA, 568 bp, Homo sapiens
  misc_feature: GZ8MTXP02GHS39.15.67.G01.1.454.CMB.2.raw
  modified_base (418)..(418): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtcccgccaggctccgaggggaaggggctgggagtggggtggccaaacataaaacaaaaggacggaaagtacaaagaaaaacctatgtaggaactctgtagacggccgattcaccatcnccagagacaacgccaaagaattcactgtatttgacaaaatgaaacagacctaggagagggacggaaggaaccgacgggaccgttagtattaagttgtagcgacgagatgaatagtagaactctaagaagtagcgaaggtggatggattgg

SEQ ID NO: 371462 - DNA, 570 bp, Homo sapiens
  misc_feature: GZ8MTXP02IXIHP.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagaagttatggatgacctgggtccgccaggctccgaggggaagggctgggagtgggtggccaaacataaaacaaagacggaaagtacaagaaaaaacctatagtagaacttcgtagtcggaacgggccgaattccacccaatcctaccagacgacaacgaccaaagaattcactgtatttgacaaatagaacagcctagagaggcgaggacgacggccgtgtattagttgtgcgtcgagtatgaagtagtaacgtactactaacaagtacgacgtaggtaggtatgagttcg

SEQ ID NO: 371463 - DNA, 551 bp, Homo sapiens
  misc_feature: GZ8MTXP02F0CMT.15.67.G01.1.454.CMB.2.raw
  modified_base (528)..(528): a, c, t, g, unknown or other
tcagtctacgtagccacgaccggtgctcgatttagagtatacatattgggtttggggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtccctggagactctcctgtgcagtctctgattcacccttagagttatggatgacctggtccgccaggctccagggaggggctggagtgggtgccaacataaacaaagacggaaagtcaaagaaaaactatagtggactctgtagaacggccgattcaccatctaccagagaacaacgcccaaagaattcactgtatttgacaaatagaacagtaccagaaggagcggaaggacaaccggcgtagtattagtgtgcgcgagatggatagtacgtactactacagtaagngaggtggtagtgtagtcgtttag

SEQ ID NO: 371464 - DNA, 549 bp, Homo sapiens
  misc_feature: GZ8MTXP02GULAM.15.67.G01.1.454.CMB.2.raw
  modified_base (341)..(341): a, c, t, g, unknown or other
  modified_base (411)..(411): a, c, t, g, unknown or other
  modified_base (417)..(417): a, c, t, g, unknown or other
  modified_base (505)..(505): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctgagactctcctgtgcagtctctggattcacccttagaagttattggatgacctgggtccgcaggctccgaggggagggctggagtggtgccaanataaacaaagacggaagtacaagaaaaacctgtagtaggactcgtagtagaccggcgtattccaccatcnccaganacaacgcaagatcactgtattgactaaatacgaaacagcctagagaggacgagacgacggtccgtagtattagtgtgcgtacgagtangatagtacgactctacgaagtagacgtaggtgtagtgtagtttg

SEQ ID NO: 371465 - DNA, 544 bp, Homo sapiens
  misc_feature: GZ8MTXP02GGUOM.15.67.G01.1.454.CMB.2.raw
  modified_base (303)..(303): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttatggatgacctgggtccncaggctccaggggaaggggctggagtgggtggccaacataaaacaaagacggaaagtacaagaaaaacctatagtggactcgtgtgacgggccattcaccatctccagagacaacgccaaagaattcaactgtatttgacaaaatgaaacagacctagagaggacggaggacacggcgtagtattatgtgcgacgagatgaatacgtacgactctaacaagtacgcgaggtagtatgattg

SEQ ID NO: 371466 - DNA, 622 bp, Homo sapiens
  misc_feature: GZ8MTXP02GGW30.15.67.G01.1.454.CMB.2.raw
  modified_base (213)..(213): a, c, t, g, unknown or other
  modified_base (259)..(259): a, c, t, g, unknown or other
  modified_base (322)..(322): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttcgtgtaggtatttagaagtgtcagtgtgagtgcattggtggagtctggggggagnttggtccaggccggggggggtccctgagactctcctgtgcagtctntggatcacctagagttattggatgacgtggtccgccaggctccgagggagggctggagtgggnggccaaacataaacaaagaacgaagacaagaaaactaatagtaggactgtgttagacggaccggaacttacaccaacttacctacgacgaacgaacgaaacgaaccgaaacgtaaacttaactaacgttagttaagttacgtaacgtaaacgtaacgaaacgaacgtaccgtaggaggaggacggaacggaacgaccggtaccggttagttaagttagttaggtcgacgacgagtagtacgtaagttaacgtacgtacgtacgtaacgtaacgtagtacggtaggtaggtagtagtagtg

SEQ ID NO: 371467 - DNA, 555 bp, Homo sapiens
  misc_feature: GZ8MTXP02GVSM6.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggctccctgagactctcctgtgcagtctctggattcacccttagaagttattggatgacctggtccgccaggctccgagggagggctggagtgggtggaccaacaataaaacgaaagacggaagtacaaagaaaaactagtgtaggactcgtgtgaacggccgattcaccagtcctaccagagaacaacgaccaaagattacacgtagttatttgacaaagtacgaaacagcctagaagacgggcgaaggacgacggcgtgtattagtgtgcgcgagatagatagtacgctactaacagtagcgaggtggtatgtacg

SEQ ID NO: 371468 - DNA, 541 bp, Homo sapiens
  misc_feature: GZ8MTXP02J0TJW.15.67.G01.1.454.CMB.2.raw
  modified_base (515)..(515): a, c, t, g, unknown or other
  modified_base (519)..(519): a, c, t, g, unknown or other
  modified_base (523)..(523): a, c, t, g, unknown or other
tcagtctacgtagccacgaccggtgctcgatttagagtatacatatcgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccaggggaaggggctgggagtggggtggccaacataaacaaagacggaagtcaagaaaaacctatgtggactctgtgacggccgattcacatctccagagacaacgacccaaagaacttcactgtatttgacgtaaatgaaacaagcctagagaggcggaggacacgggccgtgtatagttgtgcgcgagatgagtagtagactntacngtancgaggtggtatcggattg

SEQ ID NO: 371469 - DNA, 543 bp, Homo sapiens
  misc_feature: GZ8MTXP02HMDYN.15.67.G01.1.454.CMB.2.raw
  modified_base (343)..(343): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttatggatgacctgggtccgccaggctccgaggggaaggggctggagtggggtggccaanataaacaaagacggaagtacaagaaaaacctatagtgactgtgtagaccggcgattcaccatctcagacgacaacgccaagatcactgtatttgacaaatgaaacagacctgagaggacgaggacgacggcgtagtattattagtgccgtgagatagatagtacgactctacaagtagactaggtggtataggtattcgg

SEQ ID NO: 371470 - DNA, 546 bp, Homo sapiens
  misc_feature: GZ8MTXP02HSAST.15.67.G01.1.454.CMB.2.raw
  modified_base (347)..(347): a, c, t, g, unknown or other
  modified_base (503)..(503): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggccgggggggtccctgagactctcctgtgcagtctctggattcacccttagaagttattggatgacctgggtccgccaggctccgaggggaaggggctgggagtgggtggccaanaataaacaaagacggaaagtcaaagaaaaacctatagtggactctggtgacggccgattcacccatctccagacgacaacgccaaagattcacttgtatttgacaaatgaaacagcctagagaggcgaggacgacggcgtagtattagtgtagcgngagatgatagtagactctaacaagtagactaggtgtatgtatg

SEQ ID NO: 371471 - DNA, 571 bp, Homo sapiens
  misc_feature: GZ8MTXP02G17XP.15.67.G01.1.454.CMB.2.raw
  modified_base (344)..(344): a, c, t, g, unknown or other
  modified_base (421)..(421): a, c, t, g, unknown or other
  modified_base (437)..(437): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctggagactctcctgtgcagtctctggattcacccttagagttatggatgacctgggtccgcaggctccgaggggagggctgggaggtgggtggaccaanaataaaacgaaaggaccggaagtacaaagaaaaacctgtgtaggactcgtagtagacggcgattcaccatcacaganacaacgcaagatcatntatttgactaaatgaaacagacctaggagacgggacggaaggtaccgacgggcgtagtaagttagttggtgcggacgagtagtagaatacgtacgactctaagaaggttagacgtaggtggtatggtatttcgg

SEQ ID NO: 371472 - DNA, 539 bp, Homo sapiens
  misc_feature: GZ8MTXP02HOXLW.15.67.G01.1.454.CMB.2.raw
  modified_base (411)..(411): a, c, t, g, unknown or other
  modified_base (491)..(491): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagaagttattggatgacctgggtccgccaggctccgaggggaaggggctggaggtgggtggccaaacataaaacaaaagacggaaagtcaaagaaaaacctatgtggactctgtgacgggccattcaccatcncagagacaacgcaaagaattcactgtatttgacaaatgaaacagcctgagaggcgaggacacggcgtgtattatgtgcgngagatagataagtacgactctaagaagtagacgagaggtagtgtagtg

SEQ ID NO: 371473 - DNA, 543 bp, Homo sapiens
  misc_feature: GZ8MTXP02J1DC4.15.67.G01.1.454.CMB.2.raw
  modified_base (346)..(346): a, c, t, g, unknown or other
  modified_base (389)..(389): a, c, t, g, unknown or other
  modified_base (520)..(520): a, c, t, g, unknown or other
  modified_base (524)..(524): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttgggtccaggccgggggggtccctgagactctcctgtgcagtctctggattcacccttagaagttattggatgacctgggtccgccaggctccgaggggaaggggctgggagtggggtggccaanataaacaaagacggaaagtcaagaaaaacctatgtaggactcngtgacgggccgattcaccatctccagagacaacgcccaaagaacttcactgtatttgactaaatgaactagcctagagaggcggaggacacggccgtagtattattgtgcgcgtagatggatagtagactntacngtagcagggtgtatgattg

SEQ ID NO: 371474 - DNA, 542 bp, Homo sapiens
  misc_feature: GZ8MTXP02HHQM6.15.67.G01.1.454.CMB.2.raw
  modified_base (455)..(455): a, c, t, g, unknown or other
  modified_base (515)..(515): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggcccgggggggtccctggagactctcctgtgcagtctctggattcacccttagaagttattggatgacctgggtccgccaggctccgaggggaaggggctgggagtgggtggccaacataaacaaagacggaagtcaagaaaaacctatgtggactctgtagacggccgtattccaccatcaccagacacaacgaccaagaattcatgtattgacaatacgaangcctagagaggcgaggacacggcgtgtattatgtgcgcgagatgatacgacgacttacanaagtaagcgtaggtgtatggtacttgg

SEQ ID NO: 371475 - DNA, 537 bp, Homo sapiens
  misc_feature: GZ8MTXP02IFNW5.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggaggtcgtggggggaggcttggtccgaggccgggggggtccctgagactctcctgtgcagtctctggattcacccttagaagttatggatgacctgggtccgccaggctccgaggggaagggctggagtggggtggaccaacaataaaacaaaggacggaagtacaagaaaacctatgtaggactctgtgacggccgattccaccatctcagagacacgcaagatcactgtattgacaaatgaacagcctgagagcggagacgacggcgtgtattagtgtagcgtcgagatgatagtagacttcacaagtacgagtaggtgtactgattcg

SEQ ID NO: 371476 - DNA, 622 bp, Homo sapiens
  misc_feature: GZ8MTXP02HD7E4.15.67.G01.1.454.CMB.2.raw
  modified_base (308)..(308): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgaggcccggggggtccctggagactctcctgtgcagtctctggattccacccttagaagttatggatgacctgggtccncaggctccgaggggaaggggctgggaggtgggtcggaccaaacaaataaaacgaaaagaacggaaagtacaaagaaaaaacctataggtaggactcgtagtaggaccggccgtaattccaaccaattcctacccaaaggaacgaaaccaaaccgacccaaaggtaaacttacctaactgttaatttagaacctaaaattacgaaacacgcctaggaagagggacggaaggaccgacgggccgtagtatttagtagtgcgcgagatgattaagtacgacctactaacgtaagtagacgtaggtaggtatgtattg

SEQ ID NO: 371477 - DNA, 541 bp, Homo sapiens
  misc_feature: GZ8MTXP02FSCMP.15.67.G01.1.454.CMB.2.raw
  modified_base (344)..(344): a, c, t, g, unknown or other
  modified_base (420)..(420): a, c, t, g, unknown or other
  modified_base (460)..(460): a, c, t, g, unknown or other
  modified_base (503)..(503): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccggggggtccctgagactctcctgtgcagtctctggattcacccttagaagttattggatgacctgggtccgccaggctccgaggggaaggggctgggagtgggtggccaaanaataaaacaaagaccggaagtacaagaaaaacctatagtaggactcgtgtgacgggccgattcaccatctccaganacaacgaccaaagaatcgactgtatttgacaaaatgaaanagcctagagagcgagacgacggcgtgtatatcgtgcgagagangatagtacactctacaagtacgcgaggtgtatgtatcg

SEQ ID NO: 371478 - DNA, 544 bp, Homo sapiens
  misc_feature: GZ8MTXP02FYFL9.15.67.G01.1.454.CMB.2.raw
  modified_base (520)..(520): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtcccgccaggctccgaggggaggggctggagtgggtggcaacataaacgaaagacggaagtacaagaaaaacctatagtaggactctgtagacggccgattcaccatctccagagacaacgccaaagattcactgtatttgacaaatgaaacagccgtagagaggacggaggacgacggccgtagtattagtgtgcgcgagatgatagagtactactanaagtagacgtaggtgtactgattg

SEQ ID NO: 371479 - DNA, 571 bp, Homo sapiens
  misc_feature: GZ8MTXP02IBK5K.15.67.G01.1.454.CMB.2.raw
  modified_base (306)..(306): a, c, t, g, unknown or other
  modified_base (473)..(473): a, c, t, g, unknown or other
  modified_base (562)..(562): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcttgttgttattttagaaggtgtccagtgtgaggtgcacttgggtggaggtcgtgggggaggcttggtccgagggccgggggggtccctggagactctcctgtgcagtctctggattcacctagaagttatggatgacctgggtccnccaggctccgaggggaggggctggagtgggtcggccaaacataaaacgaaagacggaaagtcaaagaaaaacctatagtaggactctagtgaccggccgtattcgaccatccgccagacgaacaaacgacccaaagaattcacttagttaatttgacaaatgaaacngacctgagaggcgaggacgacggccgtgtagttatgtgcgcgagatagtatagtacgacttactacgtaagtagacgtaggttgttagnggtattcgg

SEQ ID NO: 371480 - DNA, 536 bp, Homo sapiens
  misc_feature: GZ8MTXP02FNCP7.15.67.G01.1.454.CMB.2.raw
  modified_base (343)..(343): a, c, t, g, unknown or other
  modified_base (513)..(513): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccaggggaaggggctggagtggggtggccaaanataaaacaaagacggaagtcagaaaaaacctatgtggactctgtgacgggccgattcaccatctccagagacaacgccaaagaattcactgtatttgacaaatgaaacagcctgagaggcgaaggacacggccgtgtattatgtgcgcgagatgatagtacgactctaanaagtagacgaggtgtatgtatcg

SEQ ID NO: 371481 - DNA, 568 bp, Homo sapiens
  misc_feature: GZ8MTXP02GOUGS.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctggtccgccaggctccgaggggaagggcgtggaggtggggtggaccaaaacaataaaaacgaaaagaacgggaaagtaccgaaagaaaaaacctatagtaggaactctgtagacggccgattcaccatctccagagaacaaacgccaaagaatcaactgtatttgacaaatacgaaacagacctagagagacggaacgacgacggcgtagtattagttgtgacgcgagatgatagtagactatacgaagtagacgaggtgtaagtgagttag

SEQ ID NO: 371482 - DNA, 540 bp, Homo sapiens
  misc_feature: GZ8MTXP02FJQYS.15.67.G01.1.454.CMB.2.raw
  modified_base (378)..(378): a, c, t, g, unknown or other
  modified_base (415)..(415): a, c, t, g, unknown or other
  modified_base (455)..(455): a, c, t, g, unknown or other
  modified_base (508)..(508): a, c, t, g, unknown or other
  modified_base (533)..(533): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctggagactctcctgtgcagtctctggattcacccttagaagttattgggatgacctgggtccgccaggctccaggggaaggggctggagtgggtggccaacataaaacaaagacggaaagtcaagaaaaaacctntagtaggactctgtgacggccgattcaccatctccanagacaaacgccaaagaatcactgtattgcaaaatgaaacngcctgagaggcgagacacgcgtgtatatgtgcgcgagatgataacgtagtacncttaagaagtagacgtaggtggtanacgagtg

SEQ ID NO: 371483 - DNA, 576 bp, Homo sapiens
  misc_feature: GZ8MTXP02HBR4G.15.67.G01.1.454.CMB.2.raw
  modified_base (384)..(384): a, c, t, g, unknown or other
  modified_base (550)..(550): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccggggggtccctgagactctcctgtgcagtctctggattcacccttagaagttattggatgacctgggtccgccaggctccgaggggaaggggctgggagtggggtgaccaacaataaaacaaaggaacggaagtacaaagaaaaaccctntagtggactcgtgagaccgggccgtaattccgaccatcctaccagacgacaaacgtaccaagaattcactgtatttgacaaatgaaacagaccgtagagaggacggacggacgaccggtcgtagtattagtgtgcgtcgagagtgaagtagttacgactcgtaaangtagacgtaggtaggtatagagtttg

SEQ ID NO: 371484 - DNA, 534 bp, Homo sapiens
  misc_feature: GZ8MTXP02FQD2T.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccaggggaaggggctggagtggggtggccaacataaaacaaagacggaagtcaagaaaaacctatgtggactctgtgacggccgattcaccatctccagagacaacgccaaagaattcactgtatttgcaaaatgaaacagcctgagaggcgaggacacggcgtgtattattgtgcgcgagatgatagtagactctacaagtagcgaggtgtatggatttgg

SEQ ID NO: 371485 - DNA, 554 bp, Homo sapiens
  misc_feature: GZ8MTXP02HLVRX.15.67.G01.1.454.CMB.2.raw
  modified_base (507)..(507): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtcccgcaggctccgaggggaggggctgggagtgggtggaccaacataaacaaagacggaaagtcaagaaaaaccctagtgtaggactctggagaccgggccgattcaccatctccagagacaacgcaaagaattcactgtatttgacaaatcaaacagccctaggagagggacggagggcgacggcgtgtattagttgtgcgtcgngatgatagacgactcgtacaagtagagagggttagtagtgtagttcg

SEQ ID NO: 371486 - DNA, 531 bp, Homo sapiens
  misc_feature: GZ8MTXP02FNY0J.15.67.G01.1.454.CMB.2.raw
  modified_base (448)..(448): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctggtccgccaggctccagggaagggctggagtgggtggccaaacataaaacaaagacggaaagtcaagaaaaaacctatgtggactctgtgacggccgattcaccatctcagagacaaacgcaaagaattcactgtattgcaaaatgaaanagcctgagaggcgagacacggcgtgtatatgtgcgcgagatgatagtacgactctaacgaagtagctaggtggtaatggattg

SEQ ID NO: 371487 - DNA, 546 bp, Homo sapiens
  misc_feature: GZ8MTXP02F9RIM.15.67.G01.1.454.CMB.2.raw
  modified_base (457)..(457): a, c, t, g, unknown or other
  modified_base (521)..(521): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccgaggggaaggggctgggagtggggtggccaaacataaaacaaagacggaagtacaagaaaaacctagtgtggactctgtagaccggcgattcaccatctccagacgacaacgccaaagattcactgtatttgacaaatgaaacngcctagacgaggacgaggaccacggcgtgtatattgtgcgcgagatgaatagtacgactctaanaagtagacgaggtggtatgatttcg

SEQ ID NO: 371488 - DNA, 595 bp, Homo sapiens
  misc_feature: GZ8MTXP02F4AZS.15.67.G01.1.454.CMB.2.raw
  modified_base (589)..(589): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacttggtggagtcgtggggggaggcttggtccaggccggggggtccctgagctctctgtgcagtctctggattcacccttagaagttattggatgacctgggtccgccaggctccgaggggaagggctggagtggggtgccaaacataaacgaaagacggaagtacaagaaaaaacctatagtggactcgtagtacgacggggccaatttccaaccgtaatctaccaagaacggaacaaaccgacccaaagtaaacttctaaactgttaatttcgactaaaatgaaaacacgaccgtaggagagggacggaggaaccgtacggccgttagtattagttgagccgacgagatagaatacgtacgacttctaagaagtacgcgaggtggttangtactg

SEQ ID NO: 371489 - DNA, 567 bp, Homo sapiens
  misc_feature: GZ8MTXP02HVQEV.15.67.G01.1.454.CMB.2.raw
  modified_base (341)..(341): a, c, t, g, unknown or other
  modified_base (372)..(372): a, c, t, g, unknown or other
  modified_base (380)..(380): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagaagttatggatgacctgggtccgcaggctccgaggggaggggctggagtgggtggccaaanataaaacaaagacggaagtcaagaaaacctntgtgactntgtagacggccgtattcaccctatcctaccgagacgaaccaaacgacccaaagaacttcacttgttaatttgactaaatgaaacagacctaggaggagggcggaacggaccgacgggaccgttggtattagttgtagcgcgagagtgatagtagtactactacaagtagcgaggtggtatggacttg

SEQ ID NO: 371490 - DNA, 587 bp, Homo sapiens
  misc_feature: GZ8MTXP02HFNCF.15.67.G01.1.454.CMB.2.raw
  modified_base (466)..(466): a, c, t, g, unknown or other
  modified_base (536)..(536): a, c, t, g, unknown or other
  modified_base (540)..(540): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgtttattttagaaggtgtccagtgtgaggtgcacttggtggagtcgtgggggaggcttggtccgaggcccggggggtccctggagactctcctgtgcagtctcgtggattcaccccttagaagttattggatgaccgtgggtcccgccgaggcctaccgaggggaaggggcgtgggaggtgggtggaccaaacaataaaacgaaaaggacggaaagtacaaagaaaaaacctagtagtaggactcgtggtagacggccattccaccatctaccagagacaaacgaccaaagattacactntatttagactaaatacgaaacagccgtagaggaggacgaagacgacggtccgtagtattagtgtgacggngagntagatagacgtactagtaacgaagagaggtaggtagtagtagtagtg

SEQ ID NO: 371491 - DNA, 538 bp, Homo sapiens
  misc_feature: GZ8MTXP02J2G4I.15.67.G01.1.454.CMB.2.raw
  modified_base (460)..(460): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccaggcccggggggggtccctggagactctcctgtgcagtctctggattcacccttagagttattggatgacctgggtccgccaggctccgaggggaggggctggagtgggtgccaacataaacaaagacgaagtcaagaaaacctatgtggactctgtgacggccgattcacatctaccagacgaacaaacgccaaagacttcactgtatttgacaaatgaacagcctgagngcgaggacacggctagtattagttgagcgcgagatgaatacgacgactacacaagtacgacaggtagtatggattcgg

SEQ ID NO: 371492 - DNA, 778 bp, Homo sapiens
  misc_feature: GZ8MTXP02GW6YT.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctgagactctcctgtgcagtctctggattcacccttagaagttattggatgacctgggtccgccaggctccgaggggaaggggctggaggtgggtggaccaaacataaaaccgaaagaacggaagtaccgaagaaaaaacctagtgtacggaacttctaggtacggaccggggccgaagttcccaaccctagttcctaccccaaggaaacgaaccgaaaacccggaccccaaaaaggtaaaactttacccgtaaaccgttacggtttaaatttttacggtaaacccttaaaaagttaacggaaaaaccgtaacgaaccccgtttagggaaagggaacgggaccggggaaagggaaacccgaaccggggaccccgggtttagtaaacgttttaagtttagggttacgggcccggttacggaaaggtagttacggtaaaagttaaggttaacgggtaaccttaaccgtttaaccgaaggtttaaccggacggtaacggggtagggtttaacgtacggggttaactttttacgggg

SEQ ID NO: 371493 - DNA, 535 bp, Homo sapiens
  misc_feature: GZ8MTXP02I54A1.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccaggggaaggggctggagtgggtggccaacataaaacaaagacggaagtacagaaaaacctatgtggactctgtgacggccgattcaccatctccagagacaacgccaaagaattcactgtatttgacaaatgaaacagcctagagaggacgaggacacgggccgtgtattattagtgcgcgagatgatagtagactctacaagtagcaggtgtaatgattg

SEQ ID NO: 371494 - DNA, 559 bp, Homo sapiens
  misc_feature: GZ8MTXP02H2CI9.15.67.G01.1.454.CMB.2.raw
  modified_base (306)..(306): a, c, t, g, unknown or other
  modified_base (326)..(326): a, c, t, g, unknown or other
  modified_base (343)..(343): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctggagactctcctgtgcagtctctggattccaccttagaagttatggatgacctgggtccncaggctccgaggggagggcngggagtgggtggccaanataaaacaaagacggaaagtacaagaaaaaacctgtagtggacttctggtacgacgggcctaattcaccatcaccagaacgacaaacgaccaagtaactcactgtatttgaactaatagaacagcctagagaggcgaggacgacggcgtagtattagttgtagcgcgagagtagatagtacgactacacgaagtacgacgaggtagtatgtacttg

SEQ ID NO: 371495 - DNA, 600 bp, Homo sapiens
  misc_feature: GZ8MTXP02H0VVS.15.67.G01.1.454.CMB.2.raw
  modified_base (349)..(349): a, c, t, g, unknown or other
  modified_base (544)..(544): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgaggcccgggggggtccctgagactctcctgtgcagtctctggattcacccttagaagttatggatgacctgggtccgccaggctccgaggggaagggcgtggaggtggggtggaccaanaaagtaaaacgaaaggaaccggaagtacaagaaaaacctataggtaggactctaggttacgacgggccgtaattccacctaatctaccagagacaacgaccaagaatcgactgttaatttgactaaatagaaacagcctagaggacggcggaaggacgaaccgggccgttaggtattagttagtgcgacgagtanagtaataagtagacctactacgtaagtagacgtaggtaggtatacggtaatttcgg

SEQ ID NO: 371496 - DNA, 553 bp, Homo sapiens
  misc_feature: GZ8MTXP02JPYO4.15.67.G01.1.454.CMB.2.raw
  modified_base (416)..(416): a, c, t, g, unknown or other
  modified_base (472)..(472): a, c, t, g, unknown or other
  modified_base (509)..(509): a, c, t, g, unknown or other
  modified_base (525)..(525): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtcccgccaggctccgaggggaaggggctggaggtgggtggccaacataaaacaaagacgaagtcaagaaaaacctatgtggactctgtagacggccgattccaccatctacaganacaacgccaagaattcactgtaatttgacaaatagaaacagaccctaggagacggngacggacacgggccgtgtacttagtgtagcgacgagntggattagtagactanacaagtacgacgaggtagtatcgattag

SEQ ID NO: 371497 - DNA, 560 bp, Homo sapiens
  misc_feature: GZ8MTXP02GR758.15.67.G01.1.454.CMB.2.raw
  modified_base (427)..(427): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctggagactctcctgtgcagtctctggattcacccttagaagttattggatgacctgggtccgccaggctccgaggggaaggggctgggaggtggggtggaccaaacaataaaacgaaaggaacggaaagtacaagaaaaacctatgtagactctgtagacggccgatcaccatctccaganacaaacgaccaagaatcactgtatttgacaaatagaaacagcctagacgaggacgaggacacggccgtagtacttagtgtgcgtacgagatgaatagtacgactctaacaaggtagcgtaggtgtatgtattg

SEQ ID NO: 371498 - DNA, 546 bp, Homo sapiens
  misc_feature: GZ8MTXP02IEMZT.15.67.G01.1.454.CMB.2.raw
  modified_base (388)..(388): a, c, t, g, unknown or other
  modified_base (415)..(415): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattcacccttagaagttatggatgacctgggtccgcaggctccaggggaaggggctgggagtgggtggccaaacataaaacaaagacggaaagtcaagaaaaaacctatagtagactntgtagacgcgattcaccatctccaganacaacgccaagaatcactgtatttgacaaatagaaacagaccctagagagggacgagacgacggccgtagtattattgtgcgtcgagatgatagtagacctatacgaagtagactagggtagtatgtatcg

SEQ ID NO: 371499 - DNA, 560 bp, Homo sapiens
  misc_feature: GZ8MTXP02GK4GY.15.67.G01.1.454.CMB.2.raw
  modified_base (383)..(383): a, c, t, g, unknown or other
  modified_base (513)..(513): a, c, t, g, unknown or other
  modified_base (535)..(535): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggcccgggggggtccctggagactctcctgtgcagtctctggattcacccttagaagttattggatgacctgggtccgccaggctccgaggggaaggggctggagtgggtggccaaacataaaacaaagacggaagtacaagaaaaacctangtggactctgtgacggccgattcaccatctccagagacaaacgccaaagaattcactgtatttgacaaatgaaacagacctaggagagggacggaggaaccgacggccgtaggttaattagttggtgcgngagatgatacgtagactcctanaagtagagaggtggtatggattcgg

SEQ ID NO: 371500 - DNA, 537 bp, Homo sapiens
  misc_feature: GZ8MTXP02G1DDJ.15.67.G01.1.454.CMB.2.raw
  modified_base (343)..(343): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccgaggggaaggggctggagtgggtggccaanataaaacaaagacggaagtcaagaaaaacctatagtggactctgtgacggccgattccaccatctccagagacaacgccaaagaattcactgtatttgactaaatgaaacagcctgagagggcgaggacacggcgtgtattatgtgcgacgagatgatagtacgactctacaagtagcgaggtaggtatggatg

SEQ ID NO: 371501 - DNA, 531 bp, Homo sapiens
  misc_feature: GZ8MTXP02I72GK.15.67.G01.1.454.CMB.2.raw
  modified_base (307)..(307): a, c, t, g, unknown or other
  modified_base (345)..(345): a, c, t, g, unknown or other
  modified_base (377)..(377): a, c, t, g, unknown or other
  modified_base (402)..(402): a, c, t, g, unknown or other
  modified_base (506)..(506): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccggggggggtccctgagactctcctgtgcagtctctggattcacccttagaagttattggatgacctgggtccnccaggctccaggggaagggctgggagtgggtggccaanataaacaaagacggaagtcaagaaaaacctangtggactctgtgacggcgatcaccntctcagagacaacgccaaagatcactgtattgacaaatgaaacagcctgagaggcgagacacggcgtgtattatgtgcgtgagatcgaatagtacgactctaanaagtagacaggtaggatggaattcg
